United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 24

SEQ ID NO: 127970 - protein, 105 aa, Glycine max
  Coding DNA Sequence Number=SeqID_36285
  Pfam annotation: Domain name=Transposase_23; Domain location=1-62; Score=-9.6; E_value=0.013; Accession=PF03017.5; Description =TNP1ENSPM transposase
EEAKTCEMLECDEDDARVRRTRCSDVDRDLEVKVGVEEVKDPDVPIPVPTNEVSLVGQAIHTFLAWLTHLEVVSLAKPPQNTDPEVDDLLYLMTMTIPELFLGPY

SEQ ID NO: 127971 - protein, 106 aa, Glycine max
  Coding DNA Sequence Number=SeqID_36286
MAVMDLSLGDPLYRKSSWRFSYVVARGPQESPWYFFPSIFSQQWYQELEWRRVMQEEMQSLHENNTYELVEWRIAMQEEMKFLHENNTYELVVEKSHSRREAILAW

SEQ ID NO: 127972 - protein, 131 aa, Glycine max
  Coding DNA Sequence Number=SeqID_36287
MTITALGALYTSSASRPSRDGHFLRERRVQLRDDEYTDFQEEIGRRRWTSLVTPMAKFDPEIVLEFYANAWPTEEGVRDMRSWRVKSASMARGGTGLMGSMRRPSLNCYVYWGKILPRLLQGGECESCAPT

SEQ ID NO: 127973 - protein, 128 aa, Glycine max
  Coding DNA Sequence Number=SeqID_36288
MKSLRGKEIALVKVQWGPTRGFILSVLIYILPTFENGPRRVQRNARNWNQRDDTQTEAEFQHPKGQNFSPLWLSMKSNKGIKKFQQLFFSLPRSFSSSFFSTIEASIEAPKLLIISTPNCKEKPFSES

SEQ ID NO: 127974 - protein, 62 aa, Glycine max
  Coding DNA Sequence Number=SeqID_36289
  Subcellular localization annotation: CTP_CleavageSite=16; ConfidenceScore=5.10e-01
MRTRSPLKARACSPLQARTYSPLKVIGTSTQGFTFMRKQEIDSSRGQTHATFVVKFGNADRT

SEQ ID NO: 127975 - protein, 136 aa, Glycine max
  Coding DNA Sequence Number=SeqID_36290
KKRRSRDESRHGLITERVSKAGQLSYPNFVRGLLLDDMQPLIGRFKILGTLCCTICKSRDMPEVKRKQGYVIRAQWSRQLSQHALLRACEARVTGALSKGGKMRGVATKVYLWKTSEKPKETGQNENSKFGSCIYV

SEQ ID NO: 127976 - protein, 83 aa, Glycine max
  Coding DNA Sequence Number=SeqID_36291
MHIVVVKQGQDHLELPSGVGTKHEHQKPIKVLRNGCKWGWGHDRPIVAPFSALNKQRMSRKAAQYPLNSQYFTTIVCFLVINA

SEQ ID NO: 127977 - protein, 122 aa, Glycine max
  Coding DNA Sequence Number=SeqID_36292
MAHIVVMTLARAQVKNFMNIMKEGIGHILDLTPIGEKRKESLKRLTLTYHTSMGRTIGHITYQCPTKKIMIMRGQDTYSSQDEATTSPSSSESEEAKGEESSEEIYPQEEGQPLMVKEECKE

SEQ ID NO: 127978 - protein, 75 aa, Glycine max
  Coding DNA Sequence Number=SeqID_36293
MIYYGASIGHLRQNVCPSEFARVFLVDFRISPESSLLLPGSLHRFLALCGDPRKGYGRLYLRWASFFNNDGLNIS

SEQ ID NO: 127979 - protein, 141 aa, Glycine max
  Coding DNA Sequence Number=SeqID_36294
MDNEEGVQEQMKADLSALKDQMDSISEVMYSPQAYPYGLPPDFTPRATPEDLSQAPTFEGQLPPYDDYPGQDDEEGDTHLGPLLHLKDPSPHELPQPNIVRHVSASPTPVKESVPFVKDKGKIEALEERLRAVEGLGNYPF

SEQ ID NO: 127980 - protein, 208 aa, Glycine max
  Coding DNA Sequence Number=SeqID_36295
  Homolog annotation: Hit_ID=A7UQU7; Match level="QueryCoverage=71%, HitCoverage=26%, E-value=7e-16, Identity=36%"; Hit description=IMP dehydrogenase/GMP reductase, putative
  Pfam annotation: Domain name=DUF1723; Domain location=120-169; Score =50.0; E_value=8.5e-12; Accession=PF08330.1; Description=Protein of unknown function (DUF1723)
MIPMMLRSDEPVVPAPDVQDGPMEALAAVEDIVADIPTDTGTKAAEDEHEGFSSGPSDPSVLTQYADHVACSVWTKEERPELKLSSHGRKVHSLGRPVPAIEELVAGTGLSPLIACSVDTGDRGLLSVFVERWHREMSSFHFLVGELTITLDDISSLLHLPVIGDLHAFEPLHVDNAVQMLVDLLMAFAESARAETAQCRGPYVRLQW

SEQ ID NO: 127981 - protein, 218 aa, Glycine max
  Coding DNA Sequence Number=SeqID_36296
  Gene Ontology: Mol. function=RNA-directed DNA polymerase activity; Biological process=regulation of transcription, DNA-dependent
  Homolog annotation: Hit_ID=A5CBG1; Match level="QueryCoverage=67%, HitCoverage=10%, E-value=7e-20, Identity=33%"; Hit description =Putative uncharacterized protein
MAIPFKTKDVNEEEASPSIPIEKPLFKPFKVSEKAKRKIRELRKTKSLIEGVGDNHSELLNKIGSLLKVIPDTPQASENTSKMVTRSTSKLINVINEDSDQNSDNTTEIGSVSEKNINPINSKHWKTPSKLYYQRPTAPDLLLEERDAQTEYNIMNTLQHMTMVATTYQTSHECSEETIIDILVAGFSGQLKGWWDNYLTNEEKSKIYSAVKTDLNGK

SEQ ID NO: 127982 - protein, 281 aa, Glycine max
  Coding DNA Sequence Number=SeqID_36297
  Gene Ontology: Mol. function=beta-N-acetylhexosaminidase activity; Cellular component=periplasmic space; Biological process =carbohydrate metabolic process
  Homolog annotation: Hit_ID=A4W600; Match level="QueryCoverage=99%, HitCoverage=35%, E-value=1e-126, Identity=77%"; Hit description=Beta- N-acetylhexosaminidase precursor
  Pfam annotation: Domain name=Glyco_hydro_20; Domain location=144-281; Score=-29.7; E_value=1.5e-10; Accession=PF00728.13; Description =Glycosyl hydrolase family 20, catalytic domain
  Pfam annotation: Domain name=Glyco_hydro_20b; Domain location=18-142; Score=58.2; E_value=2.9e-14; Accession=PF02838.6; Description =Glycosyl hydrolase family 20, domain 2
  Pfam module annotation: Pfam domain module=Glyco_hydro_20::Glyco _hydro_20b; Domain location=144-281::18-142
MALAAPAGDLPLMPWPAHVERPQAQGALALNNQLTINVSGDDLGEAATRWRERVARQTGWTLQPQTAPAKSPTINVIVSKKVPFLPQPDSDESYQLTVNADGATLKANTRFGALRGMETLLQLVQNGPDGTTIPYVAIDDAPRFPWRGLLLDSARHFMPLSAIKRQIDGMAAAKLNVLHWHLTDDQGWRFASSRYPKLQQQASDGLFYTQAQMKDIVRYAAERGIRVVPEIDMPGHASAIAVAYPELMSAPGPYAMERHWGVLKPVLDPTKEATYAFAEAM

SEQ ID NO: 127983 - protein, 158 aa, Glycine max
  Coding DNA Sequence Number=SeqID_36298
  Homolog annotation: Hit_ID=A5C8M0; Match level="QueryCoverage=74%, HitCoverage=12%, E-value=5e-09, Identity=31%"; Hit description =Putative uncharacterized protein
QVGAGKLPNSLIAVLWNFLLLILELQLGCPLANNQDQPWSRILISKYGGWKELIYGGRRNFTSQWWQDLKSIFQQHHNECLTDNLKWRVGRGSSINFWKHKWMEDNCTLQGKYPQLYLISKQQNSSINYMGDFVEGRWEWKLSWRRTSKCTLISGQPI

SEQ ID NO: 127984 - protein, 167 aa, Glycine max
  Coding DNA Sequence Number=SeqID_36299
  Homolog annotation: Hit_ID=A5BRV3; Match level="QueryCoverage=85%, HitCoverage=9%, E-value=2e-07, Identity=33%"; Hit description =Putative uncharacterized protein
MKDGELIQSELPPATQYQLPNVKDSNNKHVMVVPFKTKDVNEEVTSKDIKSLMEQANYTNKYLQVLGETIKTKVVPKQKSVEEASPSIPIEKPLFKPFKVSDKAKRKIRELRKTKSLIEGVGDNHSELLYKIGSLLKVIPETPQTSENTSKMLQPTKPPMNVWKKPL

SEQ ID NO: 127985 - protein, 154 aa, Glycine max
  Coding DNA Sequence Number=SeqID_36300
MTRSKRVSMNEGEKRIGEEKQQLVTEPEIDPVVEPLSETKEEVEAKDDQQKEIPIIVSEKEISEKEKKEKEREKEKENEKNEKEKENKRKEEKKKTKSELAREKRKDASPSKREKPTKKDKERHLARFLDIFKKLEITMPFGEALQQMSLYSKF

SEQ ID NO: 127986 - protein, 68 aa, Glycine max
  Coding DNA Sequence Number=SeqID_36301
MDTRLRVIGDPMNGVQRVTTKLGRGHNSLFEDSPSECGGGAATVRYGLISKGHSRNKIQAQGRVTRYH

SEQ ID NO: 127987 - protein, 153 aa, Glycine max
  Coding DNA Sequence Number=SeqID_36302
MASRKRKALASVSQARCDRSIFVSQYAWDCYANNVLCWKILLERNVKLYITKFDEFRREIERRNWYKELTNFFGGSIDVALVKEFYANLYDLEDKSPKQVRVRGNLIKFDDDALNTFLKTPVVIEERESLPSYSRFCRLRPDLQELAARLCIP

SEQ ID NO: 127988 - protein, 90 aa, Glycine max
  Coding DNA Sequence Number=SeqID_36303
MWTITGEELATQLAQASKVASSRSNRPLEEGSGRPKWARLLFVPPFLLNAPPSIFLLSKKLRKLTNCAKTPHFDFRHITEFHGSRKPASF

SEQ ID NO: 127989 - protein, 73 aa, Glycine max
  Coding DNA Sequence Number=SeqID_36304
FHSLSLEEISLSFASGKRMRIPLLQAKVQKGPRLCFNGVFYRGNPILISGAKQIWVTRCRSRAELPHYSIRHA

SEQ ID NO: 127990 - protein, 66 aa, Glycine max
  Coding DNA Sequence Number=SeqID_36305
MEVEEPWLGLWLPLHYRVDMGAGLMADLGVPFVDDWVFLVDRVVGNEKGRYLLSNDIVELVGNLAM

SEQ ID NO: 127991 - protein, 187 aa, Glycine max
  Coding DNA Sequence Number=SeqID_36306
  Homolog annotation: Hit_ID=Q6WAY6; Match level="QueryCoverage=81%, HitCoverage=30%, E-value=1e-20, Identity=35%"; Hit description =Putative uncharacterized protein
RFAVVVGDSARELDRMKQTRNGVVGLPRKYLEDKARDMVNQEEWVPFADILDLLIFGVVLFPNVDGLVDLAAIDAFLAYHHSKESPVVAILADLFDTFDRRHPCPLQRVDWDQYLAGIGGSTINWFPRWKEGKEGVLFSCGDYPNVPLIGTRGCINYKPALAIRQLGYPMRGAPTGESLSPFLVRDF

SEQ ID NO: 127992 - protein, 58 aa, Glycine max
  Coding DNA Sequence Number=SeqID_36307
  Subcellular localization annotation: CTP_CleavageSite=21; ConfidenceScore=5.22e-01
MVLVAAIATALTSIISFMLIMASIIVAICSFKASVSAFTCSCTSSTSPITLARVRTWG

SEQ ID NO: 127993 - protein, 298 aa, Glycine max
  Coding DNA Sequence Number=SeqID_36308
MAKFDPEIVLEFYANAWPTEEGVRDMRSWVRGQWIPFDADAIGQLLGYSLVLEEGQECEYGQRRNQSDGFDEEAIAQLLCIPGQDFARTAAGRRVRIMRTNMTTLTQIWMTLLLSNILPTDHIPTFPCRSVSWWPWDSPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPGAPGDGEEAHEDGEMADLLDFLGGSGDT

SEQ ID NO: 127994 - protein, 98 aa, Glycine max
  Coding DNA Sequence Number=SeqID_36309
MAITLFSCTKSPDKNAEQHTDRASSATETQSAAQLENTNTAEQINNKSNEKTAVKDPVNNFSIDPLIKDYLILKNALVADNDQAVATAGKQLLATLEK

SEQ ID NO: 127995 - protein, 206 aa, Glycine max
  Coding DNA Sequence Number=SeqID_36310
  Homolog annotation: Hit_ID=Q9AVH2; Match level="QueryCoverage=56%, HitCoverage=46%, E-value=2e-56, Identity=81%"; Hit description =Putative senescence-associated protein
MPTRDQRMLLLGLRWHLYEKSKSLGSGGSMVARLKLKDDRLRALSYSMGGGAWPFLVVERFVWDYGRLGHGGRGPLLLVGKRTAGARVASSPDSDLEAFSHNPTHGSFAPLAFQPSAMTNCANQRVNPPLSHDGLNPAHVPYWWVNNPTLGEFCFTMIGRADIEGSKSNVAMNAWLPQASYPCGNFSDTSSFKFRRTKGLIGHAFT

SEQ ID NO: 127996 - protein, 102 aa, Glycine max
  Coding DNA Sequence Number=SeqID_36311
GALIDDWKFNFSVHDARRLVCTNQADMTERLLGGSLAFESRILHYLIVRILLPRSSNLAQGARNVGEEGNEGEDSSLLSKIMDRFDGLQTFVGERFDTLETA

SEQ ID NO: 127997 - protein, 103 aa, Glycine max
  Coding DNA Sequence Number=SeqID_36312
MGEAREEPRDHALGEFEPYTTYATKGPTFGGMPQPHTSGAPQHHPLQPLHFSMGRLPLTMEEREKYDLIEERLRTIKGIGDYPFADMAKLCLVHDVVIPPKFK

SEQ ID NO: 127998 - protein, 159 aa, Glycine max
  Coding DNA Sequence Number=SeqID_36313
  Gene Ontology: Mol. function=sequence-specific DNA binding; Cellular component=intracellular; Biological process=regulation of transcription, DNA-dependent
  Homolog annotation: Hit_ID=A6EEU5; Match level="QueryCoverage=77%, HitCoverage=62%, E-value=3e-16, Identity=33%"; Hit description=RNA polymerase ECF-type sigma factor
  Pfam annotation: Domain name=Sigma70_r4_2; Domain location=107-157; Score=40.6; E_value=5.6e-09; Accession=PF08281.3; Description=Sigma -70, region 4
MDLKAVPLSLDEFNRFKLGDEKVRRVCPSYLDVEEIMQEIFVQLFLKRNSIPSAEAIFPFLFIVAKRMAITLFRKELSRQKFQVSHLAEWDELSDELERKIAHKDLDKILQTIVSRLPPQQQLVFNKSKIDKMSYAEISEEIGISKNTVRNHLVAACQF

SEQ ID NO: 127999 - protein, 260 aa, Glycine max
  Coding DNA Sequence Number=SeqID_36314
  Homolog annotation: Hit_ID=A5AKA6; Match level="QueryCoverage=73%, HitCoverage=21%, E-value=8e-07, Identity=19%"; Hit description =Putative uncharacterized protein
DGIISSEVHGISMIIDQSLFFSLTKLASQGAPFEGTIVDDCKFDYSSHDARRMVCNDQAEMTGRLLAGSLTFDNCIMHYIIVRILLPRSSNLAEASEEDLILMWAFLTSRQIDWAHLVWYRMHRALRANAPLPYPQLVTLFLRHFQIPLDDEPFVQVKRSFAIGAGAVTSFGYSKDRNGQWLKKDALPPQDERTPSPPPQRDDSALMTEVLLELRGLRTYVGERFDSLDTHFAGMDIHLTQLEEDVGYIRQSFDLPPPHS

SEQ ID NO: 128000 - protein, 88 aa, Glycine max
  Coding DNA Sequence Number=SeqID_36315
ISAYHGCRMTKLGLCVPSDTTVSEWQRGADNRQVSPRIMGISAYHGCRMTKLGLCLSSGPPPLDDKRGANNHKGADNHKVSPRIMGAE

SEQ ID NO: 128001 - protein, 100 aa, Glycine max
  Coding DNA Sequence Number=SeqID_36316
MVTQNNESSKFLLWDRECAELIGETADDVNRVKIELVNLCCFWKDGDLDLNASPQALDKFLGHVLAFKACSKIDPSNVDCNNTTHAECFMLYATISVCHS

SEQ ID NO: 128002 - protein, 149 aa, Glycine max
  Coding DNA Sequence Number=SeqID_36317
MAPTRHPLDPDKSNRALGFPALITGLCQSFGVPVAPSKVIRPPITRAFIKKYCTQRQVQGDAPQAADAPPPHQAGPAGSFDTEQYLRHLVRQQAANHRAHFRAEVAWPGDWPEARAGEAPAEAPDEADEAREDEEMTDLLDFLGGSGAT

SEQ ID NO: 128003 - protein, 15 aa, Glycine max
  Coding DNA Sequence Number=SeqID_36318
GILISSSLALFIIFC

SEQ ID NO: 128004 - protein, 105 aa, Glycine max
  Coding DNA Sequence Number=SeqID_36319
MIIKENANIYVQNTFRKDAPSLGTKRTARKVLKHTILRRNEVDMAFNKVIQEKVWVTVLLLGDSNIHTERDTTFTDRGAASNTHTGITRPIRNNQPPHYLKDYIT

SEQ ID NO: 128005 - protein, 125 aa, Glycine max
  Coding DNA Sequence Number=SeqID_36320
  Subcellular localization annotation: CTP_CleavageSite=42; ConfidenceScore=5.21e-01
MRVHCNQASRRPSMITDSPPLPYAPMNPGIGPFFTHMESPTVATYPSAGGRRETRGMRVPRKEYARSRHQRLFEENVGKTGKDAIYELLSEKVRELYLRTGKDVSLCSYVPSLERKSDCVVLSIK

SEQ ID NO: 128006 - protein, 64 aa, Glycine max
  Coding DNA Sequence Number=SeqID_36321
  Gene Ontology: Mol. function=nucleic acid binding
  Homolog annotation: Hit_ID=A5BW89; Match level="QueryCoverage=84%, HitCoverage=4%, E-value=3e-11, Identity=57%"; Hit description =Putative uncharacterized protein
MVCVASATNVSAQVSNIPMLNETNFKVWKEVVEIVLGCMDLDLALRTKRPTSTPEASNEVKIEK

SEQ ID NO: 128007 - protein, 125 aa, Glycine max
  Coding DNA Sequence Number=SeqID_36322
MAVQLIRDRVEMECLEGAWETLEGTRDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 128008 - protein, 108 aa, Glycine max
  Coding DNA Sequence Number=SeqID_36323
MSSVSIYYAPESDIRVKGYDHFNFSRAFVVQFRASRYVMFLNRTSGVTTYDHLNFSRASICSILSVSIYDAPESDIRSESYDNFNFLRASVVQFRAARFGMGLKRNSE

SEQ ID NO: 128009 - protein, 279 aa, Glycine max
  Coding DNA Sequence Number=SeqID_36324
FNDPVGAEQAAEQAVENALIEGWRAEIPTENAAIFWDEAGVIDETLADRDRRIRLVVTLDDFGITLAAGEFIQGIEGLEPLGGQNALGRPDAEIHAVEGKILLNRFFGIGGIGCRRYGCEVGGLLQLPFLQCQSGAVSPAEMAMLPVLSLRKRGSREWISRMSCSSDPDGGKTPDDRLGQGVAVEAPDRQVAGVIFDLDRELVGIGGIGGDVDGETRLVHEGVAEIAFADEIAGKLLAFGGVQPGNGRSCRIGGDLLHRIGGHQINAVAIMVSRTRKNI

SEQ ID NO: 128010 - protein, 193 aa, Glycine max
  Coding DNA Sequence Number=SeqID_36325
GDSSCLLQVLQTETRPSGAGCPICIPGKGFVLNAEGLPWKLLMKDLITLVQTWNVMSYFNLAPTSHTSDLNMDRARARGSEGPSSATPQTSTAPAPIPLALVPATFDPSTQSTDLMMAMLPGVQPSSHGGGEASTAQEPKPDPETTPAGQEDDSEAIPPESFVPKTDPETDPVIAEASPQASLVSTPMLELST

SEQ ID NO: 128011 - protein, 262 aa, Glycine max
  Coding DNA Sequence Number=SeqID_36326
  Homolog annotation: Hit_ID=A5AZG1; Match level="QueryCoverage=31%, HitCoverage=26%, E-value=2e-07, Identity=35%"; Hit description =Putative uncharacterized protein
  Pfam annotation: Domain name=zf-CCHC; Domain location=61-78; Score =21.5; E_value=0.00084; Accession=PF00098.14; Description=Zinc knuckle
MSQQQLKRKSTSKFYGSHSYPKKDQGQGILGVTPSKPKDDKGKTIEKQPFKASMQEKTSSMKCFKCLGRGHITSQCPTKKTMIMRGQDIYSSQDEVTTSPSSSESGEAKGEESSEEIYPQEEGQPLMVKEECKEVSVSSKRLAKKERHFEIKTNIKEISPLRQPPHFLLCKKTLVSIATPLRLEFIPQVKELLDEGLVRKSLNPCALLVPKICIIRHQIPKIGGMMNVLSGATLFCKITCAPNIFMICVHRDTLSRYSYGTP

SEQ ID NO: 128012 - protein, 207 aa, Glycine max
  Coding DNA Sequence Number=SeqID_36327
  Homolog annotation: Hit_ID=A7ZKL2; Match level="QueryCoverage=86%, HitCoverage=99%, E-value=2e-84, Identity=81%"; Hit description =UPF0227 protein ycfP
  Pfam annotation: Domain name=UPF0227; Domain location=29-206; Score =365.4; E_value=9.1e-107; Accession=PF05728.3; Description =Uncharacterised protein family (UPF0227)
GESRRRIAAQSGNDEGRARGPWLVARIHMIIYLHGFDSTSPGNHEKVLQLQFIDPDVRFISYSTLHPRHDMQHLLKEVDKAVQQGGDAHPLICGVGLGGFWAERIGFLCGIRQAMFNPNLYPEEHMHGKIDRPEEYRDIATKCVEDFREKNRDRCLVVLSRHDEVLDNRRSAELLHHYYEIVWDEQQTHKFKNISPHLQRLKAFKAL

SEQ ID NO: 128013 - protein, 56 aa, Glycine max
  Coding DNA Sequence Number=SeqID_36328
MLVRMIDTRLFAAARVKSCPGVDMEHTENEDVAPLKGEGVQPSAGEDVQSSDGEDI

SEQ ID NO: 128014 - protein, 79 aa, Glycine max
  Coding DNA Sequence Number=SeqID_36329
MNIEESIHVTFDESNAILSRKNMLDDIAESLEQIHIHGQDSKGKGKGSNEDPPEEVKKKYMLNNHQVLKYWISQIMSIN

SEQ ID NO: 128015 - protein, 81 aa, Glycine max
  Coding DNA Sequence Number=SeqID_36330
  Homolog annotation: Hit_ID=Q2AA51; Match level="QueryCoverage=67%, HitCoverage=17%, E-value=2e-07, Identity=45%"; Hit description =Retrotransposon gag protein
MHALLGSFNSGNWSNSKVLDSMELSCCTITRNRGVPDEAIRLSQFSFSLAGEAKRWLYLFKGNSLKTWEEVVEKFLKKYFP

SEQ ID NO: 128016 - protein, 116 aa, Glycine max
  Coding DNA Sequence Number=SeqID_36331
MDEFDAQVAWPGTQLSLSGGGGASAAQEPASEDAAATAEGEDELTPPKPFYFDADALMAQEDGTSTYQIPEPSPAPVPKETQPCTPVREPEQPIQDSSAAPALDLNEDQPQDEQDI

SEQ ID NO: 128017 - protein, 113 aa, Glycine max
  Coding DNA Sequence Number=SeqID_36332
MGETHEVPQDHTLDDSEPCLGYATEGQAFGGVPLPNTLGGPQYRPQPQPLHFAVGRVPPAMVEREKLDHIEERLRVLEGGKNYAFADMAELCLVPDVVIPPKFKVSNIDCGIL

SEQ ID NO: 128018 - protein, 757 aa, Glycine max
  Coding DNA Sequence Number=SeqID_36333
  Gene Ontology: Mol. function=transporter activity; Cellular component= cell outer membrane; Biological process=transport
  Homolog annotation: Hit_ID=A1FYG4; Match level="QueryCoverage=64%, HitCoverage=49%, E-value=0.0, Identity=86%"; Hit description=TonB -dependent receptor precursor
  Pfam annotation: Domain name=FecR; Domain location=22-115; Score =115.2; E_value=2e-31; Accession=PF04773.4; Description=FecR protein
  Pfam annotation: Domain name=Plug; Domain location=413-522; Score =42.4; E_value=1.6e-09; Accession=PF07715.6; Description=TonB -dependent Receptor Plug Domain
  Pfam annotation: Domain name=STN; Domain location=329-375; Score =17.3; E_value=0.06; Accession=PF07660.5; Description=Secretin and TonB N terminus short do
  Pfam module annotation: Pfam domain module=FecR::Plug::STN; Domain location=22-115::413-522::329-375
MAAAACTALLGVGLVPQLMPTAQLYSAGQGELRDLVLPDQTQVRLNADSRLRVRMGWLSRKVELLQGEATFDIARDRRPFEVEVNGLEIRDIGTVFDVARRLKSTRIGVVSGEVEIWSQGADARRLAQLGEGRVVQVDARSHAVESLDVPLSMLLDWQQRKVSFLDERLDEVAAAFNRHNQVQVRVLDEGAASARLSGSLPRTRPAFPGEARRRHRAGRQSLRPTWPWTVRKNSSNPRSPLPVDAGSYLGEATAEPRSGRLLPSLFQGPVMRNTLYLSIILALSPCSVPLAVAATADGLEARVSAPIAAQPLARALEQLSRSSGVQFLYSAGGDARMAGAVPRGATVKQALDALLAGTGLGYTVVDGNVIAIDPAPVSNAPKPAAPKPREAEAVVAPTLDTVKVIAAHEVIDQKKSSPVIKDSVVYDEMDSYGDETLAESLMAAPGLSAVEDAGEPRYVTVRGVQANLNYTTIDGIAIASVGGSGSGERMNNLQLIPSDIGTRTDIYKSFSAEQAPDAIGGVIDIISRSAFDRSGKYVFADVAGIYSTAETNVERSAGGNHETLGHFGKSAKVVFSNQFGADQEFGIVAVARYEQRSRNSVKRWVESNYYYNDAGKYLTDGTTGPDEAKGWNGLRAPGNFSTGTYTNFITNFGGSAKLEWKPSDDPFYASLLLYSYRFYENSTMNKTDLYGNAKFPIRNQTEDSGTTQINSIYIKNRHDRWDRSNRGAIASFNWDMDDRSRLTLRGGHTEETFHNNQ

SEQ ID NO: 128019 - protein, 272 aa, Glycine max
  Coding DNA Sequence Number=SeqID_36334
  Gene Ontology: Cellular component=integral to membrane
  Homolog annotation: Hit_ID=Q7CYT6; Match level="QueryCoverage=66%, HitCoverage=46%, E-value=2e-80, Identity=83%"; Hit description=ABC transporter, membrane spanning protein
  Pfam annotation: Domain name=STAS; Domain location=61-165; Score= -1.7; E_value=0.059; Accession=PF01740.12; Description=STAS domain
MVHVTTSACVRVPREMVKLPATGKRSVVACRPNRYETFKNLVTAALARSIMQEQDTRQQANPAAITEDDNVSGGGLRFVMSGSWRNSNLSGVFPSLEKIEKSRSAGAVEIDLSAVEAIDTTGAWIIQRLRKDLEVNGATVTVTGNDHIEEVIGQLPEKVEMEGEAGPKEGLAERIFAPIGKAVIQNGADFLAGMYILGSAVRGAQMKLGRGRGVSPAAIVNQIDHMGVRAATDHHVDVVPDRRDHRPAGCVPAQIFRCGSLRCRSRRHSAIA

SEQ ID NO: 128020 - protein, 73 aa, Glycine max
  Coding DNA Sequence Number=SeqID_36335
MIVIMSMTTQQMSSKRAPHHCTIEAQLELVGLGSSSSMDSFASWKMNDNGMEKEEREEMPLQGEYESRRSSPP

SEQ ID NO: 128021 - protein, 232 aa, Glycine max
  Coding DNA Sequence Number=SeqID_36336
MARRDKLWSFCTFLPSADDRVRWHGEINCGHSAPFRHLETIVSDGTQRQIMPEATCPMTSRDKLWSFRTFSPSADSHARWHAKTNYGHSVPFRHLETIVSGGTGGKPNDMWRQIMVIPHLFAIRRRSCPMARRDKLWSFCAFCHPETVSPMTWGDKSWSFCIISPSGDDHVRWNAEINYGHFRLLSSRGGEPNDMRSMAAEWRGSNDDWRCYFKEKMSQEQAHQHRKPWIRA

SEQ ID NO: 128022 - protein, 26 aa, Glycine max
  Coding DNA Sequence Number=SeqID_36337
MTGDASKFIHISPNNSGHLTYGDNNK

SEQ ID NO: 128023 - protein, 96 aa, Glycine max
  Coding DNA Sequence Number=SeqID_36338
MSKSLMPHSDFIFFGGWTCGGVAGFFELTDADQVCSQSLHQQYFVQTREVHHELAFPISNDLSFRAISKCHIASGAGLNVQQEFFDSCHVSGTAAI

SEQ ID NO: 128024 - protein, 146 aa, Glycine max
  Coding DNA Sequence Number=SeqID_36339
  Pfam annotation: Domain name=zf-CCHC; Domain location=74-91; Score =36.0; E_value=1.4e-07; Accession=PF00098.14; Description=Zinc knuckle
MCQIWDEDSRDRASYYRSIGPMKEHKEWTSIYIGEKPYSTLPKQYGNRPNNQRIVAIGFAGDSGSKPNTFPTKITCYRCGKPGHISSNCPDKGHIQRDCPYPKKEQNGGGLNDQTGHPKAMGRVFTLNSTQALKSKDLIHGHFWLI

SEQ ID NO: 128025 - protein, 163 aa, Glycine max
  Coding DNA Sequence Number=SeqID_36340
MVLKEELAACSRSKRNLTQRLCETETNMLAIITKYQEELSLATTHEHRVADEYAQVKNTITKRATRHPYRTRSKSRTMGDQEETQEQMKADMSALKEQMASMMEAMLGMRQFMEKNVANTAAVSSTVEADPTLLATVHHPPPNTLGRGRNTLGHNNNPHLGYN

SEQ ID NO: 128026 - protein, 109 aa, Glycine max
  Coding DNA Sequence Number=SeqID_36341
MTYGTFATCPFAGERGRGSRVRFPKKERCAESPPTFICGKRRENRRKQVKMKILGSGVVFTLEEELWKLCYLNFYSPPFFEVDKSGALAPTYPPSKRKSDLRSSSLSVN

SEQ ID NO: 128027 - protein, 139 aa, Glycine max
  Coding DNA Sequence Number=SeqID_36342
MEQRGHRMYYTPATFSQYPSQMYQYHFQGHDTDMSASEHSFGGVVETHPHFSWPTMTHSQQHDPPMATPNAPLASQWNVLGAIPDMGDLLGVDLRHEFSVEAEQVEAGRQRGRRNHDCQARRWDRPCGTSSWHHGHHNE

SEQ ID NO: 128028 - protein, 90 aa, Glycine max
  Coding DNA Sequence Number=SeqID_36343
MVGTSVNWFPRWKEGRAGVLSSCEGFLNIPLIGMRGCINYNHVLAVATCLSRASEGEAHGCAFQRRKDARSRHQRLFVENIGKIKGNRSK

SEQ ID NO: 128029 - protein, 236 aa, Glycine max
  Coding DNA Sequence Number=SeqID_36344
  Gene Ontology: Mol. function=transporter activity; Cellular component= integral to membrane; Biological process=sodium ion transport
  Homolog annotation: Hit_ID=Q477V0; Match level="QueryCoverage=44%, HitCoverage=20%, E-value=2e-45, Identity=83%"; Hit description =Na+/solute symporter precursor
MQHLKALFAAVCFLLPYTLHAADLSGLWQTTDDRTGKPRSLVRIVENAGEYSAVVEKGLLATDTGEAVCDKCTDERKGQKIVGMTIAKHLKPSSKSHVYEDGEILDPENGKTYKCKMTLSPNGNELEVRAYLLVSIGIGLIAARNVHSTKDYAVAGRHLPLPVVMATVFATWFGAEAVFGVSATFVREGLTGVAADPFGSSMCLILAGIFFSSRLYKLNILTLGDFYRMRYNRSVE

SEQ ID NO: 128030 - protein, 149 aa, Glycine max
  Coding DNA Sequence Number=SeqID_36345
MDKDVFLFTLIARHKVQHAFTEGVTIVGIIVGGIHGNIDVAIHLLEHIDAALGQDITTTNRQGNKSEDKQAKISQVSRINQPTGKRLEVAHQGKLEHGAGRVTSKEAVQDHQHKQGNKAQDTGNNRLCCQAGEIQAQRGETGNQQQQSQ

SEQ ID NO: 128031 - protein, 43 aa, Glycine max
  Coding DNA Sequence Number=SeqID_36346
GIFSYLFLLHSAAIYLPRSKGIIDEEDPRLTSSNGAYIKFFQK

SEQ ID NO: 128032 - protein, 69 aa, Glycine max
  Coding DNA Sequence Number=SeqID_36347
MLVRMIHTRLFAAARVKSCPGMHSRCVIASLSGCARIVGRPLISPVVAQELIKGNYWPLNRECKSRLSI

SEQ ID NO: 128033 - protein, 213 aa, Glycine max
  Coding DNA Sequence Number=SeqID_36348
  Homolog annotation: Hit_ID=A5C7Z4; Match level="QueryCoverage=53%, HitCoverage=40%, E-value=3e-08, Identity=30%"; Hit description =Putative uncharacterized protein
VVVSPPKPPPKPHPEVDDPLYLMTLTIPELFLRPYQVRWDATVFGAVNPDFPLYIKHEDLSEIAHGGISLKHVCEWGILISMDSSSHSPFRADTGQMVVILPKEHLVVWFCSLHNRPDNYLKGIINSAIKGLDDSPQPKSKAPARWIVVKCNRQKGTTECGYYVMHWMSTIILGTFRNNWEAYYNDPRPLEPERLKALRIQWAQFYLRVRDQA

SEQ ID NO: 128034 - protein, 253 aa, Glycine max
  Coding DNA Sequence Number=SeqID_36349
MDGIAQDPHVAIGDVTAIFTQMYGNAVCARLLRDKRGLYRIGIVCATRVTYGGDCNARSLSGASPALVVCHVRSFFRHKLTEQLLTLQRLTAQIRFQRHAREAFGGTQRVGVGKFALPQRAQLSAGETALIDHQTGDKTFLFAIAVGHAVVDRLAAAGAVQKVDAVAQMAQQCQLKTAQRWLGRTVGRRQRLDTGEIIEEQFGEGNFLLQHPRQQLVNIQATVERDAAERQRQRHRFGVTQGFDFATAAPAHQ

SEQ ID NO: 128035 - protein, 210 aa, Glycine max
  Coding DNA Sequence Number=SeqID_36350
MEADMEAMKEQMAAMMEAMMSVKKIMEANAVATTATSVVAKVNPTSPSGINQMNHPTSDMVGKDLGSTGGPHDVQIQNEHAFPPYGLPLNYTPPNVAYTPNKNVNNPTPIPIESQQPQTDHAHPWLGYATEGQAVGGIPLENTSEGPQYHPQLHLLHSTTSKNPHAMAEMGKLDHLDERLRAIEGGEDYSFANLEELLPIPNIITPLKFK

SEQ ID NO: 128036 - protein, 92 aa, Glycine max
  Coding DNA Sequence Number=SeqID_36351
  Homolog annotation: Hit_ID=A7PHV0; Match level="QueryCoverage=94%, HitCoverage=28%, E-value=1e-07, Identity=32%"; Hit description =Chromosome chr13 scaffold_17, whole genome shotgun sequence
MWAWERCTILAPKRTPPIIENKPLGHRWLRRGNQHIGNDDLIVFRRKLDIMKRHEFLWEPYTATVMSMLPPICLVGSVAWCAVVPLILVSML

SEQ ID NO: 128037 - protein, 85 aa, Glycine max
  Coding DNA Sequence Number=SeqID_36352
MEGSGSPSGAPNDGKGDDNNDSRHVTVVITLAKVPQPPFFLGYDPNAACAYHGGVPWHAIKHYMTLKRKVQGLIDTGWLKFEENC

SEQ ID NO: 128038 - protein, 90 aa, Glycine max
  Coding DNA Sequence Number=SeqID_36353
  Homolog annotation: Hit_ID=A7PBE8; Match level="QueryCoverage=44%, HitCoverage=4%, E-value=1e-09, Identity=72%"; Hit description =Chromosome chr16 scaffold_10, whole genome shotgun sequence
MCPNPHRTFGRFIHRPSSSAAKASHPSINIERPKEIKRKIGEAKKRENERRNGLWWPGQILGFDHLSTSHLTSPCSGTPVKLLRKEDSNK

SEQ ID NO: 128039 - protein, 133 aa, Glycine max
  Coding DNA Sequence Number=SeqID_36354
SLILKDELKVCSRSKRNLSQRLCETGTNMLAIVSKYQEELNLATTHEHRMADEYAQVYAEKEARGRVIDSLHQEATMWMDRFALTLNGSQELPRLLAKVKAMADTYSAPEEIHGLLGYCQHMIDLMAHIIRNR

SEQ ID NO: 128040 - protein, 88 aa, Glycine max
  Coding DNA Sequence Number=SeqID_36355
  Subcellular localization annotation: CTP_CleavageSite=52; ConfidenceScore=5.22e-01
MNCVFVHASSAHEFGAMRSDCLVQFSILYLFRSPKNCVFVHVSSTFEFGAMRSDSLVKFSILNLFRSPMNCIFVHVSSTSEFGAMRSD

SEQ ID NO: 128041 - protein, 69 aa, Glycine max
  Coding DNA Sequence Number=SeqID_36356
  Subcellular localization annotation: CTP_CleavageSite=77; ConfidenceScore=5.63e-01
MFKTLLAMHFGYFGQKHGFRAEKSSRSTSVNASVSDSVEILHRSSPFFIRSSFVLRSSTVFFSSVFNVL

SEQ ID NO: 128042 - protein, 212 aa, Glycine max
  Coding DNA Sequence Number=SeqID_36357
  Gene Ontology: Mol. function=DNA-directed DNA polymerase activity; Cellular component=mitochondrion; Biological process=DNA replication
  Homolog annotation: Hit_ID=Q5U6B7; Match level="QueryCoverage=84%, HitCoverage=37%, E-value=2e-28, Identity=35%"; Hit description=DNA polymerase
MYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPDWKELSVKKKESTTTLRTLSNSKRIPFFNEKESFKRKTAILEKENSALSQKLQKLEQERGIIAQRRVEEGNNTEDNNTLEQNNAKRAEDNINGDLLDPDTMPRDKKPP

SEQ ID NO: 128043 - protein, 125 aa, Glycine max
  Coding DNA Sequence Number=SeqID_36358
MKRNFWSFNGGFNGREEEEKSNVERGRICMSPLWFQFLAFLCTRRGPFLKAWSIIYNTWFVSRRPTTGARCTTPEQFGAEVAWPRDRLEAQVGEAPSGSPGDAEEARKNEEMTDLLGFLGESGAT

SEQ ID NO: 128044 - protein, 24 aa, Glycine max
  Coding DNA Sequence Number=SeqID_36359
LHNVGGVMEAYMWGFYGGWIFELQ

SEQ ID NO: 128045 - protein, 39 aa, Glycine max
  Coding DNA Sequence Number=SeqID_36360
SRLFRFFRRFPRINVGGDSGGGAFVEHASRESRVALPPK

SEQ ID NO: 128046 - protein, 95 aa, Glycine max
  Coding DNA Sequence Number=SeqID_36361
MHSEAEALEHMKKRDTGHQSVSLKNKTRDSTVLKVGDLAKVVIKQDMKGRKHKYEFDNNKREKPEKVRVVDDETSNEHQLYEVLRMPSRCVFLKI

SEQ ID NO: 128047 - protein, 98 aa, Glycine max
  Coding DNA Sequence Number=SeqID_36362
MYKDNWTQPWPMGSEIYPEVHENPRAFFSSCSPILLEPLAHGSSDCSTKMKMLLIPHDVAPCGACRPWIFFINGFLCFLRSDCSGMEKEKDEWRCHFK

SEQ ID NO: 128048 - protein, 111 aa, Glycine max
  Coding DNA Sequence Number=SeqID_36363
  Subcellular localization annotation: CTP_CleavageSite=34; ConfidenceScore=5.04e-01
MARLMLKEKGLPNTFWVETVYTAVYILNRSISLRATVSTTCKLGNSSSVEMLKLMSMLLGIGMKKKWRRMFLYPLNCLKKKLRKKTQVNHLHLHHNKKIKNYHHQSLLQDE

SEQ ID NO: 128049 - protein, 232 aa, Glycine max
  Coding DNA Sequence Number=SeqID_36364
  Homolog annotation: Hit_ID=A7PJZ4; Match level="QueryCoverage=60%, HitCoverage=40%, E-value=1e-12, Identity=29%"; Hit description =Chromosome chr12 scaffold_18, whole genome shotgun sequence
MTHAQPKPVDFSLLHLQDNHISNQVWEGQERLILLSLITLAGFGHVINVGKVDINQHLDVALQLGLKIDGLSVTDIITGDVRVACQALLGETPPDKYVKGKIIYQSWLWQNFQQLHIDSEDVVIAQHARAHIMMHIGCCLMPDTSVLVDSLEIRPLMNDVEVLMIVRAKVPLTCFAIVEWHPIDRVMRQFGLRKIISDDPPNLDQLHDIERENKYFLASLSLSLDCQMKSLE

SEQ ID NO: 128050 - protein, 183 aa, Glycine max
  Coding DNA Sequence Number=SeqID_36365
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=32%, E-value=4e-81, Identity=63%"; Hit description =Photosystem I P700 chlorophyll a apoprotein A2
DPLHVRPIAHAIWDPHFGQPAVEAFTRGGALGPVNIAYSAGWLHLQPKWKPSVSWFKNAESRLNHHLSGLFGVSSLAWTGHLVHVAIPGSRGEYVRWNNLLSILPHPEGLGPFFTGQWNLYAQNPDSNSHIFGTPQGAGTAILTLLGGISSANSKTNFGIGHSIKDLLEAHTPPGGRLGRGHK

SEQ ID NO: 128051 - protein, 123 aa, Glycine max
  Coding DNA Sequence Number=SeqID_36366
MTRGNPSDLQPFDPEIDRTFHRLVRHHLVSFEHPEHSDIDDFEHYNFEHSDFVHSENMAQPPPRERTLREMATPELIPYCLLHHETTRCPGGSHISEGLSSFFRGSGKGLAILPCSKVHHELG

SEQ ID NO: 128052 - protein, 105 aa, Glycine max
  Coding DNA Sequence Number=SeqID_36367
MKLCFHIYVLTFRGLHVLTFRGLYVLTFSGLHTLTFKGRHVLNFRVLHVLAFRGLRVLTFSGLHIHALRDRAHKAPSGPGGVQQGPGVSSSGYGPPLVLQGVRSP

SEQ ID NO: 128053 - protein, 170 aa, Glycine max
  Coding DNA Sequence Number=SeqID_36368
  Homolog annotation: Hit_ID=Q2JIC4; Match level="QueryCoverage=78%, HitCoverage=22%, E-value=4e-09, Identity=42%"; Hit description =ISSoc9, transposase
MTDPLDESISCFLTRVNPWVLVPIAFRGLHALAIRGLHVLAIRGLHALAFRGPNILIFRGLHVLAFRGLHVLAFRGPNILLFRGPNILIFRGPNILIFRGLHVLAFRGLHALAFRGLHALAFRGLHILHFRGVHVLAVKGLHTLAVRGLHALTFSGLHIRTLREFKVLCP

SEQ ID NO: 128054 - protein, 263 aa, Glycine max
  Coding DNA Sequence Number=SeqID_36369
  Homolog annotation: Hit_ID=A7PYQ3; Match level="QueryCoverage=38%, HitCoverage=44%, E-value=1e-10, Identity=32%"; Hit description =Chromosome chr12 scaffold_38, whole genome shotgun sequence
MAVHCDCGLCYNCDERYDPHHKCKAKFFLLITNNDDDLVDPTLSDLTSMVVDDPSSDIGHSDSSSPARISFHDLSGHLTSATLRVDGFVNGHDVVVLIDGGSSHNFVKDGTKLLNPRSLVRLNIQASSANPPCKTTPDLDSPLRFRLTQTEFHSQIPHGDSSSSSQHLTLTFYSIISLMTKPRLQCTSCSSFMLLGLFTPNRPVAAREFCALAVLHVVLRVSEIGLSASLELSLLKAPDVLSTLILRLVRNFDADALLDSPLR

SEQ ID NO: 128055 - protein, 129 aa, Glycine max
  Coding DNA Sequence Number=SeqID_36370
MADASTDKVEQHWTQVQMMRTLSLMTLSTLMVKREHEDLKKPHQVHLVEFVLETTSLSNALLDEKVSSGCKKFLKDFQDLEERVKSLITALKDSKEGCKEMLKQKLLVKKECPFSNDELDKMKKKNSDL

SEQ ID NO: 128056 - protein, 84 aa, Glycine max
  Coding DNA Sequence Number=SeqID_36371
MTTLASACQSDLGSPNDEVRITERCLRMLPDSWVMRAKGGVVDKREPFAPTVCGKLGFWLKACRTAGHDICQDVGLASGSGKKE

SEQ ID NO: 128057 - protein, 100 aa, Glycine max
  Coding DNA Sequence Number=SeqID_36372
MSLHSSSSVNGEGSTPKDPLYKILDELRSLKLWKEKQERKEKGRHRSHLRHHSHRRENERKPQEVNIKLPYFHGKYNVEANLDWEIRVEQQFRLHHDLYY

SEQ ID NO: 128058 - protein, 136 aa, Glycine max
  Coding DNA Sequence Number=SeqID_36373
MRRYYMSTDVTFFEDRPFFSPSEDHSSSLQEVLPIPSPYPLDDFDQNVIVGPSSSPDSPEVVSSPLITNQPRTTQIGFPVPEASPCGSRSSSASPPLMAPSTSSSHSDTHWPIAIRKVSLFSHWPPLLFLPLSVST

SEQ ID NO: 128059 - protein, 84 aa, Glycine max
  Coding DNA Sequence Number=SeqID_36374
AEYTIPATGGGGDSPHVREANIPMEKGGYLIYGTAHMHSGWKDFMYINTKYGTGKEAGNEKGISLECLFVIHNRVQSRFMMVKF

SEQ ID NO: 128060 - protein, 30 aa, Glycine max
  Coding DNA Sequence Number=SeqID_36375
MADEHDQRTTLEDYSSSSVPQFFTSIARPE

SEQ ID NO: 128061 - protein, 82 aa, Glycine max
  Coding DNA Sequence Number=SeqID_36376
MGVQIATRPLGPSKMFLQKAVASGGSNLARLGELGGKHLLPFPINRGRREEQKCSTLLVSEIHLKLVRKFVSVKKIQVEALS

SEQ ID NO: 128062 - protein, 64 aa, Glycine max
  Coding DNA Sequence Number=SeqID_36377
  Subcellular localization annotation: CTP_CleavageSite=49; ConfidenceScore=5.33e-01
MDATVLSCKSFLLSVLFLLSVASISKSKGTKVPVGDLCINSTNRTPVCKLSMQKERKSRKRNAV

SEQ ID NO: 128063 - protein, 92 aa, Glycine max
  Coding DNA Sequence Number=SeqID_36378
MRLPRKETMLMKFSQTINEILDVSISFLNDHLEETLGPIKNRRKSLKVYQSHTGQGLTFSPWVKVYGKLGFWLKAGRKAGHDICQFWPAVWG

SEQ ID NO: 128064 - protein, 297 aa, Glycine max
  Coding DNA Sequence Number=SeqID_36379
  Gene Ontology: Mol. function=acetaldehyde dehydrogenase (acetylating) activity; Biological process=alcohol metabolic process
  Homolog annotation: Hit_ID=P0A9Q8; Match level="QueryCoverage=100%, HitCoverage=33%, E-value=1e-142, Identity=87%"; Hit description =Aldehyde-alcohol dehydrogenase [Includes: Alcohol dehydrogenase (EC 1.1.1.1) (ADH); ...
  Homolog annotation: Hit description=Acetaldehyde dehydrogenase [acetylating] (EC 1.2.1.10) (ACDH); Pyruvate-formate-lyase deactivase (PFL deactivase)]
  Pfam annotation: Domain name=Aldedh; Domain location=4-297; Score= -262.0; E_value=0.0013; Accession=PF00171.13; Description=Aldehyde dehydrogenase family
MAVTNVAELNALVERVKKAQREYANFSQEQVDTIFRAAALAAADARIPLAKMAVAESGMGIVEDKVIKNHFASEYIYNAYKDEKTCGVLDTDDTFGTITIAEPIGLICGIVPTTNPTSTAIFKALISLKTRNGIIFSPHPRAKDATNKAADIVLQAAIAAGAPKDIIGWIDAPSVELSNQLMHHPDINLILATGGPGMVKAAYSSGKPAIGVGAGNTPVVIDETADIKRAVASILMSKTFDNGVICASEQSVIVVDSVYDAVRERFASHGGYLLQGKELKAVQDIILKNGALNAAIV

SEQ ID NO: 128065 - protein, 333 aa, Glycine max
  Coding DNA Sequence Number=SeqID_36380
  Gene Ontology: Mol. function=nucleotide binding; Cellular component =nucleus; Biological process=defense response
  Homolog annotation: Hit_ID=A2Q3B4; Match level="QueryCoverage=91%, HitCoverage=72%, E-value=1e-82, Identity=49%"; Hit description =Disease resistance protein; Calcium-binding EF-hand
  Pfam annotation: Domain name=LRR_1; Domain location=213-234; Score =2.7; E_value=98; Accession=PF00560.24; Description=Leucine Rich Repeat
  Pfam annotation: Domain name=LRR_1; Domain location=236-258; Score =10.6; E_value=3.3; Accession=PF00560.24; Description=Leucine Rich Repeat
  Pfam annotation: Domain name=LRR_1; Domain location=260-282; Score =15.6; E_value=0.19; Accession=PF00560.24; Description=Leucine Rich Repeat
  Pfam module annotation: Pfam domain module=LRR_1::LRR_1::LRR_1; Domain location=213-234::236-258::260-282
MMGTVASYKLQSLSPKNSLSLFVKWAFKNEGEEEKHPHLVNIGKEIVNKCKGVPLAVRTLGSLLFSKFEANEWEYDYEFDSVEVARLWEALGVLAPPRKNETPEDVAKQYLDELLSRSFLQDFIDGGTFYEFKIHDLVHDLAVFVAKEECLVVNSHIQNIPENIRHLSFAEYNCLGNSFTSKSIAVRTIMFPNGAEGGSVESLLNTCVSKFKLLRVLDLIDSTCKTLPRSIGKLKHLRYFSIQNNRNIKRLPNSICKLQNLQFLDVSGCEELEALPKGLRKLISLRYLEITTKQPVLPYSEIANLISLALLTIEVTLELLLRHGRINSQISML

SEQ ID NO: 128066 - protein, 115 aa, Glycine max
  Coding DNA Sequence Number=SeqID_36381
  Homolog annotation: Hit_ID=A5AHJ1; Match level="QueryCoverage=90%, HitCoverage=41%, E-value=3e-12, Identity=34%"; Hit description =Putative uncharacterized protein
MKDDEKRKVQDDQKAKNILTYGLSSDDYFRIARCKSANEIWKMLKVIHEGTAVYHLLGVGKTFEDDQLNIKILNCLTRTWELKIKTIKESNNLASMSMEALSEKLLAYVHEFGKR

SEQ ID NO: 128067 - protein, 199 aa, Glycine max
  Coding DNA Sequence Number=SeqID_36382
  Homolog annotation: Hit_ID=Q6WAY6; Match level="QueryCoverage=85%, HitCoverage=37%, E-value=2e-18, Identity=30%"; Hit description =Putative uncharacterized protein
MASQEEWVPFRDILALLIFGVVLFPNVDGLVDLAAIDAFLAYHHSKEIPVRRVDWDQYLAGIGGGTINWFPRWKEGKKGVLFSCGDYPNVPLIGTRGCINYNPALAIRQLGYPMRGAPTEESLLPFLMRDFGTQSLKIVQRVHKAWKSPLRKDRKVRGIRNGIIGGYHEWLRVHTRGLDWLSKLKIINEDNFEAPEEDE

SEQ ID NO: 128068 - protein, 118 aa, Glycine max
  Coding DNA Sequence Number=SeqID_36383
MGERYVGARASLLSTTPSFVAITQELVARGDTLRLSAPRHLVTPSVIHEQRPIWSSTPFPEMSAFSDGDFSSLTSYPELRRSEFLMGGYVGARASLLSTTPPFVIQNYVGLSSSWEDT

SEQ ID NO: 128069 - protein, 141 aa, Glycine max
  Coding DNA Sequence Number=SeqID_36384
VNAPPSLWIGLGIDKSKAQERAKDQLFSQAGMKMKLTTRRERKSPPSADDPAELNTADIDPLLHPLKDLLPVLIDGDRHEGQSFRLSEFPSTMPEMFSDALRSGVEKYGSDREVNLLCQGTKLSALSDTELDAAKVPTLAQ

SEQ ID NO: 128070 - protein, 179 aa, Glycine max
  Coding DNA Sequence Number=SeqID_36385
  Homolog annotation: Hit_ID=Q2QNX8; Match level="QueryCoverage=78%, HitCoverage=13%, E-value=2e-07, Identity=25%"; Hit description =Retrotransposon protein, putative, unclassified
VEVDLLCDRCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRKATREGVKPAKGGLQGDNSNRVAKR

SEQ ID NO: 128071 - protein, 133 aa, Glycine max
  Coding DNA Sequence Number=SeqID_36386
MSEIEEVQEQMKVDMEAMKDQMTTMMEVMMSMRKMMEVNEAAVVATSIATKVDPTHPFGINQVQSKHPFPPYGLPPYYAPPDVTHAPDENVDNFAPIPIESQQPQSGHAHVSQPIGRHMKYPETTLWLTWSFT

SEQ ID NO: 128072 - protein, 157 aa, Glycine max
  Coding DNA Sequence Number=SeqID_36387
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=61%, HitCoverage=10%, E-value=3e-10, Identity=37%"; Hit description =Gag/pol polyprotein, 3'-partial, putative
  Pfam annotation: Domain name=G-patch; Domain location=38-82; Score =34.9; E_value=2.9e-07; Accession=PF01585.14; Description=G-patch domain
MPYVEAAEESLETAFQSFEVVSIASVDSLSGQPCLSDTAMMVARVMLGYGYEPGMGLGKNNYGRTSLVSTRGNRGKFGLGYKPTQVDIRKSVAERKSRGQSPQLGRQVKGAPPCHISRSFISVGLGHEGQVVAICEDDSPSGSDLVRPCPSGFRLGN

SEQ ID NO: 128073 - protein, 48 aa, Glycine max
  Coding DNA Sequence Number=SeqID_36388
MTTGDSPQQKTSQGNEKKKEDENITQDSTSTGEKSKNRYRRRTQEYYE

SEQ ID NO: 128074 - protein, 96 aa, Glycine max
  Coding DNA Sequence Number=SeqID_36389
MQSQGLALPPKIEVGPSAAYVNTKESCVDPSGNDPDTGQRNAGSMGPTKHADRSDHDVDDPLYLMTLTIPQLFLKSLQYFNDVRPLQPERLKALRI

SEQ ID NO: 128075 - protein, 94 aa, Glycine max
  Coding DNA Sequence Number=SeqID_36390
MAVEWRRKKDDWRCHFKEKMSQPTDPRSSPRFSTVEARLQEILMMPTVKCSSWIIQVNFKKSKKYKLHLQVRFSSWIYKLYLKAQSELVIDYQS

SEQ ID NO: 128076 - protein, 149 aa, Glycine max
  Coding DNA Sequence Number=SeqID_36391
  Subcellular localization annotation: CTP_CleavageSite=43; ConfidenceScore=5.78e-01
ERKASIAARSTNPSTFGKRTTPKIKSARTSMNRAYSSWLAKVLAFASKHFLGTPTTLFSTCFPGSNSCAEILIILEILAKEGLNPEKRYGFLPPRGHPKISSNYSIVGVNWKSPKGGNGLCGDLCHSQVPDLAIGLVKGLSLELTHQLP

SEQ ID NO: 128077 - protein, 139 aa, Glycine max
  Coding DNA Sequence Number=SeqID_36392
MDETDLNLNALCLYYELYRWQQRKGALYADQRSKRSSRKGRIIISYGTGLALLAGQLTVTSTADYLLCSGLGVQAPVLPCMAESDSGFGLGLSCNGGGGWGWLLDLLIGIEESTARSTDSTMIFIGDCFLSIRIAGPLY

SEQ ID NO: 128078 - protein, 91 aa, Glycine max
  Coding DNA Sequence Number=SeqID_36393
MGEEEKKPEENKVEEKKAEEEEKKEEEKKTRGIKKDDKESKEESASPEIMQGTTFAMHGHFKHDFWASFKLGTILQHLGQKIGTILNFSLR

SEQ ID NO: 128079 - protein, 70 aa, Glycine max
  Coding DNA Sequence Number=SeqID_36394
CRLLLEEATWLAWASRACLGELSGKILPYFAINRGRSEEEKGSAFLALRILLKLLRKIVSVKKIQADALP

SEQ ID NO: 128080 - protein, 106 aa, Glycine max
  Coding DNA Sequence Number=SeqID_36395
  Homolog annotation: Hit_ID=A5C3B5; Match level="QueryCoverage=72%, HitCoverage=6%, E-value=8e-07, Identity=38%"; Hit description =Putative uncharacterized protein
  Pfam annotation: Domain name=zf-CCHC; Domain location=49-66; Score =14.5; E_value=0.0097; Accession=PF00098.14; Description=Zinc knuckle
MSPYGSSTWKDKETLKKEGGSSFKSHEKSVTLGKNNFNPTLTSSEMSFIKYFKCLGKGHIASQCPNKRTMVVLGNGDITSAFLLALLVLLVRVKVNVMYNPWKVIF

SEQ ID NO: 128081 - protein, 106 aa, Glycine max
  Coding DNA Sequence Number=SeqID_36396
MENCTRQSTTHGSRLIGGGCMNDNQFMGLGIKLIGGGLHERQSIHGAPNKSGEWRIALGKNYAHGSRLIGGGCMNDNQFMGLRIKWIENFTRQQLRMAPDSMVEDA

SEQ ID NO: 128082 - protein, 80 aa, Glycine max
  Coding DNA Sequence Number=SeqID_36397
  Subcellular localization annotation: CTP_CleavageSite=36; ConfidenceScore=5.35e-01
MSKDWDPSAVDAGYTGKSSHSTTPGPYGWSPTGQPNAACRVPSSALFFNEGPINGRLKNPSGHNRHPIELAETVIKGQKS

SEQ ID NO: 128083 - protein, 48 aa, Glycine max
  Coding DNA Sequence Number=SeqID_36398
MKNFPQKSLTEALRKVFGNFTEVLRKPRKPRKPFFKNVEELAAQLLPP

SEQ ID NO: 128084 - protein, 58 aa, Glycine max
  Coding DNA Sequence Number=SeqID_36399
MVTASSKFEADSLDDDATVVEAMTSKIILMMSNNQELSKFQRIRLQESSLKESRFKNN

SEQ ID NO: 128085 - protein, 90 aa, Glycine max
  Coding DNA Sequence Number=SeqID_36400
MGKTTWASLMQNQMKTNPIRPRKEILNDITDSLEDMHIDEKGHKGKEDGNSRDSQFKENQTNVDLPKEWRTSRYHPLDNIIYDILKGVTT

SEQ ID NO: 128086 - protein, 116 aa, Glycine max
  Coding DNA Sequence Number=SeqID_36401
MACPSPQQGRRRARHHSFLGTTSSGRQTHHYHFQSPLQLIYKGWSIAYDTWPTSKWPTTGAAQDVKEALLGGNLELSTKKLPAKRSWKGTIEEGSCAAPQVDTGFDKPRFQSAEHQ

SEQ ID NO: 128087 - protein, 71 aa, Glycine max
  Coding DNA Sequence Number=SeqID_36402
AVNHMVTPHVTFLTGQDGKRTTKGAEDDVSPRASTGLFAPWLTKGTGHICPWLTKGAGNHKACLPLVDQRC

SEQ ID NO: 128088 - protein, 95 aa, Glycine max
  Coding DNA Sequence Number=SeqID_36403
  Homolog annotation: Hit_ID=A6FJQ2; Match level="QueryCoverage=40%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLAEEEEEAAEEDKEAAEEEGEAAEEEEEAAEEEEDAAEETESDDDSEATP

SEQ ID NO: 128089 - protein, 138 aa, Glycine max
  Coding DNA Sequence Number=SeqID_36404
MVARVMLKNGFEPRMGLGRTASEMLTVWPDRLSQSFTSVGMVSEEEVAAVGEEFPQDPPNFVQPCHPDSQDPNNEGLTIDFDRDIKPNDKRGRGRGCPFTRVGEEKKEVKVGTGMTAPIHQGLITLLEEYQDVFAWSY

SEQ ID NO: 128090 - protein, 177 aa, Glycine max
  Coding DNA Sequence Number=SeqID_36405
  Homolog annotation: Hit_ID=Q6WAY4; Match level="QueryCoverage=87%, HitCoverage=28%, E-value=3e-17, Identity=36%"; Hit description =Putative uncharacterized protein
MGTNQNGKRFYQVKVKSLDVTSLKELGRLMGPLQRQAFRKVYGKILDLTAAEVFTEAVVSLAQYYDQPLRCFTFGDFQMVLTIEEFEEILGCPLGGRKPYLFSGFLPSLSKIAVVVGDSAKELDHMKQTRNGVVGLPRKYLEGKARDMVSQEKWGPFADILALLIFGVVLFPNVDGL

SEQ ID NO: 128091 - protein, 212 aa, Glycine max
  Coding DNA Sequence Number=SeqID_36406
  Subcellular localization annotation: CTP_CleavageSite=59; ConfidenceScore=5.23e-01
MGPKSTLRLIRTLGPSLASLAQSTWTFLSNALAGKECVLRSPYPMRARARVMSEIEEVQEQMKVDMEAMKEQMTTMMEAMMSIRKMVEVNTTKVVATSTATKVDLTHPSGLNPVNPPISDMVGQGGEALGSMGSPHFVQVQNKHSFPPYGLPPNYTPPNVSHAPNENFNNSTPILIESQQSQFDHAHVSQPMGGTHVLNRNRNRQPLHGRDS

SEQ ID NO: 128092 - protein, 149 aa, Glycine max
  Coding DNA Sequence Number=SeqID_36407
MALRVKVARPGELLLQPEVEVTLLAHASSTHPGELVTSPLSYLGAQASQRLAWALLLSYEKVKNRNNNLDKSKAEIKSAQRKSKERREEESKHKFYIGSATTRAYIQSPSNPRFLRFPITLVKSFTSKEPQRMYPPLFSLNNKVDVPST

SEQ ID NO: 128093 - protein, 82 aa, Glycine max
  Coding DNA Sequence Number=SeqID_36408
MPPSSPRRARLLPPEATAFWRAQVGLLSKKLRKLTDCAKTPLFDFRHITEFHESRKPASFRFLRRLGTSFIACHQVIIPRQN

SEQ ID NO: 128094 - protein, 25 aa, Glycine max
  Coding DNA Sequence Number=SeqID_36409
MAAQGHEMDSHDLIKMKRPTKGKEA

SEQ ID NO: 128095 - protein, 245 aa, Glycine max
  Coding DNA Sequence Number=SeqID_36410
  Subcellular localization annotation: CTP_CleavageSite=32; ConfidenceScore=5.05e-01
MAEPSKKRKGTSSRSQRHSGSQETPIPSSIPSGSLFSSEEQRIRYTNLFSSHSIIDLKFIDMDFFSNESFECFQAFENSIPIPFMSLKLPVYSNLVKAFYSNFEIHEGTLMSEVYGIKMVIDQSLFYDLTQLPSEGVPFEGALIDDWKFDFSIHDARWLVCTNQADMTEGYLPVVATCPFAGERRRGSRVRFPKEKRCAESPPTFICGKRRKNQRKPVKIKILSSGVIFKFEEGISTSHVCLKGQ

SEQ ID NO: 128096 - protein, 85 aa, Glycine max
  Coding DNA Sequence Number=SeqID_36411
MPISPCESIGWSVPSRHRDCARKTPSGPGEAQQGPRVSSSGYGPLLVLQGARSPQQGIAPARHPVDLEKYNRVLGFPTLITGGIL

SEQ ID NO: 128097 - protein, 73 aa, Glycine max
  Coding DNA Sequence Number=SeqID_36412
MAPNSMVGDTRTKTKFMGVRKRLRVENCTKQSLRMAPHSKAITTHSSKLDGGGHMNENEIHGAPKKVENGELH

SEQ ID NO: 128098 - protein, 167 aa, Glycine max
  Coding DNA Sequence Number=SeqID_36413
  Gene Ontology: Mol. function=protein binding
  Homolog annotation: Hit_ID=A1G0U1; Match level="QueryCoverage=67%, HitCoverage=18%, E-value=5e-59, Identity=97%"; Hit description =Peptidase M61 precursor
  Subcellular localization annotation: CTP_CleavageSite=52; ConfidenceScore=5.04e-01
MKTRALAMSLLFALAATPALAQSSPPANAVAPGLLRIDVDARDLARRIFKVTATVPAKPGPMTLLYPQWIPGNHSPTGPIDKLAGLRVTANGKPLAWQRDQYNVYAFKVNVPEGASEIVAHFDFLSSQGGSQGRVVMTPEDAQPAVECQFAVSGPASMRASCKRRPA

SEQ ID NO: 128099 - protein, 216 aa, Glycine max
  Coding DNA Sequence Number=SeqID_36414
MAPRKLASKRSRKDKAAEGTSSAPEYDSHRFRSAEHQQRFKAIKGWSFLRERRVQLRDDEYTDFQEEIVRRRWASLVTPMAKFDPDIVLKFYANAWPTEEGVRDMRSWVRGQWIPFDADAIGQFLGYPLVLEEGQECEYSQRRNWSDRFDEEAIAQLLCIPGQDFARTAAGRRVRIMRTNMTTLTQIWMTLLLSNIQPSDHNSDLPLPKCHLLMPS

SEQ ID NO: 128100 - protein, 488 aa, Glycine max
  Coding DNA Sequence Number=SeqID_36415
  Gene Ontology: Mol. function=binding; Cellular component=nucleus; Biological process=gibberellic acid mediated signaling
  Homolog annotation: Hit_ID=A8KF27; Match level="QueryCoverage=85%, HitCoverage=50%, E-value=1e-100, Identity=46%"; Hit description =Tetratricopeptide repeat protein
  Pfam annotation: Domain name=TPR_1; Domain location=131-164; Score =37.1; E_value=6.4e-08; Accession=PF00515.19; Description =Tetratricopeptide repeat
  Pfam annotation: Domain name=TPR_1; Domain location=97-130; Score =18.8; E_value=0.021; Accession=PF00515.19; Description =Tetratricopeptide repeat
  Pfam annotation: Domain name=TPR_2; Domain location=131-164; Score =32.9; E_value=1.2e-06; Accession=PF07719.8; Description =Tetratricopeptide repeat
  Pfam annotation: Domain name=TPR_2; Domain location=97-130; Score =23.4; E_value=0.00082; Accession=PF07719.8; Description =Tetratricopeptide repeat
  Pfam module annotation: Pfam domain module=TPR_1::TPR_1::TPR_2::TPR _2; Domain location=131-164::97-130::131-164::97-130
MRQGQHLQALHTLQQEWQMTIPAVMPDTQPSAQQQEALLALFRQQQYTQMEQDLQAFLHQYPAWLGGWKMLSDVLMIQKKDARESAAQALLLNVDDAEEHCYYGLALKAQNDLVAAAEAFKHAIQLKPAYAAAYNNLGIVLKDIGQVEEAIQQFKQALILRPEYAEGFSNLLFCMTHAEQVDNEALLQAHIAYADLYEAPLMAHWQPHANTRDAKRPLRIGFVSADLRAHSVAHFLLPLLPGLAKDASLELFAYANYALEDEVSAEMRQYFRQWRMVSHISDDDLAACIRHDQIDILVDLSGHTAGNRLLTFARKPAPLQASWLGYLNTTGLSAMDYYLADSALLPSGQFDQQFSEQIVQLPVNAPFVAHPDAPAVNALPALKNGYLTFGCFNRPNKITRVTVQQWAAVMQACPGSRMYLGGMGEAGSYAHLQQWFAEAGITADRLSFHARTDMLGYLQQYHLVDVCLDTFPSNGVTTTAHALWMGVP

SEQ ID NO: 128101 - protein, 74 aa, Glycine max
  Coding DNA Sequence Number=SeqID_36416
  Subcellular localization annotation: CTP_CleavageSite=25; ConfidenceScore=5.42e-01
MAQLISPPKKSNRALGFPALVAGLCQSYRVPVPPGRNRTHKDTRWTRRSPTGPWGFQLWLQASVVLQGARFPQQ

SEQ ID NO: 128102 - protein, 117 aa, Glycine max
  Coding DNA Sequence Number=SeqID_36417
MANQEEWVPFMDVLALLIFGVVLFPSVEGLVDLAAIDAFLAYQHSKESPMVAILADLFDTLDRRCEKSSARIICCLPASLCMGRGGCINYNPALAIRQLGNPMRGAPAPPPPSLLSL

SEQ ID NO: 128103 - protein, 64 aa, Glycine max
  Coding DNA Sequence Number=SeqID_36418
MVKEECMEINIKETSPLRQPPYFLFCQKTLVSTVTPLGLKVSPQVKEFLDDGLVIEVIPESNKH

SEQ ID NO: 128104 - protein, 84 aa, Glycine max
  Coding DNA Sequence Number=SeqID_36419
VAQTEKSEPKFSDTEYQKYLKLKSEKSSSQASSSSVPCYSTACILNLLTVPVLGYLIQVSLIIFLLMVPKLQLKGVVKYLYLPH

SEQ ID NO: 128105 - protein, 75 aa, Glycine max
  Coding DNA Sequence Number=SeqID_36420
MKGLFVTKLESNEDWYNIGTNYRINFEPKQQAHFDATSIGACRPRISSSMDSFAPWKMNGSGMEKEERDETPLQG

SEQ ID NO: 128106 - protein, 153 aa, Glycine max
  Coding DNA Sequence Number=SeqID_36421
MGRKQRSNLFVDQLRLLRCFALRLPGDAVLLDESSISRGPDALAGGDRGNRHPVGLIEAHNQSWKPQGPVGLLRVHLGVLWAGRLALRSLCRMLLSSNVIHICVRVVMLVRTIRTRLFAAARDQRVTQELIKGNYLPLNRERKSRLSIKGRGP

SEQ ID NO: 128107 - protein, 105 aa, Glycine max
  Coding DNA Sequence Number=SeqID_36422
MSVEQFIEKVAWPGARPSFMGDNESFTARAPQQHEPEPENDHSSEAIISGAAAHHGPMPASVDAPFPGVDPSPPQHVVDSSIPVLEIHEGQTIPVLPWTLLLPLL

SEQ ID NO: 128108 - protein, 312 aa, Glycine max
  Coding DNA Sequence Number=SeqID_36423
  Homolog annotation: Hit_ID=A2Q162; Match level="QueryCoverage=65%, HitCoverage=80%, E-value=2e-22, Identity=58%"; Hit description =Putative uncharacterized protein
MTSKIILMMPKNQELSKILKIQKSSFKNNQDQDSRIKRRLNQDKGYIYLGCCTENKRGYISCGSVQVEGFPRALHPAPDAPNAFAHDVSALLMPSFPMLHHTPIMVEAVRRSTLYTNSVSLMCFLGTVISYDFWMSLIADLMLPNSSPPTILPPLDIHWVWFCHTLNPVSYREYCETRFSKLIGKAGIFDEENREAIQVRGGLLDSCETTIQGFLVYAAEVKEKEFEETKKLWDRAFNQPYEKAGGEVPLTLEGVISIKSPVYWEDSGTDVNTKYRSFFQDFYWRSQKHRGMLNQGKIENLLQLATMKMIEA

SEQ ID NO: 128109 - protein, 279 aa, Glycine max
  Coding DNA Sequence Number=SeqID_36424
MAANDHAILRDHTYAPTKRSHLELTTQDAILAQKKLLSQQIEALIETLNKLPQQLQADHDWRYYPSNNFNQGGSPYQHPSQGPSQQEKPPISIEEMLLSFIQETRAFIQETRSHQKSTDAAIRNLEIQIDQLAESITEKPTETFAVNAERKPKEDCKVILTEREEEEKKTEEDVCDKEGEKKEERERNEEKTQQWEKHSQVEIQQESILRINTPPHQLIVKEERHGKHEKALSVILSLIATTSLAIMLKVFLEYTSFMASLTMRRKCKEDVFYVTFMPP

SEQ ID NO: 128110 - protein, 89 aa, Glycine max
  Coding DNA Sequence Number=SeqID_36425
MYQSHIRGANVVISLYETKVRFGRQRLVLSQPKISHSHIFVVLCRKKYSKGMANIDIEGILKQQPDDGLMKSTVLASLLELVFVETCDR

SEQ ID NO: 128111 - protein, 87 aa, Glycine max
  Coding DNA Sequence Number=SeqID_36426
MSVKNLVGRLGVKSYGGQSGSLSFASTLQSYGINIGFKEHSNQVYLPPRPTLRRVYQGLSLLIQVQPKKHVNTQTLSMNFTKHTSPQ

SEQ ID NO: 128112 - protein, 240 aa, Glycine max
  Coding DNA Sequence Number=SeqID_36427
  Gene Ontology: Mol. function=3'-5'-exoribonuclease activity; Cellular component=exosome (RNase complex); Biological process=RNA processing
  Homolog annotation: Hit_ID=Q2HRD9; Match level="QueryCoverage=93%, HitCoverage=91%, E-value=2e-81, Identity=68%"; Hit description =Peptidase S8 and S53, subtilisin, kexin, sedolisin; 3 exoribonuclease
  Pfam annotation: Domain name=RNase_PH; Domain location=13-138; Score =23.6; E_value=6.5e-06; Accession=PF01138.12; Description=3' exoribonuclease family, domain 1
METDRPDSQTPNQLRPLACSCSCSILHRSHGSASWAQRETKVLAAVYGPKAGTKKNENPKKASIKVIWKPKTGQIGKVEKEYEMILKRTLESICIRTIYPNTTTLVIVQASFVLNIRNLLLPCAINAACVALVDARIPLKHLVVAICCSITDSGCIILDPTKDQEEKMKAFINLVFPNTIVSVLPEGSLQEGSETMAHGIMTSITQGAMSGLGGFVACRALSQRNTDPTKASRPWDIAIL

SEQ ID NO: 128113 - protein, 62 aa, Glycine max
  Coding DNA Sequence Number=SeqID_36428
MFLVFNTSALKGLDDTPQPKSKATAWWIVVKYFNEVRPLEAERFKALRIQWAQYYLKVRNQT

SEQ ID NO: 128114 - protein, 180 aa, Glycine max
  Coding DNA Sequence Number=SeqID_36429
  Gene Ontology: Mol. function=acyltransferase activity; Biological process=response to oxidative stress
  Homolog annotation: Hit_ID=A7NZW0; Match level="QueryCoverage=100%, HitCoverage=8%, E-value=3e-63, Identity=65%"; Hit description =Chromosome chr6 scaffold_3, whole genome shotgun sequence
MDPKRSIEDQFSKLHPSMPVNTRIGIVGAGSSGLSIAYALDRLGYNNITILEKHHTVGGMCELVEIEDRLSTRKITMNSHKLAVIDSFSRKYQEVKVTDDYVFVMSPTLQIQVKNSGHFGVHALSEVASHLAPDYVEHHGLKSIPKSVAHGYTASGYGFIQHMPYAYIHEFTRTSMAGKI

SEQ ID NO: 128115 - protein, 89 aa, Glycine max
  Coding DNA Sequence Number=SeqID_36430
MYSSPSGGRGAGARGHCLKIGRHQHARAQTPNRTRMIITSRDLHNFLLLSKNTKWLLKDPKIGKGCQVNLRFFLMSRGTAFLNNWTKPT

SEQ ID NO: 128116 - protein, 343 aa, Glycine max
  Coding DNA Sequence Number=SeqID_36431
  Gene Ontology: Mol. function=kinase activity; Biological process =protein amino acid phosphorylation
  Homolog annotation: Hit_ID=A2Q361; Match level="QueryCoverage=39%, HitCoverage=22%, E-value=3e-48, Identity=66%"; Hit description=RNA -binding region RNP-1 (RNA recognition motif); Pyridoxal-dependent decarboxylase
MPRPCDPSTLPKRRAANKGYEHESVGRNFRESKAVPVPDANAEFQATMRRQGQCNSKCTIEKYNPQEDGHYGFHHEPAKSRALNWPEDQFGMRYSHQADGESNKLLDGLKSSQKKDFHPVDKDCTKGYANKNARMHHSGPLLAPEDNREEMLKEHERQIQQAVRKVRLGKDKTKNADSENGLTESLFQHVKSIPFSGTGKHKYSFQNIKVPPLPVHFCDCEEHCKPFVPEREKLSIDRAAESGGINDEEISIMNAVVNKLFGKEQVSNAKNLGEEKDSFESPDALHSDECEDSATDEDDLIINVETKKNKTALTENKELQRILENQVFIFYFWAAVGAKINQL

SEQ ID NO: 128117 - protein, 205 aa, Glycine max
  Coding DNA Sequence Number=SeqID_36432
MKLEPANDRLEAPAFTAVRTRRSCAVKAPATATEVAITRKKLAPNGTRDISGGCNDNVSDMGGDDSNLDDVSGHGGGGSINGGDSYYDIDHSCNGSDRGDIVGSGGGGDNDNAVAITLMMVVVVITIEDEGGWMVVVMTAVIVVAPSGGGDGCGGDNDGDGGSNTDDDGSVSDDGGSGNDVGGDRADRLAQVIEFWVDATFKEER

SEQ ID NO: 128118 - protein, 193 aa, Glycine max
  Coding DNA Sequence Number=SeqID_36433
  Gene Ontology: Mol. function=copper ion transmembrane transporter activity; Cellular component=integral to membrane; Biological process=copper ion transport
  Homolog annotation: Hit_ID=A7P4V3; Match level="QueryCoverage=75%, HitCoverage=98%, E-value=5e-36, Identity=57%"; Hit description =Chromosome chr4 scaffold_6, whole genome shotgun sequence
  Pfam annotation: Domain name=Ctr; Domain location=2-135; Score=89.1; E_value=1.4e-23; Accession=PF04145.6; Description=Ctr copper transporter family
MMHMTFYWGKKVTILIDSWKTDSWTSYFLSLLACLVAAALYQYLENRRIRLKLLAGGRRPSPAPEIRAPLLRWGVAGDKEKLGVKFAEAVLFGVNSAIGYLLMLAVMSFNGGVFLAIAVGLTIGYFFFRNEGENDALVVDNNSCAWRDIKPFVKKIKALFAVTSSPQLAEADFTRNGPSSDLLEKDHQQYKIH

SEQ ID NO: 128119 - protein, 630 aa, Glycine max
  Coding DNA Sequence Number=SeqID_36434
  Gene Ontology: Mol. function=protein kinase activity; Biological process=protein amino acid phosphorylation
  Homolog annotation: Hit_ID=A7Q5D4; Match level="QueryCoverage=8%, HitCoverage=3%, E-value=9e-15, Identity=75%"; Hit description =Chromosome undetermined scaffold_53, whole genome shotgun sequence
MLTRRTLDHPRPIVTVNAATGRGSGPHKEKFHSYLGVVAREKVPIVHNSWKDVPDTLKELVWNEILAKFDIPEALDAKKKIWEEFAATRKTPSWQDSLEEQVAQGEFVPQGRHDILSTAIGRPDHGGRVCAAGPRVTISQYYGRISRASSSSSIAFTKEQLAEIVVTVREQVMKELEEEKKQSLQAWKKELKDAIITDIFNGDNDLAPANFDLNVLGARVSTKESNTEIAVNPSGEMHVGRVTPPMGLYVQSQNCTKLVALAKIHDGPSTIHCVAYADDVVRVSVKQVIDGEAEVPLPTSEIKYVRDVVNTFIAWPLPLHSGITPEKVVNAAELNNDVPKQDPLRELIKTLVDIYDKPVEFVWDLIEFGIPNVNSSLFLTYTDVSKITSGEKCLNIAILQLWTIAHWQMVVLCPKDNVVVCAYKKLNTTADGKTHVQRGGYECGYYVMHWMWNIIGAELKSDWTVWFGDGSALDSEAITALRKKWAAYFLKLRTIQCTKFVAPLMELLLAGADPHAVDDEGESVLHRAFAKNSIDCALVILENGGSRSMAILNSKNMINSLRVVCLAASSMAGVGSSSYKGNDNILFCFHCKSKTITFINGWQLRSGGLALLCQNCGCVFFVLSSLLFSS

SEQ ID NO: 128120 - protein, 147 aa, Glycine max
  Coding DNA Sequence Number=SeqID_36435
MNHLISRVLLCDDDDNDDDDISNDNRNTNSGHSDSGGGDDIEGSGSDDVVVITVGEGDGSDTGEIVVVVASDCVVVVVVVVATLVAIVVTMIEVILLVMVVVGTMKVTVKLTVIAIVTITDVVFVVVINGGSSKECHCQGWSKIVLL

SEQ ID NO: 128121 - protein, 330 aa, Glycine max
  Coding DNA Sequence Number=SeqID_36436
  Gene Ontology: Mol. function=phosphoprotein phosphatase activity
  Homolog annotation: Hit_ID=A7UQU7; Match level="QueryCoverage=51%, HitCoverage=30%, E-value=2e-20, Identity=35%"; Hit description=IMP dehydrogenase/GMP reductase, putative
  Pfam annotation: Domain name=DUF1723; Domain location=144-193; Score =63.2; E_value=9e-16; Accession=PF08330.1; Description=Protein of unknown function (DUF1723)
MPRTRGGDHTRPTAFVRRCAVVDEEQKIYEAPEHVVADDVAPKDIVFGVVDEEQEIYKALKHIVADDVAPEDVVFGGGPKDKSVLTKYVDHMACKLWDSLDCGELKLVAHGRKLRDLPPLPHKEIMQLVQVLGLLSLTKCSYETIDKGLLFAFTERWHRETNTFHLPIGEMTITLNDVSSLLHIPIVGALDELTIDRVLWMPYKEHCNVCPFGMLSLFSGYIQLGSNMHLHFPKRVLQQFDYTQNYSSTPIYVYNGCVIGYMEWYFRISHPFVLSVNKECIPIVQPVIPDMRDEMINLRMVTEGTTTWEKVQTTLLLLSEDTHGGNISRG

SEQ ID NO: 128122 - protein, 266 aa, Glycine max
  Coding DNA Sequence Number=SeqID_36437
  Gene Ontology: Mol. function=protein binding; Cellular component =integral to membrane; Biological process=protein amino acid phosphorylation
  Homolog annotation: Hit_ID=A7QK47; Match level="QueryCoverage=89%, HitCoverage=33%, E-value=4e-36, Identity=37%"; Hit description =Chromosome chr16 scaffold_110, whole genome shotgun sequence
  Pfam annotation: Domain name=LRRNT_2; Domain location=28-66; Score =24.8; E_value=0.00031; Accession=PF08263.3; Description=Leucine rich repeat N-terminal domain
  Pfam annotation: Domain name=LRR_1; Domain location=152-174; Score =7.7; E_value=12; Accession=PF00560.24; Description=Leucine Rich Repeat
  Pfam annotation: Domain name=LRR_1; Domain location=180-202; Score =3.7; E_value=64; Accession=PF00560.24; Description=Leucine Rich Repeat
  Pfam annotation: Domain name=LRR_1; Domain location=204-225; Score =6.7; E_value=18; Accession=PF00560.24; Description=Leucine Rich Repeat
  Pfam annotation: Domain name=LRR_1; Domain location=228-250; Score =6.2; E_value=22; Accession=PF00560.24; Description=Leucine Rich Repeat
  Pfam annotation: Domain name=LRR_1; Domain location=71-90; Score=5.6; E_value=28; Accession=PF00560.24; Description=Leucine Rich Repeat
  Pfam annotation: Domain name=LRR_1; Domain location=97-119; Score =10.5; E_value=3.5; Accession=PF00560.24; Description=Leucine Rich Repeat
  Pfam module annotation: Pfam domain module=LRRNT_2::LRR_1::LRR_1::LRR_ 1::LRR_1::LRR_1::LRR_1; Domain location=28-66::152-174::180-202::204 -225::228-250::71-90::97-119
MNIYNNILCWLLLPYFMLASSSSSSFCNHHDTSALLLFKNSLNTPFKLETLKKHTDCSEWDGVTCDTISGHVIGLDLSFCNLQGQLHPNCTIFSLSHLQRLNLAKNEFFGDIPSIISCLSKLLFLDLSSNYDSRRMRVDPYTWNKLIQNATNLRELYLDDVDMSSIGVSSLSLLTNLSSSLISLSLVSTELQGNLWSHILSLPNLQMLDLSFNKDLGGELPKSNWSTPLSNLALSHTAFSGNIPDSIGHLKSLNTLYLWGCNFDGL

SEQ ID NO: 128123 - protein, 83 aa, Glycine max
  Coding DNA Sequence Number=SeqID_36438
  Homolog annotation: Hit_ID=A7QJA5; Match level="QueryCoverage=97%, HitCoverage=34%, E-value=6e-23, Identity=62%"; Hit description =Chromosome chr8 scaffold_106, whole genome shotgun sequence
MAQQKLNGLEKQKEEMMKLNSPQYLLQWIQEAMNKTEVEYENLHQQVLQRDIDIGAFLQKYKQLRTAYHRKSLVHLAARTSNI

SEQ ID NO: 128124 - protein, 84 aa, Glycine max
  Coding DNA Sequence Number=SeqID_36439
MSGCVVVKYRRFPIRLRYLLDASASGAPSFFCSFSFVMSGVATDDDKGDDKMLKDQSKNNSSESRTIQEFKIRIKKNSRLKKKV

SEQ ID NO: 128125 - protein, 330 aa, Glycine max
  Coding DNA Sequence Number=SeqID_36440
MEQEVAIAIFIELRIYPHLNFIYLLLKFILELSAYSTFNLSNPETEQQHTFEEPQTKPELGFLTEKIASLTELEKVEEVETETKSVSRPSVLTRCKSELARIGHRLDPPVEDLMKAGENLRAKLGLHKRRINWPAPKVGIELYSVESQEIESSIVDASAASRKRRRDEEEEEELEQAFFIIVSVATMLLGAMTWYHNKYFVKEPAQNLELERHSFLNRLYRGTKTDCIEQLRVNLCAKDKATGFRAKNALDADAIMSKEANEEEAIHSVSIDLEGSSSATRKNIHPSKSGEKEGMISSMKEVVESLKEFVEVIKKKMENQKKMEIKEAQE

SEQ ID NO: 128126 - protein, 96 aa, Glycine max
  Coding DNA Sequence Number=SeqID_36441
MLDKQKVVGLSKPADRPDHDVDDPLYLMTLTIPHLFLKPLHMNETSMRAGNADVYGFLKPQFIQRSGQSQFESKSYIKNWMQNSRRDVYLGTYLNG

SEQ ID NO: 128127 - protein, 189 aa, Glycine max
  Coding DNA Sequence Number=SeqID_36442
  Gene Ontology: Mol. function=nucleoside-triphosphatase activity; Cellular component=integral to membrane; Biological process=protein catabolic process
  Homolog annotation: Hit_ID=A5AIR5; Match level="QueryCoverage=80%, HitCoverage=22%, E-value=5e-34, Identity=53%"; Hit description =Putative uncharacterized protein
  Pfam annotation: Domain name=Peptidase_M41; Domain location=1-143; Score=-17.0; E_value=1.7e-09; Accession=PF01434.9; Description =Peptidase family M41
KNSGGLTWFIPGEDPSLISKNQLLARIVGGLGERAEEEVIFSETEITTGVAMDLQQITQIARQMVTKFGMSKIGPWALTDPAVQGHHVDLKLVAHSLAPPGIRTIPPSPKWLSTSHGCIEAHLTDNSEPVGFIITKIDEFWQLKQVYRGNALAALISSIKQLPNNLNPLKLQMKALSLLRSILPLYWKR

SEQ ID NO: 128128 - protein, 117 aa, Glycine max
  Coding DNA Sequence Number=SeqID_36443
  Homolog annotation: Hit_ID=A5BSR3; Match level="QueryCoverage=78%, HitCoverage=29%, E-value=9e-07, Identity=34%"; Hit description =Putative uncharacterized protein
  Subcellular localization annotation: CTP_CleavageSite=41; ConfidenceScore=5.70e-01
MTSPPASPPPPPPSDASTLPFAVKRTRKASRLRSLATRPPSAARPVVHVDPTTGKADDPHRKKLRTYLGIVARDKVDVTYENWKEVPTAQKDLIWEDIQLEFEIPEASHSKTKKKLL

SEQ ID NO: 128129 - protein, 352 aa, Glycine max
  Coding DNA Sequence Number=SeqID_36444
  Gene Ontology: Mol. function=ATPase activity, coupled to transmembrane movement of substances; Cellular component=integral to membrane; Biological process=transport
  Homolog annotation: Hit_ID=A7Q0B2; Match level="QueryCoverage=19%, HitCoverage=5%, E-value=3e-17, Identity=56%"; Hit description =Chromosome chr7 scaffold_42, whole genome shotgun sequence
MARCVTERYHCSEGIHLKRLVGLRSDLASAGGTEERPNESLPTFESALTASLKRSSSQWSSLTKASSLYKSSLKKMLACVSIFKTFDRLELEESGVLSELVRLRKDFWGLHKPLVCPDGAVVAYAWTTSRTSWRTFFPATGLKIGEYKPTASGYCQFGLVVYATENESMSSSYEGYQTTLKLEDVPSVPIDFRAEKMSELFHSSWPKPEENSKHPVGLILFRCFWKHIAFTGFLAIIRLGVMPCSDTDPVFGKTNRSPLCAPIQFPLSEARHAHSLLTSFTSFEVGCYSFHRNAGPEDLVARESMLAKITKNPGEYSEPFLKEFKIFHQELKDFFNASRFDMTITNMTQYPL

SEQ ID NO: 128130 - protein, 292 aa, Glycine max
  Coding DNA Sequence Number=SeqID_36445
  Homolog annotation: Hit_ID=A7QZ43; Match level="QueryCoverage=24%, HitCoverage=34%, E-value=9e-07, Identity=34%"; Hit description =Chromosome undetermined scaffold_264, whole genome shotgun sequence
  Subcellular localization annotation: CTP_CleavageSite=44; ConfidenceScore=5.18e-01
MGTPPRSPPHSDGHSEATPKKTRQSTRLRRLNLRTLDQPRPMVVAQEKISIVHKNWKDVPESLKDLVWDKILDSLQEQTTPGSFVPHGRDDILNIAIGRPEYPGRVRVVESGEYESNVETVVNPLGEEHDGHVIPTMGVSVEKVLDGDAQVPFPTSKIHYVRETLHTFIAWAKNLVKLVAQELVVMCPRNDVVAWFCSLRKKLDVHIKVTLKTTVDGKNDQGTPKWIEVKDLLHQWIPLLLGRRMAVESRRKRERRRHFKEKMSLEEAHHHRRQWIRAWRKKEMNDGKGRRR

SEQ ID NO: 128131 - protein, 71 aa, Glycine max
  Coding DNA Sequence Number=SeqID_36446
MDIQHAQSSRTLHDNKDDDLKESKNEFKMFKIESRTFQGSRGNLISESRFKVQASKNQDQDSRLKIQESRE

SEQ ID NO: 128132 - protein, 42 aa, Glycine max
  Coding DNA Sequence Number=SeqID_36447
MLYYSNTQIIADALQALAQAIGNSNRGEATGATKYQGLDRFQ

SEQ ID NO: 128133 - protein, 106 aa, Glycine max
  Coding DNA Sequence Number=SeqID_36448
MEKKIENLRKKSELQLQPMLPVKVQKLKGRSRKQEQSRGSKFGEKNKKMKRKDLKVKGEILTFHDLSFRNLVVVALSVRERARVRLLRVRSGRASQKVVSESESAE

SEQ ID NO: 128134 - protein, 22 aa, Glycine max
  Coding DNA Sequence Number=SeqID_36449
MASNRKKQQVGSRWRRRLAEEG

SEQ ID NO: 128135 - protein, 80 aa, Glycine max
  Coding DNA Sequence Number=SeqID_36450
MPLVQAEEWDVWIGMFITGLGIVPSIAGLIDLDCDNKGVIPQAKEPRDATARSNGRGEGAKGGMVVMHYGDYHNLPNVYS

SEQ ID NO: 128136 - protein, 138 aa, Glycine max
  Coding DNA Sequence Number=SeqID_36451
MAARCFGIGVFEMDPEIMRGLGLRHQGGHFIRESGEESTIYKAVLSTPGLVSRILSCYRKKRSIWILEEIIAIKESFNLLFPIRIIVGKKFGDIGESDASKGFGWLMGVGNEGVVVGHGRQGWETTSLIEEIGNGWIV

SEQ ID NO: 128137 - protein, 883 aa, Glycine max
  Coding DNA Sequence Number=SeqID_36452
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=88%, HitCoverage=75%, E-value=0.0, Identity=54%"; Hit description =Cytokinin independent 2
  Pfam annotation: Domain name=HATPase_c; Domain location=263-458; Score=144.7; E_value=2.6e-40; Accession=PF02518.17; Description =Histidine kinase-, DNA gyrase B-, and HSP90-like ATPase
  Pfam annotation: Domain name=HisKA; Domain location=152-217; Score =82.1; E_value=1.8e-21; Accession=PF00512.16; Description=His Kinase A (phosphoacceptor) domain
  Pfam annotation: Domain name=Response_reg; Domain location=647-787; Score=87.8; E_value=3.5e-23; Accession=PF00072.15; Description =Response regulator receiver domain
  Pfam module annotation: Pfam domain module=HATPase_c::HisKA::Response_ reg; Domain location=263-458::152-217::647-787
MSAIVRDLSIRKGLTLILFFQDKELRYRFIYNHFPSLQEEDIIGKTDVEIFTGSGVKESQDFKREVMEKGLPAKKEITFETELFGSKTFLIYVEPVFSKAGETIGVNYMGMEITDQVRKRERMAKLREEIAVQKAKETELNKTIHITEETMRAKQMLATMSHEIRSPLSGVVSMAEILSTTKLDREQRQLLNVMISSGDLVLQLINDILDLSKVESGVMKLEATKFRPREVVKHVLQTAAASLQKMLTLEGNVADDMPIEVIGDVLRIRQILTNLVSNAVKFTHEGKVGINLYVVPEPPFAKAEGHQKMITEQSTNSANGVKEEKRASTPRSSSDQNCLDGQKHNDHPSQNHAFNDECRSSVKSECSMNGDTEEQTHSTETVWIRCDVYDTGIGIPEKAIPTLFRRYMQVSADHARKYGGTGLGLAICKQLVELMGGRLTVTSKEHVGSTFTFILPYKVSTACDDSDDPDELSDVDDNDDDTTEGFFQFQPRTLGSLFTSNGPTRPQNILPGFRSSHKFNGISENSYSFLTTNTRSKGISSTEDASSVIVDAPEMSESTSSSSHSPETKQESVINTNNENQDKAHARLQNGSVDSSQHKEVMVMTLGTMSNEPQQTCQLVNTDITSQRVISSNNNTLSEVTKSSLGPKILLVEDNKINVMVTQSMMKRLGYSMDVVNNGVEAVRAVQHHTYDIILMDVYMPVMNGLQTTKLIRSYEDTGNWEAARKAGIEQCLPASNECSVPPKNRIHIIAMTANTMSESAEECYANGMDSFVSKPVTFQKLKDCLEQYLSVYLKNCIDLLIYNILFHLSECIIAIRKLVGLAGACKVEGDQSGSQCFARMLQPYGINIGLKEHSNRVTPKAYTPKSPSGSLPPDSGSTQKTF

SEQ ID NO: 128138 - protein, 67 aa, Glycine max
  Coding DNA Sequence Number=SeqID_36453
MTIEGFTTEGDGNKGATEVSFGPSKARLARHLALNAFRSMWLALSARNGFCIFELNISLSAYAALLA

SEQ ID NO: 128139 - protein, 58 aa, Glycine max
  Coding DNA Sequence Number=SeqID_36454
MWYHGDQSGSQCFAIMLQPYEINIGLKEHSNRVTPKAYTSKSPSGPLLPDSGPTHKTF

SEQ ID NO: 128140 - protein, 319 aa, Glycine max
  Coding DNA Sequence Number=SeqID_36455
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8S8Z0; Match level="QueryCoverage=100%, HitCoverage=91%, E-value=1e-139, Identity=81%"; Hit description =Protein phosphatase 2C
  Pfam annotation: Domain name=PP2C; Domain location=33-299; Score =218.5; E_value=1.6e-62; Accession=PF00481.12; Description=Protein phosphatase 2C
MGYLNSVLSSSSQVHAAEDSPVSGGGLSQNGKFSYGYASSPGKRSSMEDFYETKIDGVDGEIVGLFGVFDGHGGARAAEYVKQNLFSNLISHPKFISDTKSAIADAYNHTDSEFLKSENNQNRDAGSTASTAILVGDRLLVANVGDSRAVICRGGNAIAVSRDHKPDQTDERRRIEDAGGFVMWAGTWRVGGVLAVSRAFGDRLLKQYVVADPEIQIFGNSLNFIKEEKVDSSLEFLILASDGLWDVVSNEVGNDVHFFPFPVDNYSEAVAMIKPIEDAEEAAKRLMQEAYQRGSSDNITCVVVRFLSNQGASSHSNSG

SEQ ID NO: 128141 - protein, 69 aa, Glycine max
  Coding DNA Sequence Number=SeqID_36456
MYCTPSLVHQNFGQTEQGQSSSAAATHTEYTDIEQQHCHDEGEPVIQERRNPRCNRHLPPCGTGHRLDH

SEQ ID NO: 128142 - protein, 65 aa, Glycine max
  Coding DNA Sequence Number=SeqID_36457
  Gene Ontology: Mol. function=electron carrier activity; Cellular component=integral to thylakoid membrane; Biological process =electron transport
  Homolog annotation: Hit_ID=P49161; Match level="QueryCoverage=50%, HitCoverage=10%, E-value=5e-09, Identity=93%"; Hit description =Apocytochrome f precursor
MDIEVPQAVLLDTVFEAVVRIPYDMQVKQVLANVDALDGRELIDIIPPGQLLVLEGESIKIDRPL

SEQ ID NO: 128143 - protein, 226 aa, Glycine max
  Coding DNA Sequence Number=SeqID_36458
  Gene Ontology: Mol. function=oxidoreductase activity; Biological process=electron transport
  Homolog annotation: Hit_ID=A7P679; Match level="QueryCoverage=28%, HitCoverage=20%, E-value=4e-11, Identity=37%"; Hit description =Chromosome chr4 scaffold_6, whole genome shotgun sequence
  Pfam annotation: Domain name=Rieske; Domain location=58-141; Score= -0.1; E_value=0.0023; Accession=PF00355.17; Description=Rieske [2Fe -2S] domain
  Subcellular localization annotation: CTP_CleavageSite=57; ConfidenceScore=5.28e-01
MALADPFLSTTAIQTQFSNSLTLHSLFLPNHSNINSCHFHAGGASTTGVRPSKMHICFDLKDGEDHNVFVDPSTEEELKDEEEAGDYDWIGHKSAKLSEGQLIDGKLKCLYHVWQFEGEGKCVKIPSGRRRQTQEFYTGSATTRAYIQSPSGLRSLRFLFNLVKTFTSKDPQGMYPPLFSLNNQVDVDVPSTCTTKDVPSNVLRQSSQAISPLKLCEGETKDISSD

SEQ ID NO: 128144 - protein, 134 aa, Glycine max
  Coding DNA Sequence Number=SeqID_36459
  Homolog annotation: Hit_ID=A7P674; Match level="QueryCoverage=85%, HitCoverage=75%, E-value=1e-37, Identity=67%"; Hit description =Chromosome chr4 scaffold_6, whole genome shotgun sequence
MGNQYHQATDGLLSLFTKANHDLSMVHHRLEKEFQQVYPDNANPMKLVSRIKKVQEDISILKGQCHELLAAKQDLIDKAQRVLVENRNLVQRMQPSLGISPSGEDDAAFTNFKQLVECGSVEDEGWSKKFQLKL

SEQ ID NO: 128145 - protein, 139 aa, Glycine max
  Coding DNA Sequence Number=SeqID_36460
CASSGILPDEPLLPESSRKRFSGSLPEEVFFRKTFGYFRKNTSSGNFPENVLPELPEEPLTGLPGDFSVSLFRHFFRRTLVFSPLVFYPKLRVRGRGTNLFAEKKKKALARLAEKKLHGEEKKKQVPGEEEAVPGEKKK

SEQ ID NO: 128146 - protein, 183 aa, Glycine max
  Coding DNA Sequence Number=SeqID_36461
  Homolog annotation: Hit_ID=A5AF91; Match level="QueryCoverage=46%, HitCoverage=30%, E-value=4e-12, Identity=40%"; Hit description =Putative uncharacterized protein
  Pfam annotation: Domain name=RVT_2; Domain location=1-78; Score= -172.0; E_value=0.0022; Accession=PF07727.5; Description=Reverse transcriptase (RNA-dependent DNA pol
MDALEKNGTWELVELPKEKTLVGCKWVFTSNIRQMGHSKGIRQEFEIKEQDRLKYFLGVEVAHSRHGSINDRKPMIMTFPNKEDLLEIWRIEGNPIILVEHRFNINMLEAMRVPFRDNLHLCNIINFFTKDEVVVAEMVREFWRNVFEKDRITRIMLGIQDIDPKLIKAFLYKPSASEKLELT

SEQ ID NO: 128147 - protein, 40 aa, Glycine max
  Coding DNA Sequence Number=SeqID_36462
AVAKKPGGTEGAERELEKGIWESEGVEAEIGGDRSGLRLK

SEQ ID NO: 128148 - protein, 311 aa, Glycine max
  Coding DNA Sequence Number=SeqID_36463
MEAPSIGDALSNPTLHLEQQLRVFKRPQLSPAIASFAASLRMTLDDEISFEDDGFGQQDVEHVLLDEDGLDDNECLENNVSGDNELEDEEDFDNEVSDDEHYHKIVLEDDPPNPSLFNPLVVATTKPFVAALKTVITVTVQEPLAPKIPGVEIALPMSNGGRLRRRQMKVDGDCHEEAKFMNEEESNCNTHFVQQFDRQRFEFEVEAKAIPERRRTGKLTVRLDQKTCHYGKPQKVHMQCAYVIAASKEEKVQAADDSLSEVDPLSETSSSLSGWETLEEDKPEICTPSTQPAHPTRLLSLLALSEPTLLK

SEQ ID NO: 128149 - protein, 53 aa, Glycine max
  Coding DNA Sequence Number=SeqID_36464
MKEALEMEQGIIAPVKALSVEEHKKKLVKDARLVALAGIPKDFVYRGGVDEGY

SEQ ID NO: 128150 - protein, 122 aa, Glycine max
  Coding DNA Sequence Number=SeqID_36465
MECLEGVWETLEGNERCRFPWHDSTHCYFIGTSKGTRTHALVAYGVDTTYTYSISTSGAKDPEENPEELPPEPVVDDLGLPEDDEDPLPDVDSPEDIMSASEADSTEESGPGGTASSEDSSS

SEQ ID NO: 128151 - protein, 106 aa, Glycine max
  Coding DNA Sequence Number=SeqID_36466
MKGKTPCSIIIDGNLAMRNVITRAIPSVFHKLCAWHLLRNALSHVRDKQVLKWLKKLIDEDMTKSKGKDPLEGLRGLMTRARARKAKEALQQVLSILFEYKPKFQG

SEQ ID NO: 128152 - protein, 669 aa, Glycine max
  Coding DNA Sequence Number=SeqID_36467
  Gene Ontology: Mol. function=coproporphyrinogen oxidase activity; Cellular component=cytoplasm; Biological process=porphyrin biosynthetic process
  Homolog annotation: Hit_ID=A1FY91; Match level="QueryCoverage=50%, HitCoverage=83%, E-value=0.0, Identity=95%"; Hit description =Putative oxygen-independent coproporphyrinogen III oxidase
  Pfam annotation: Domain name=Glyoxalase; Domain location=40-158; Score=56.0; E_value=1.3e-13; Accession=PF00903.16; Description =GlyoxalaseBleomycin resistance proteinDioxygenase superfamily
  Pfam annotation: Domain name=Ham1p_like; Domain location=145-293; Score=63.1; E_value=9.7e-16; Accession=PF01725.7; Description=Ham1 family
  Pfam annotation: Domain name=HemN_C; Domain location=607-669; Score= -8.1; E_value=0.0034; Accession=PF06969.7; Description=HemN C -terminal region
  Pfam annotation: Domain name=Radical_SAM; Domain location=364-537; Score=105.0; E_value=2.3e-28; Accession=PF04055.12; Description =Radical SAM superfamily
  Pfam module annotation: Pfam domain module=Glyoxalase::Ham1p _like::HemN_C::Radical_SAM; Domain location=40-158::145-293::607 -669::364-537
HRRRPCLPSRRAGRAAGPGRKGRDRTAGRTAGGAVGMNRRIALTTLVVADYDEAIAWYTGKLGFTLLEDIDQGHKRWVVVGPTDGSAAALLLARASNEEQRSRIGNQTGGRVAFFLNTDDFHRDHAAMLAAGVEFLEAPREEPYATVAEILADLPLQITSAAELGLGDVEETGLTFVENALLKARAACEATGLPALADDSGLIVDALGGAPGLYSARYAGHPTNAAANNAKLLDAMADVPDGQRSARFYAAVGRARSSASCAARMFRLQPGVPGHHPRPDRRGNGAGAEERHQPPRHCPAAAQATAGDAVLTPPDRTREAGQRPALPKKPMPHAHDHCNHLPGEACSADHDSPPRLVPPPLSLYVHLPWCVRKCPYCDFNSHQAKGELPFDAYIDALLRDLDQDLPLVWGRVVHSVFFGGGTPSLFPPEAIDRFLQQASARLRFAPNAEITLETNPGTAEHGRFDRYRAAGVNRLSFGIQSFDDAMLKRLGRIHDSGEAERAVKMAQDAGYDNFNIDLMYALPEQTLAGAEADLERAFALQPAHISHYQLTLEPNTVFFARPPQGIPDEDNAWDMQEHCQALLAQAGFGQYEVSAYARPGRQSAHNLNYWRFGDYLGIGAGAHGKISSGAEEHVLRRWKLKHPQAYLDSAGTPASFGGDDMIAPERLPF

SEQ ID NO: 128153 - protein, 177 aa, Glycine max
  Coding DNA Sequence Number=SeqID_36468
MSALKEQMTSMMDAMLGMRQLMENNVATATAVSSATEADPTLPATAHHPLPNAVGRERSTLGHISNPHLGYNQVAYPYGLPPNYTPLVMHDDVGHVPSPVLQGEPPRQSDEVHEDHREYAQGDVDFYPPGPCRGAGTQHTASTQPPSTTNILVHRRTTPGSGRKKETRSHRREIKSC

SEQ ID NO: 128154 - protein, 131 aa, Glycine max
  Coding DNA Sequence Number=SeqID_36469
MMEAMMSMKKIMEANAVAIAATSAVAKVNPMPPSGLNQMNHPTSNMVGKDLGSTGGPHYAQIQNERTFPPYGLPPNYTPPNVAYTPKIGKLDHLEERLRAIEGGIDYAFTDVEELFLVPKHGHSQVQGVGL

SEQ ID NO: 128155 - protein, 69 aa, Glycine max
  Coding DNA Sequence Number=SeqID_36470
MSGEVVHIGKRVGNIHMLNIEHASFHELSCLRGFSALSVKKEFGRAPELKQCAKREISSLSESSVSCQA

SEQ ID NO: 128156 - protein, 47 aa, Glycine max
  Coding DNA Sequence Number=SeqID_36471
  Subcellular localization annotation: CTP_CleavageSite=18; ConfidenceScore=5.07e-01
ELGLASLLAKPFMSSSVVALSVSGRTKRNLVSVVEFGLASLLAKPIL

SEQ ID NO: 128157 - protein, 99 aa, Glycine max
  Coding DNA Sequence Number=SeqID_36472
EGLFPPQNARVVVVGDTEGPPKCLAGKAVASGGSNPARLGELGGKHLPYFAINRGGSEKEKAEALPKRFRNVFRDEFRKGFDRSSTFFIRSSSFFDLQR

SEQ ID NO: 128158 - protein, 278 aa, Glycine max
  Coding DNA Sequence Number=SeqID_36473
  Gene Ontology: Mol. function=amino acid transmembrane transporter activity; Cellular component=integral to membrane; Biological process=amino acid transport
  Homolog annotation: Hit_ID=A8G9D5; Match level="QueryCoverage=100%, HitCoverage=55%, E-value=1e-132, Identity=85%"; Hit description =Amino acid permease-associated region
  Pfam annotation: Domain name=YbgT_YccB; Domain location=19-42; Score =14.9; E_value=0.068; Accession=PF08173.2; Description=Membrane bound YbgT-like protein
MALVNFEHLNTLMESHNASWMVGVGLVIVFGLLNAFGIEAFGKAEIVLTFAMWSTLVIFGIVGLLSPHAVPLEGWFGSTLSLNDPFAVFSLIGMAMFMFVGCELVTPMAPEIKRCDRVIPRAMALGLCGVAVCMALYGAALSHQVENVVIDAASGTRLLETPMAIPAFAGQVMGQFGKYWLGVGLLLAGAATINTLMAAVPRILYGMALDGALPRMFAYLHPRFKTPVVGILVAVLIPCVHAFAIQGNLDRIIPLVLAAVCAWGVAYLLVTCSVVILR

SEQ ID NO: 128159 - protein, 186 aa, Glycine max
  Coding DNA Sequence Number=SeqID_36474
  Gene Ontology: Mol. function=RNA-directed DNA polymerase activity; Biological process=RNA-dependent DNA replication
  Homolog annotation: Hit_ID=Q5NRP4; Match level="QueryCoverage=52%, HitCoverage=6%, E-value=2e-09, Identity=36%"; Hit description =Putative gag-pol polyprotein, identical
  Pfam annotation: Domain name=zf-CCHC; Domain location=113-130; Score =21.4; E_value=0.00087; Accession=PF00098.14; Description=Zinc knuckle
KNFVTIMKEGIGHILDLTPIEEKRKEMPQEANIKLSYFHGKDNVEANLDWEIRVEQQLKKKSTSKSYGSHSYPKKDQGQGILGVTPSKPKDDKGKTIEKQDPKASMQEKTSSIKCFKCLGRGHITSQCPITKTMIMRGQDIYSSQDEATSPSSKKCKEELASIATPLGLEFIPQVKKLLDEGLVRK

SEQ ID NO: 128160 - protein, 66 aa, Glycine max
  Coding DNA Sequence Number=SeqID_36475
MLDQFHPCIQDSIENIIDVKADGNCGYWTMAALLGMGEELWSLVHNHLLKELTSWSKEYINLVGGI

SEQ ID NO: 128161 - protein, 132 aa, Glycine max
  Coding DNA Sequence Number=SeqID_36476
RKTKMFVDPNNAKTATLAEVAETLQYMVSPQGRNTWTVDDLVPYVEKITILSEEQERITEPAAHGPTSERRFPPQQFHMLQSSVETRGFDRRREAVEAQEYEKQIEERGHGMYYTPPTFAEYPSQMYQYPFQ

SEQ ID NO: 128162 - protein, 142 aa, Glycine max
  Coding DNA Sequence Number=SeqID_36477
  Homolog annotation: Hit_ID=UPI000065F7CF; Match level="QueryCoverage =93%, HitCoverage=18%, E-value=3e-08, Identity=33%"; Hit description =Homolog of Homo sapiens "Leucine-rich repeats and IQ motif containing 1
SFGTCTYWLALRGLNVLTFRGLHALTFRGLHVLALRGKHALTTLTSERTTRPRHQRAARPHLQRTTRPRLERATRPHLGTTRPHHQRAARPHLQRTTCPRLERATRPHLGTTRPHHQRAARPHLQRTISPRLERATRPHLGY

SEQ ID NO: 128163 - protein, 90 aa, Glycine max
  Coding DNA Sequence Number=SeqID_36478
MVILCPLSFRSNKLSDKRAETNYGHSAPFVIQGRFRWQGDSLSEWCFARTKLVSYLYFPFISNKRQVKEGQLSYPNFISGTIRCWDATLI

SEQ ID NO: 128164 - protein, 389 aa, Glycine max
  Coding DNA Sequence Number=SeqID_36479
  Gene Ontology: Mol. function=binding; Cellular component=integral to membrane
  Homolog annotation: Hit_ID=A5WCI0; Match level="QueryCoverage=96%, HitCoverage=76%, E-value=8e-39, Identity=30%"; Hit description =Putative uncharacterized protein precursor
MTGVDPILRDYVHGALLRRDGRLAEAIALYRRLIAQHPDLGYVRLELAAMLMEDRQFAQSDAELADLRLGSLEPAAQRSVMQYRQALAQQRRWNFRLGAGAVHSNNVNSANRDPMLYLPIATRRGPVWAPFAKSRDALPKSDWGLKYSGSANVERNLGGHHYYTLGADIDGTAYRVQRDYSDRTMTLRGGYKWQDATLWFAATPQAGRSWMGGRRYSHNHGMSLEYGWRPAPDWQLMGAWLWLKRGYDDRAYAAYDGHLEVLSLTAIRVFSPALLAYGSIGLQREAVAAGEYTYRFPWAQLGVVKTFGRMLGARLSARYGRQAYESPYALFLNQRRRDRELRVDASVWTPDFKIAGLEPKLNLSYLTIASNLPMYARDRDRIQPDVGEA

SEQ ID NO: 128165 - protein, 115 aa, Glycine max
  Coding DNA Sequence Number=SeqID_36480
MSRNFTDCAAMFSLDFRHVTELHESPNDGCKYLEVVKRGSHPNNGWSPDKIRNDHNLSLCFVGHDRAWAARHRMTIICLCVPPDTIASGWRKGVRNDKGRRICLCAFITQLAKSE

SEQ ID NO: 128166 - protein, 88 aa, Glycine max
  Coding DNA Sequence Number=SeqID_36481
MSLPNAVHVFSLIKCEASGYWEARYSVVFQIGSFAKYKKKKEEEVEMRVVIAKRAERTKSVSYLCFPLISDERLARSVKFRNVAEVEK

SEQ ID NO: 128167 - protein, 157 aa, Glycine max
  Coding DNA Sequence Number=SeqID_36482
MSHHSSSVNGEDISHNDPLSRILDELSSLKLWKEKLERKEKGKERVEINQDEREKIREDERRKIKELRKEKYASYSSCRNVPFAGERGRGSRVRFPKEERCAESPPTFICGKRRKNRRKLVKMKILSSGVVFTLEEGRQKRGFCSYVPSFGEEIRPT

SEQ ID NO: 128168 - protein, 203 aa, Glycine max
  Coding DNA Sequence Number=SeqID_36483
GGLHHNSQHFSARNDAIVIRGVHEVATNSAASSETKKLEGKLDALVNLVTQLALNQKSVPVARQPGAIEQPEAYAANIYNRPPQPQQQNQPQQNNYDLSSNKYNPGWRNHPNLRWSSPQQQQQQPAPSFQNAAGPSRPYIPPPIQQQQQPQKQPTVESPPQPSLEELVRQMTMQNMQFQQETRVSIQSLTNHMGQLATQLNQQ

SEQ ID NO: 128169 - protein, 71 aa, Glycine max
  Coding DNA Sequence Number=SeqID_36484
MSLSLSKIIGRPVRVTMFCVRMLQPYGISIDLKEHSNPVTPKAYTPKSPSGPLPPDSGPTPKIILAHKLYL

SEQ ID NO: 128170 - protein, 79 aa, Glycine max
  Coding DNA Sequence Number=SeqID_36485
MEKVPRQRRQNTCFTLQDTTCLCGCEIYQQVHRVVKYLKALGPLIEKIDAIKDVSLIKDVFVFYAEDSSTKHRCLMSLA

SEQ ID NO: 128171 - protein, 99 aa, Glycine max
  Coding DNA Sequence Number=SeqID_36486
ERKPQEVNIKLSYFHGKDNVEANLDWEIRVEQQLKKKSTSKSDGSHSYPKKDQGQGILGTLASIATPLGLEFIPQVKKLLDEDLVRKSLNPCALLVPKI

SEQ ID NO: 128172 - protein, 188 aa, Glycine max
  Coding DNA Sequence Number=SeqID_36487
  Gene Ontology: Mol. function=hydrolase activity; Cellular component =membrane
  Homolog annotation: Hit_ID=A1FX16; Match level="QueryCoverage=99%, HitCoverage=71%, E-value=1e-102, Identity=97%"; Hit description =Dienelactone hydrolase precursor
  Pfam annotation: Domain name=DLH; Domain location=2-187; Score=56.6; E_value=8.3e-14; Accession=PF01738.9; Description=Dienelactone hydrolase family
LAGDDYVVLVADVYGKGVRPKTDAEAGPVATKLRNDRPLLRARALEAVNVLKAQAGKVPLDASRIGAVGFCFGGTTVLELARAGAPLAGVVSLHGGLGSPLPAQAGGSHPSVLVLNGADDKSVTAEDIAGFQKEMNAAKVDWEFTNYSGAVHCFAERDANSPPGCQYNERAAKRAWKALDEFFEERFR

SEQ ID NO: 128173 - protein, 145 aa, Glycine max
  Coding DNA Sequence Number=SeqID_36488
MSSPSEGYTPLPSEDACPHLRRATRPHLQRTHVLTFRGLHAFAIRGLHVLIFKGGLHALAFRGLHVLSFVGLHALTFERTTRPRTSEGYTPSPLEDYASSLSLPAGPPPDIGGGPTVRAQPEREAITQLLCILGQDFTRAAAKRR

SEQ ID NO: 128174 - protein, 96 aa, Glycine max
  Coding DNA Sequence Number=SeqID_36489
  Gene Ontology: Cellular component=chloroplast
  Homolog annotation: Hit_ID=Q3BAJ0; Match level="QueryCoverage=37%, HitCoverage=44%, E-value=1e-11, Identity=94%"; Hit description =Putative uncharacterized protein
MPFRLMRNKKGYRKFEVAEAEAATFEVTERKATTGVGESESKRGFLTSFSHSKPCMRLSSRTAPKNPSSVVVNDLFFSISMTCSYGTEIENIKNKK

SEQ ID NO: 128175 - protein, 91 aa, Glycine max
  Coding DNA Sequence Number=SeqID_36490
MACTKKTGQMTSEVAKEIADKLDSLEEQASQGSFVSHGCQDVQTATIAQPKHPCRVRVVGADVMIKQYFGPAPRTSCTSSSMALEDLEQLT

SEQ ID NO: 128176 - protein, 47 aa, Glycine max
  Coding DNA Sequence Number=SeqID_36491
MAGENGRTARKPHYKRNLKESWASSLKGNNTRKSSLPWIQTENAIET

SEQ ID NO: 128177 - protein, 117 aa, Glycine max
  Coding DNA Sequence Number=SeqID_36492
MEADMEAMKEQMAAMMEATMSVKKMMEANEVAIAATSVLAKVNLMSPSGINQMNHPTSDMVGKDLGIGGIPLENTSEGPQYHPQVHLLHSTTSKNPHAMAEMGKLDHLEERLRAIEG

SEQ ID NO: 128178 - protein, 65 aa, Glycine max
  Coding DNA Sequence Number=SeqID_36493
MASSESVPSYEKKMQLPQEPLNEKPRRLTRKSMAETNSVELCRAAPMSSSFEGERETNHEHIAWS

SEQ ID NO: 128179 - protein, 45 aa, Glycine max
  Coding DNA Sequence Number=SeqID_36494
MHHHERKTLDETSLLSSESEIQHDNRSTSTPYGSHRPGYRAQHLK

SEQ ID NO: 128180 - protein, 58 aa, Glycine max
  Coding DNA Sequence Number=SeqID_36495
MMKAIIVYTSHLTKRDKNASGMEKEEREEIPLQGEDESRRSSPPYEAMDKSLEEKGDE

SEQ ID NO: 128181 - protein, 77 aa, Glycine max
  Coding DNA Sequence Number=SeqID_36496
MVVVVGNIDGPPKCLVGVYHQLLALQWHIQGEARSRLDCSGVFMRLPHGLRDACMNRLRLSTFNGYGSRVIDILTGI

SEQ ID NO: 128182 - protein, 207 aa, Glycine max
  Coding DNA Sequence Number=SeqID_36497
SPNHRGVRGDLRMLNRRKEAMPFFWVLPFYGESSGSSQNLGTRVRSRFNKANTKILQKIRKAWNKVGRKDKELTGRSNGVIGGYHKWLKSRKQGIVWLKKLKGLNGEEAEVPEESEEVQALKAELEKTKVAKEKLKVVVTRVRKECDRLKDINMSTAEALEHETKKTRKEKWSSNKFRGDLLGSSNEFKLRKAERDKSRMDNMILED

SEQ ID NO: 128183 - protein, 74 aa, Glycine max
  Coding DNA Sequence Number=SeqID_36498
  Gene Ontology: Mol. function=structural constituent of ribosome; Cellular component=ribonucleoprotein complex; Biological process =translation
  Homolog annotation: Hit_ID=A4GYN8; Match level="QueryCoverage=95%, HitCoverage=63%, E-value=2e-30, Identity=82%"; Hit description =Chloroplast 30S ribosomal protein S12 B
  Pfam annotation: Domain name=Ribosomal_S12; Domain location=1-73; Score=52.8; E_value=1.2e-12; Accession=PF00164.16; Description =Ribosomal protein S12
KGDLSVNFSTITPKKPNSALRKVARVRLTSGFEITAYIPGGRVKDLPGVRYHIVRGTLDAVGVKDRQQGRSSAL

SEQ ID NO: 128184 - protein, 126 aa, Glycine max
  Coding DNA Sequence Number=SeqID_36499
DAGSRQARQGASAGVGGCRGWLNYAASEQIVLRVHHMRAIGAGLFAITPAGERGMCCKAIKLGNARVFPVTTLIPLDYLLSFELKHDIKVKGHGAGVIEEIAFAPNESHTWKVEMNSIDMSWKDCS

SEQ ID NO: 128185 - protein, 83 aa, Glycine max
  Coding DNA Sequence Number=SeqID_36500
MWIGDVVCLDFRSCNACEKLRHGRAGVVLKSNPLWLLIHHDVSFRCTNFGLSQVCSSIFKSSGAKSPAEELPRIQEATKQSSN

SEQ ID NO: 128186 - protein, 66 aa, Glycine max
  Coding DNA Sequence Number=SeqID_36501
MEHCTPKCAILAIKIAIPWVMGLNQAHAFMKKVHQVKLKYGSNHHAKIGAKDGSGYITTSSTAKHI

SEQ ID NO: 128187 - protein, 93 aa, Glycine max
  Coding DNA Sequence Number=SeqID_36502
MILHEIRRPNSLKTVPSGVATYPSAGGRCKVHECVFQERKMHGVTTNVYLRKMSEKSEKRETLRHWTINDLLGWSTKAGLLLLRILNEELRPT

SEQ ID NO: 128188 - protein, 113 aa, Glycine max
  Coding DNA Sequence Number=SeqID_36503
  Subcellular localization annotation: CTP_CleavageSite=79; ConfidenceScore=5.11e-01
MQMADRGRGGGRRTFNRGRRHGLTLGASITTNPSTSFIHISTSKSMIHVVAPTPNTLPTTQDQPNPTFVKKSIPTTPVRDASSSTQDDSLTLEYPPDLNCEHIFYQRPFIRAY

SEQ ID NO: 128189 - protein, 98 aa, Glycine max
  Coding DNA Sequence Number=SeqID_36504
MLKLSDKIIRFHRRVVLGMLEVVSSPWRFTVGNWLCNSDLVSPTGIERVLTEKDLLADSYSDLEASILDEKEFLLLKVISTFPEFVRQVASDILRRGG

SEQ ID NO: 128190 - protein, 115 aa, Glycine max
  Coding DNA Sequence Number=SeqID_36505
EGKTLGSTGSPHFMQVQSKRPFPPYGLPPNYAPPNVAHVSDENVDNSAPIPIESQQLQSGHAHVSQPMGETPKVPRDHVLADFEPHLRYATEGGPPAMMEREKFDHIEVRLRAIE

SEQ ID NO: 128191 - protein, 291 aa, Glycine max
  Coding DNA Sequence Number=SeqID_36506
  Gene Ontology: Mol. function=4 iron, 4 sulfur cluster binding; Cellular component=nitrate reductase complex; Biological process =nitrate metabolic process
  Homolog annotation: Hit_ID=P09152; Match level="QueryCoverage=53%, HitCoverage=12%, E-value=3e-87, Identity=93%"; Hit description =Respiratory nitrate reductase 1 alpha chain
  Pfam annotation: Domain name=Molybdop_Fe4S4; Domain location=166-228; Score=12.6; E_value=0.00033; Accession=PF04879.7; Description =Molybdopterin oxidoreductase Fe4S4 domain
MVLFLTAGLGSASTFQMISVIFRKLTMDRVKAQGGSEEQAMREAATDTAAALGFISAIGAIGGFFIPKAFGISLELTGSPAGAMKVFLVFYIACVVITWLGVTFAANQQCRFREPQAPHRRYPMSKFLDRFRYFKQKGETFADGHGQVLDTNRDWEDGYRQRWQHDKVVRSTHGVNCTGSCSWKIFVKNGLVTWEMQQTDYPRTRPDMPNHEPRGCPRGASYSWYLYSANRLKYPLMRKRLMKMWREAKVQHSDPVDAWASIIEDADKAKSFKQARGRAALCVLPGKRSTS

SEQ ID NO: 128192 - protein, 66 aa, Glycine max
  Coding DNA Sequence Number=SeqID_36507
  Subcellular localization annotation: CTP_CleavageSite=50; ConfidenceScore=5.34e-01
MARKPASNCFFTSSFIFKDVSGFILLSFCFTGEHSGFRGPISWSSWATILSNSGGSPTSSFPSSSV

SEQ ID NO: 128193 - protein, 447 aa, Glycine max
  Coding DNA Sequence Number=SeqID_36508
  Gene Ontology: Mol. function=oxidoreductase activity, acting on CH-OH group of donors
  Homolog annotation: Hit_ID=A6T9V7; Match level="QueryCoverage=100%, HitCoverage=100%, E-value=0.0, Identity=89%"; Hit description =Putative uncharacterized protein ydcJ
  Pfam annotation: Domain name=DUF1338; Domain location=333-444; Score =266.2; E_value=6.7e-77; Accession=PF07063.4; Description=Protein of unknown function (DUF1338)
MANTITADEIRETFHRLCRQMYQQEVPQYGTLLELVPDVNLAVLEHNPKLHEQLANADELARLNVERHGAIRVGTAEELATLRRMFAIMGMYPVSYYDLSQAGVPVHSTAFRPVDDAALARNPFRVFTSLLRLELIGNEALRQRAADILARRDIFTPRCRELIALHEDRGEFTAAEAREFVTEALETFRWHRHATVDEQTYHALHNEHRLIADVVCFPGCHINHLTPRTLDIDRVQALMPQCGIEPKALIEGPPRREVPILLRQTSFKALEEPVMFAGEHKGTHSARFGEIEQRGVALTPKGRALYDRLLNEAGVGKDNLNHQRHLQEVFSEFPDSEFLLRQQGLAWFRYRLTPAGEAHRHAFGPGDDPQPLIERGWVVAQPIVYEDFLPVSAAGIFQSNLGNETQARSHGNASREAFEAALGCEVLDEFELYQQAEERSKRRCGLL

SEQ ID NO: 128194 - protein, 42 aa, Glycine max
  Coding DNA Sequence Number=SeqID_36509
MDKSLKVGEDEWREKERRSTKFYVSNEPTNPRSSPRFFTRCA

SEQ ID NO: 128195 - protein, 155 aa, Glycine max
  Coding DNA Sequence Number=SeqID_36510
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=76%, E-value=6e-34, Identity=87%"; Hit description=LacZ protein
MQGKEENDENEKKDGEDGDEDENAQEEDEEDINDDDYNQDSRWFSLISMMYNNTFYPQKGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 128196 - protein, 44 aa, Glycine max
  Coding DNA Sequence Number=SeqID_36511
MPISPCGSISWDHAHKTPSGPGGAQQGPGVSGSGYCWIKWPLNN

SEQ ID NO: 128197 - protein, 68 aa, Glycine max
  Coding DNA Sequence Number=SeqID_36512
MFKKETSPDYADRTFSNRYHANIIQLLNTKFNGRHQSLLKAQVEKNEGPSGEGQSPRVEKDEGPSGEG

SEQ ID NO: 128198 - protein, 67 aa, Glycine max
  Coding DNA Sequence Number=SeqID_36513
MAGRKFGGEGFREREELQGRVVIDYTKMVINYQRATLPEITACNRLHYYGNRLPVVILARKQKQKAF

SEQ ID NO: 128199 - protein, 237 aa, Glycine max
  Coding DNA Sequence Number=SeqID_36514
  Gene Ontology: Mol. function=cysteine desulfurase activity; Biological process=cysteine metabolic process
  Homolog annotation: Hit_ID=Q1H3Q0; Match level="QueryCoverage=100%, HitCoverage=36%, E-value=6e-24, Identity=35%"; Hit description =Cysteine desulfurases, SufS subfamily
MSAALGVGRELENTGVLDTATLTQLVNDLYAEGFPATAPFAAADFVQSLASSHTPQPSVPATDSLTTKLGHAGGNSLGAASPSYVQAQGQPVTQEAQAQQLTHASGIEALGSDPLHNHPAHLNVLQPDAAYLVPTAFAGLGIDIPYQQELDRWLGTGASQSPSSAAFTQPANKPSAGSAQSFYFLQTEPTVIGSLPASAHPAFDVHAVRRDFPILNERANGRQLVWFDNAATTHKPQ

SEQ ID NO: 128200 - protein, 88 aa, Glycine max
  Coding DNA Sequence Number=SeqID_36515
MASGSKLAKSIELLVVIVMVNSDIFQYGNRIFGQYRQRAIQRDQVWLIQANHALFAFAYAQQQDFGFTVDDRQLVARNQRNAAPGQEL

SEQ ID NO: 128201 - protein, 66 aa, Glycine max
  Coding DNA Sequence Number=SeqID_36516
MSARVQPIAFLCFLRTDNNFSSFSSAREADIITGKLLLSSNGRRRWFLSLVPHKESQRYVYFLKHG

SEQ ID NO: 128202 - protein, 183 aa, Glycine max
  Coding DNA Sequence Number=SeqID_36517
  Homolog annotation: Hit_ID=Q6WAY6; Match level="QueryCoverage=28%, HitCoverage=9%, E-value=2e-09, Identity=51%"; Hit description =Putative uncharacterized protein
MTPSTEDVKKAMQGLFAVLQLSMWGWFHTFFSKKVGPSIRYKEGRIRILSSCEGCPNVPLMGTRGCINYNPVLTIRQLGYPVRGAPLDKSITPFITRGFSDPNAKDRELRGSSNGIIGGYHKWLRVRTQGLDWLPNLKTMRDDEVKASEEVMRAAIVSSNSEEVKGIITGQRHDLEGRAKGLP

SEQ ID NO: 128203 - protein, 263 aa, Glycine max
  Coding DNA Sequence Number=SeqID_36518
  Gene Ontology: Mol. function=phosphoprotein phosphatase activity; Biological process=intracellular signaling cascade
  Homolog annotation: Hit_ID=A7PJZ4; Match level="QueryCoverage=91%, HitCoverage=57%, E-value=7e-24, Identity=30%"; Hit description =Chromosome chr12 scaffold_18, whole genome shotgun sequence
  Pfam annotation: Domain name=DUF1723; Domain location=86-135; Score =59.4; E_value=1.2e-14; Accession=PF08330.1; Description=Protein of unknown function (DUF1723)
LKGTKAGTGPPLEVDGIDKLDPRNPSVLIGFADHVAHSIWSGHERPDLKLVSHGMKVDKFGRPTAEIEGMIAATRLDPLIRCSVITTDPGLISAFVERWHRETSSFHLPVGEVTITLDDASSLLHIPITGALHSFEPLVTSDVVALLMELLEVTADEAIAETHHTGGPHVRLSWLRDIATHVHVVHLQALRDLGQAGAFSWGAATLVHLYDQLNEASQALTWQMASYISLLQCWIYEYFPSVHKCVVDDGYVEASPRACRWLT

SEQ ID NO: 128204 - protein, 264 aa, Glycine max
  Coding DNA Sequence Number=SeqID_36519
  Homolog annotation: Hit_ID=A7NVH3; Match level="QueryCoverage=39%, HitCoverage=15%, E-value=2e-18, Identity=47%"; Hit description =Chromosome chr18 scaffold_1, whole genome shotgun sequence
  Subcellular localization annotation: CTP_CleavageSite=41; ConfidenceScore=5.08e-01
GVGHCRPSNVSSCLATAQATEFPFSEFPCPTTCLQVKVSLVAALRKAEQFLWAGSEMDSVRDMVKNLIEAQKWAEVLAHVLNCLNSCALAVVLNGLADFSPSLSPSGLWTAVASYGTPNGWAGEVEDFPTHIYVFLTRDRTHHVKVAEFGGWPSWAVVFTEQFSPPTLPFRLTRSSSNESPHRVSTRSTPATSPGNNNFNDGAYVSTVFEVIYCYVVAFKARPKNQMFPRRCCRRNVFEGADVYNDVAFKDGRSPSLNADDDRR

SEQ ID NO: 128205 - protein, 73 aa, Glycine max
  Coding DNA Sequence Number=SeqID_36520
  Gene Ontology: Mol. function=nucleoside-triphosphatase activity; Cellular component=integral to membrane; Biological process=protein catabolic process
  Homolog annotation: Hit_ID=A7NYK3; Match level="QueryCoverage=53%, HitCoverage=7%, E-value=7e-09, Identity=79%"; Hit description =Chromosome chr6 scaffold_3, whole genome shotgun sequence
MGGLRAILTDQNKLVVAVCGVTALAAGRGLHCKGIEEKTAKLKGSEKALVARHEARYAVVGTAVAYLLAGQPH

SEQ ID NO: 128206 - protein, 163 aa, Glycine max
  Coding DNA Sequence Number=SeqID_36521
MNTNEKIQSMQKRFTHIVNHLASLGKIFPNEDLINKVLRCLSREWQPKEHDMELQCLNQNEEIDKRKRSISLKASSSMQEEEEKEESDDEEDFSLFVKKFHKLVKNRRMERRHSFDNGKRSQEEKNEKKSDEERRSKKAYIAWDDNDSSDGSQKEINLLSGIL

SEQ ID NO: 128207 - protein, 108 aa, Glycine max
  Coding DNA Sequence Number=SeqID_36522
MGNQPRPNCNASGYFGFQHGQQYNQQQGQWRTHPELGIKNLEVQVGQLAKQLADRPSSSFGANTEKNPKEACKAIMTRSKMVSMNEEIDPVVEPLSEIEEELETEDDQ

SEQ ID NO: 128208 - protein, 222 aa, Glycine max
  Coding DNA Sequence Number=SeqID_36523
  Homolog annotation: Hit_ID=Q6WAY6; Match level="QueryCoverage=88%, HitCoverage=33%, E-value=1e-14, Identity=31%"; Hit description =Putative uncharacterized protein
KGGANWDQLLANKEGASINWFSRWKEGRTGVLFLCGGFPNVPLMGTRGCISYNPVLAIRQLGYPMRRAALEDELAPVISRGFNKTNVETLQKVRKAWEVLQKKDKELKGNNNGPIGGYRKWLKSHVQGLDWLPSLRTEEVEAPEEDEEVQALRAELEQAQTVKERFKSTALKNSKENTELRDVNVATTKALERETKRACREEHGRNKFRGALWGSNSELKLR

SEQ ID NO: 128209 - protein, 43 aa, Glycine max
  Coding DNA Sequence Number=SeqID_36524
MTGPLDESISCFLIRVDPWVLSYPNFVRGPLLDDMRPFFGPCE

SEQ ID NO: 128210 - protein, 177 aa, Glycine max
  Coding DNA Sequence Number=SeqID_36525
  Homolog annotation: Hit_ID=A4PP05; Match level="QueryCoverage=41%, HitCoverage=20%, E-value=9e-07, Identity=38%"; Hit description=IMP dehydrogenase/GMP reductase, putative
HFPSVAEYMADSDYDEVSPRACRWNATKATLKSISIATYRQRLDRLRIPDVCWMPYGEHRPFGYVQSIPIEAVDSWVSFEEIDDRWMHYSDHLAPAGEICHVLGQCALEYMDYHISLRSQSHQQQHRHMPDACHAIAERLECLLNLRIVMAGIETHKVMEECIKIARGVIEDDNVYV

SEQ ID NO: 128211 - protein, 126 aa, Glycine max
  Coding DNA Sequence Number=SeqID_36526
MEAIKEQMDTMMKAMMSMKKIMEVNAVIVAAISAVAKVNPMLPSRLKQMNHPTSNMVGKDLGTDFEPCLGYATEGQAVGGIPLQNTLEGPQYLPQAQPSRSTAVKNPHDYGRNGKVGSSRGKAQGH

SEQ ID NO: 128212 - protein, 76 aa, Glycine max
  Coding DNA Sequence Number=SeqID_36527
MDGEELPSPVNSDGQFLLRSRLEVKTSQWQKSTKVLRKGGEWRIGLRPTNRHPFSALGQQRTSLQGSPVSFEFTVF

SEQ ID NO: 128213 - protein, 221 aa, Glycine max
  Coding DNA Sequence Number=SeqID_36528
  Homolog annotation: Hit_ID=A8T484; Match level="QueryCoverage=36%, HitCoverage=19%, E-value=2e-13, Identity=46%"; Hit description =Putative uncharacterized protein
MIGEWPEPLDSYSTCPCKAKFIPSMMDDTYEKSSGASAGESAAGFTAAPTQTSPELPGYLTGEQKPTGFVPDYPVLRNTHDLPDGNLRAMLNANNNNVMLLTLGEVFEYLTSMGFYKSGWSFISQSKPGEFVVNYGTRKWAVDVVKVGISSAITWGAGAYAIGVFSTIAAPIVVVLVAGALSAWALNKLDDEYKITDKVISLIESAQQEFVEKAKEMEKGI

SEQ ID NO: 128214 - protein, 427 aa, Glycine max
  Coding DNA Sequence Number=SeqID_36529
MASRKRKSTTSRPIAQYTDNILGWNILSERNVKLYHTEFDEFKVELERRNLHKCLANLRDGSIDMALVKEFYANLYTMEEQAPKQARVRGHLIKIDAGMLNEFLQTPVVLEEGESLPTYSRFYKLRTNHQEIKARLCIPRKGFVLNAEGQPWKILRKDLTTLAQTWSVFSYSNLAPTSQTSDLNIDRARLVYGLVTNMDMNIGALISGQISSIAQSNSSRLGFPALITAHAELEKLPLTLTLEGQGRQGFDQLVFPSSSTQPTPSTSTTPTPAPRGPYAQDSQRFESMLQSLHKGQILLMQSLQVIAPPGSILIVEQFLEKVQDASSEATIPEPFILEVGETQVRQEAAALERSPQTSPDPPSLVVDQSSLQQPADPSTPLLDLLEDPSTPVLGLTTTPPATPVLRLTDKEGTQDEDTQSQDLSQEF

SEQ ID NO: 128215 - protein, 158 aa, Glycine max
  Coding DNA Sequence Number=SeqID_36530
TEFEILEASNSRTKKKLLQTVSERWRQFKSDLTRKWALAADQDGVDDTICEKYGISKEKWAQFFQTHRDPSWEKKAQAIQKQNTAPHVLSRGGYEYLEQKLLAEKTKKKMEEVAQLGSIDGVIDPPSPVRHHMKWKMAHTKKTWEMTTEAAKEFAAKI

SEQ ID NO: 128216 - protein, 22 aa, Glycine max
  Coding DNA Sequence Number=SeqID_36531
MLPFEFRHVTNCLTMGGKYLKM

SEQ ID NO: 128217 - protein, 150 aa, Glycine max
  Coding DNA Sequence Number=SeqID_36532
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=72%, E-value=3e-24, Identity=68%"; Hit description=LacZ protein
MEKMNSTLLFSVKEQDSSCLVKKTIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 128218 - protein, 99 aa, Glycine max
  Coding DNA Sequence Number=SeqID_36533
MHGSVKIARSVLAPCPYFRDPYGRELKGLLVIIPKVVISLLMVSRVPSGVANCRNLPFGGRATRGLRVRLPWEEDARSRRQRLFEENIGKTGKNVVYEL

SEQ ID NO: 128219 - protein, 205 aa, Glycine max
  Coding DNA Sequence Number=SeqID_36534
MTPAEARNLIEKMASNSQQFSARNDAIVLRGVHEVAMDSSLSTENKKLEGKLDALVNLVTQLAMNQKSAPVARVCGLCSSADHHTDLYPSLQQSGVNEQPEAYAAKIYNRPPQQQNQQQQNNYDLSSNRYNPGWRNHPNMRLPSPPQQQQQPFPPFQNTVGPSKPYVPPPMQSDNQIQVPPLVAGLAPEPVKLHSTLEKEDEIVA

SEQ ID NO: 128220 - protein, 164 aa, Glycine max
  Coding DNA Sequence Number=SeqID_36535
  Subcellular localization annotation: CTP_CleavageSite=32; ConfidenceScore=5.10e-01
MQRQTRSSAHFHFKDDNVFSHYMPSKATMTIVCISKTTMSSVIACLQRRQCLQSLHAFKGDNDYHLHFEDDNVFNHCMPSKVTMTIICISKTTMASVIACFKGDNDLHLHFEGDNVFSHCMPLKGNNAIIYAFEDVKVFNSKTSIFVVLVLHRTRRPLFLIFFK

SEQ ID NO: 128221 - protein, 119 aa, Glycine max
  Coding DNA Sequence Number=SeqID_36536
MGTKGCISYNLVLAIRQLGYPMRGAPLEEELTPIIARGFNKTNVEALQKVRKAWEIMQRKDKELRGNNNGPISGYRKLLKAHTQGLNWLPSLRTVKGEEVEALEEDEEVQSLRAELEQA

SEQ ID NO: 128222 - protein, 62 aa, Glycine max
  Coding DNA Sequence Number=SeqID_36537
MYVNLAKEVHEMAPRKLASKRSRKDKAAEGTSSAPEYDSHRFRSAEHQQGFEAIKGWSFLRE

SEQ ID NO: 128223 - protein, 161 aa, Glycine max
  Coding DNA Sequence Number=SeqID_36538
  Gene Ontology: Mol. function=helicase activity; Biological process =viral genome replication
  Homolog annotation: Hit_ID=Q2A9E0; Match level="QueryCoverage=100%, HitCoverage=12%, E-value=6e-44, Identity=47%"; Hit description =Putative uncharacterized protein
MVHGPCGILRPASPCMKEGKCSRFYPKKFQRATLIDGAGYPVYHRRNTGRTITKNVIIIDNRCIVPYNPKLLKKYQAHINIEWCNQSTSIKYSFKYINKGYDRVTAVMVHDDTGTLPHANTPNDEIKEYLDCRIFGFPIYGRNTYVERLQFHLPEQHSVVY

SEQ ID NO: 128224 - protein, 62 aa, Glycine max
  Coding DNA Sequence Number=SeqID_36539
MSLYYEFQFLVECRGNDSHQVDPRAPQKAAVSGVNVHYLKGNLTGMGAYQYREVDLSPNLSA

SEQ ID NO: 128225 - protein, 52 aa, Glycine max
  Coding DNA Sequence Number=SeqID_36540
METDALQALAHAVGNQNRGEAAGDAEYQGLDRFQRNNPPAFNGGYNRDGAQN

SEQ ID NO: 128226 - protein, 173 aa, Glycine max
  Coding DNA Sequence Number=SeqID_36541
MELIENMVVSDHAILRDRTHIPTKRSLLELSSQDALLAQYKFLAKKLETLTGTLSCSISGGAYESGCYIPLDEVAQEVNYMGNQHRPGFNAGGFAGFQQGSNFNQNQGQWRSHPGNQFNKDQGGSSNKPQNQGPGLYERTTKLEETLAQFMQVTMSNHKSTESAIKNLEIQVG

SEQ ID NO: 128227 - protein, 94 aa, Glycine max
  Coding DNA Sequence Number=SeqID_36542
MVIKYLTTRCTFRRAVVAALIPIDLEINATCRKRKAERKQDIEVAKTLEEPLSSEASSSFPTQGQSHTILAEANIMAEEPRRVTLEDYSSSSVS

SEQ ID NO: 128228 - protein, 17 aa, Glycine max
  Coding DNA Sequence Number=SeqID_36543
MGLKAQVEKGEGPSGEG

SEQ ID NO: 128229 - protein, 78 aa, Glycine max
  Coding DNA Sequence Number=SeqID_36544
MTKLPRPEVVAFDAGTAACELHAPEVARRRSGAWRRVRQRKAARVAGLGRTSRGDLNPGLTGENRRRWRPAADGGNPL

SEQ ID NO: 128230 - protein, 108 aa, Glycine max
  Coding DNA Sequence Number=SeqID_36545
MDCETFLKKIGSFVPHGRQDVLAAAIGRLEHPGRVRAAGAGVTIKQYFGSAPRTSRSASSLPPDELHQLTQQIRHQLEESITEKVKAGHGILQPASVTDAISGTCSAS

SEQ ID NO: 128231 - protein, 90 aa, Glycine max
  Coding DNA Sequence Number=SeqID_36546
  Homolog annotation: Hit_ID=UPI00016621D1; Match level="QueryCoverage =93%, HitCoverage=35%, E-value=1e-07, Identity=40%"; Hit description =UPI00016621D1 related cluster
MHVLTFRGLHVLTFRGLDALAFRGLLVLAIRGLHVLAFCGLHVLSFKGLHVLVFRGLHVLVFTRLHALSFRGLDVLAFRGLHVLTFPGLH

SEQ ID NO: 128232 - protein, 47 aa, Glycine max
  Coding DNA Sequence Number=SeqID_36547
VVMTAISYAESPVISLVRPEGKVISAPLPGRVSQQMAAALCCGCTSG

SEQ ID NO: 128233 - protein, 98 aa, Glycine max
  Coding DNA Sequence Number=SeqID_36548
MRIKRPFKVVMGPRTRLVVSFKTRKGKQGSKGLSKELIQSKSIWLEAYKNKIASIISKYACELGSINKNQAKAIMPSNQLGQNTPNDYGDGWLKFSQR

SEQ ID NO: 128234 - protein, 255 aa, Glycine max
  Coding DNA Sequence Number=SeqID_36549
  Gene Ontology: Cellular component=outer membrane
  Homolog annotation: Hit_ID=P0AB36; Match level="QueryCoverage=52%, HitCoverage=83%, E-value=3e-65, Identity=81%"; Hit description =Uncharacterized protein ycfJ
  Pfam annotation: Domain name=Rick_17kDa_Anti; Domain location=85-117; Score=27.6; E_value=4.4e-05; Accession=PF05433.6; Description =Rickettsia 17 kDa surface antigen
AHCPLRVYLPVPYAPDCAARLLQNRTDDAGIGVAAALGVAAVASLNVLDRGPQYAQVVSATPIKETVKTPRQECRNVSVTHRRPGGVIGHQFGGGRGRDVATVVGALGGGYAGNQVQGAMQDNDTYTTTQQRCKTVYDKSEKMLGYDVTYKIGDQQGKIRMDKDPGTQIPLDGNGQLAEELFFASEFEELRPQSQRGVADSLQFFQRGPFTGADRHPLQNTAQVLRQHLRVTVRRDFTALLTLSQKRAERLLLHG

SEQ ID NO: 128235 - protein, 49 aa, Glycine max
  Coding DNA Sequence Number=SeqID_36550
MEELIKKTQLSPQNIPNVITSAWRFLDRISSLHLIVVILLHTNKVRDHH

SEQ ID NO: 128236 - protein, 101 aa, Glycine max
  Coding DNA Sequence Number=SeqID_36551
SLFWGRHNASSEATIPGAFDFSGAGVEMRPDEDVFLKPIVPVIYETVEAANPPTPVHERQADPPTPIMEMSKDPTTPVLRRPSTPLVTPVLHPTDEEDMQD

SEQ ID NO: 128237 - protein, 207 aa, Glycine max
  Coding DNA Sequence Number=SeqID_36552
MVAGRNVAKQQRHLDLREGGDAGAHDSHPSPCYAPGKVLPRNAQQLADSLLVEARGLTPPLGKLTTLAFFQDQWMPQKLVDGILIERNPLAPHPGALVSDSLFCRPSVRIELHDYLRIELSHGCYKLSPLPPGNFLLKLSILFVPQMDSPLPEERPTFNGLKSLLVFLTLEPMSIKIHICLWGRTRTLSSGIFPGPLGRKLLRSHFL

SEQ ID NO: 128238 - protein, 164 aa, Glycine max
  Coding DNA Sequence Number=SeqID_36553
  Homolog annotation: Hit_ID=Q1H0W6; Match level="QueryCoverage=39%, HitCoverage=8%, E-value=2e-07, Identity=48%"; Hit description=TonB -dependent receptor, plug
VNVTYRKVSERDILISGDGTVNSRYVFGQQDGYEMWNAGIRLKVNEQLTFRLIGENLKNEEYRLDGSMGGLGMYGPGRNALAFVQAFLCGTWEVSKTDQATVNQDADQVFQYTCQLNVTFTEGHKVSFLVTWRQTLLSYTTTLCPGVIAHWCWPKRIVASSAFT

SEQ ID NO: 128239 - protein, 74 aa, Glycine max
  Coding DNA Sequence Number=SeqID_36554
  Gene Ontology: Mol. function=hydrolase activity, acting on carbon -nitrogen (but not peptide) bonds; Biological process=nitrogen compound metabolic process
  Homolog annotation: Hit_ID=A4W6W3; Match level="QueryCoverage=100%, HitCoverage=28%, E-value=5e-33, Identity=90%"; Hit description =Nitrilase/cyanide hydratase and apolipoprotein N-acyltransferase
MDGPANLRHFDRQLEDITGRDVIVLPEMFTTGFAMEAAKQSMPQEEVVAWMHTKAQQTHALIAGSAALQTERGP

SEQ ID NO: 128240 - protein, 145 aa, Glycine max
  Coding DNA Sequence Number=SeqID_36555
  Homolog annotation: Hit_ID=A5B370; Match level="QueryCoverage=80%, HitCoverage=18%, E-value=4e-10, Identity=33%"; Hit description =Putative uncharacterized protein
  Pfam annotation: Domain name=SWIM; Domain location=71-107; Score =16.5; E_value=0.0074; Accession=PF04434.8; Description=SWIM zinc finger
MADYSSTYGNEVLQTNLRSLERSGDHLLTKEMFRLFQSYLCRTIKLRVVDCKEMATFSIYTVLKYCSGSVWLVSYCPSTVDFSCSCMRMQSIGLPCDHILVVLVSLNFMELPKYATLVEVGRQVCEDAYRDEDEYEKMLHFLPNE

SEQ ID NO: 128241 - protein, 130 aa, Glycine max
  Coding DNA Sequence Number=SeqID_36556
  Pfam annotation: Domain name=zf-CCHC; Domain location=61-78; Score =30.9; E_value=4.6e-06; Accession=PF00098.14; Description=Zinc knuckle
MKHSTKASSSMQDENEDEESEDEEDFSIFVKKFHKFVKKRRIEKHQNFNHGKRFQEDSPTLRCYKCNQFGHIKANCPSNEQWPEKNEKKSHEERRSKKAYIVWDDNDSSDGSEKEINHLSEDYESDENIS

SEQ ID NO: 128242 - protein, 130 aa, Glycine max
  Coding DNA Sequence Number=SeqID_36557
MIIDESLFFSLTQLPSQGAPFEGTIVDDWKFDYSNHDARRMVCIDQGDMTDRLLVGSLTFDCRIMHYIIVRILMPRSSNLAQAFEEDLILMWAFLTGRPIDWAHLIHYHMHKALRSSAPLPYPQLVTLFL

SEQ ID NO: 128243 - protein, 82 aa, Glycine max
  Coding DNA Sequence Number=SeqID_36558
MERYLQHLVHQQVPNHRGQGQGFAPFTCPTPDQFRAEVAWPGDWLEAQVGEAPAVAPGDAEEARMDEEMTDLLGFLGGSGAT

SEQ ID NO: 128244 - protein, 67 aa, Glycine max
  Coding DNA Sequence Number=SeqID_36559
MFNTHRSGIRKDPRCFGKKPVKKHENGSVFSKVEPSQHILEVGLLKEEATGRQAPPSFVEKWFPGLP

SEQ ID NO: 128245 - protein, 73 aa, Glycine max
  Coding DNA Sequence Number=SeqID_36560
  Homolog annotation: Hit_ID=UPI0000ECBAF8; Match level="QueryCoverage =56%, HitCoverage=48%, E-value=1e-16, Identity=100%"; Hit description= UPI0000ECBAF8 related cluster
MDSIPATAIETGDVAPTQTVGMQAWHWPSFYNVVTGKTLALPNLIALQHIPLSPAGVIAKRPAPIALPNSCAA

SEQ ID NO: 128246 - protein, 144 aa, Glycine max
  Coding DNA Sequence Number=SeqID_36561
YPELRRSEFLIGGYVGARASLLSTAPPFVTMTQELVACGDTLRLSAPRHSVTPSVIDEQRPMWSSAPFPEVSASSGGDFFKSHKLSRTTSHVTCGDTQVVVRTFKTFCCLGGGLDDMQRQIMVIPHTFCHSDTVVPDGTQRQIM

SEQ ID NO: 128247 - protein, 108 aa, Glycine max
  Coding DNA Sequence Number=SeqID_36562
MAASDIAILRDRAHILTKKSLLELTSQDALLVAGCTICRGAHDCGCCIPSEEPIVHEVNYIGNQPRNTFNAGGFTGFENGQQYQQQRQWQNHPGNQFNRDQGGPPNRP

SEQ ID NO: 128248 - protein, 43 aa, Glycine max
  Coding DNA Sequence Number=SeqID_36563
MGLNQAHAFTKRGGARADGSHDEHEEDNEANAVVVAATNVVAK

SEQ ID NO: 128249 - protein, 54 aa, Glycine max
  Coding DNA Sequence Number=SeqID_36564
NAFKGYFNDAKEFKNQEKFQVSSFQESRIKNNQEQDSRLKIQESREDLIKISMK

SEQ ID NO: 128250 - protein, 57 aa, Glycine max
  Coding DNA Sequence Number=SeqID_36565
MCCAGVVGAQKGWRENDLNRRTTKNVEERLKIFAKSPTETLRKRLGLDFLHGNNFSH

SEQ ID NO: 128251 - protein, 146 aa, Glycine max
  Coding DNA Sequence Number=SeqID_36566
MDQLSQSNGLGSVYGFLEPQAILNANDKRGQCQEYIEKWLKESNRDVYLGAYLNHAFKTLETKSEGKFGHSTPRWIEVKSHVQSGTYECGYFVMHWMWNIIVGQLKTNWTLWFNDGTPLDINIMTTLRKKWAEYFVKLRSIQCTKL

SEQ ID NO: 128252 - protein, 146 aa, Glycine max
  Coding DNA Sequence Number=SeqID_36567
  Homolog annotation: Hit_ID=UPI0000ECBAF8; Match level="QueryCoverage =28%, HitCoverage=48%, E-value=1e-16, Identity=100%"; Hit description= UPI0000ECBAF8 related cluster
TGGTTRPVKDRSASPAEGTSRPVHTGGGPIDPTQAGITAAAGTRLALQWILVKGFRLYSFQLPDSMSPAPSPESNPNSPSPVTTMVGHYPTIESMQAWHWPSFYNVVTGKTLALPNLIALQHIPLSPAGVIAKRPAPIALPNSCAA

SEQ ID NO: 128253 - protein, 166 aa, Glycine max
  Coding DNA Sequence Number=SeqID_36568
  Homolog annotation: Hit_ID=UPI00006A2939; Match level="QueryCoverage =83%, HitCoverage=87%, E-value=6e-13, Identity=32%"; Hit description =UPI00006A2939 related cluster
MSKSCGFGMTGPLDESISFFLIRVDPWVLVTLTFRGLHVLTFRGLHALAIRGLHVLTFVGLHALTFRGLHVLANRGLHALTLRGLHVLALRGLHVLTIRGLHALTSRGLHVLALRGLHALAIRGLHVLTFVGLHALTLRGLHALAIRGLHVLTFRGLHALTLRGLH

SEQ ID NO: 128254 - protein, 159 aa, Glycine max
  Coding DNA Sequence Number=SeqID_36569
  Gene Ontology: Cellular component=mitochondrion
  Homolog annotation: Hit_ID=O47882; Match level="QueryCoverage=100%, HitCoverage=62%, E-value=6e-51, Identity=54%"; Hit description =Putative uncharacterized protein orf1
MSIGFCFMPGQGEFLIKDLRAPDTLVGLRKLKDSLGLSLTKGSLNSNPLLKLKGISDSVSNSMESLASRVLVEVITFNEGYYGRFLILVQMGIGCTVWYGFVPGFVPLSQAFAQDRPFMDMDIEIPDSNKSIIIGVSLGLAVAILFTFGINPCRGEVIV

SEQ ID NO: 128255 - protein, 83 aa, Glycine max
  Coding DNA Sequence Number=SeqID_36570
MGDQEEVQEQMKADMSALKKQMASMMDAMLGMKKLMENNAATAATISSAVEADPTLPTTAHQPIPNVVGRERSTLGYISNPHP

SEQ ID NO: 128256 - protein, 207 aa, Glycine max
  Coding DNA Sequence Number=SeqID_36571
MKRITGAPYQARWDALTITDVCWLPYSDHRGVKGFELISSFQGKLRWGPTVVTVRPERVLCRFWYIQSIPPPFVSASLSYDDIDDRWMHFSDHATAVGDLYVVPGQAGDQPRHAPAPDHEDYMQPDIPQVPVAFDPPRHAVDDYEGYEAIAERLERVLNLRMVTAGTELHDIMQDCLRIARGVPAQMEVLGLDKGGAQSIDDVFYVL

SEQ ID NO: 128257 - protein, 77 aa, Glycine max
  Coding DNA Sequence Number=SeqID_36572
MVKENSMEAKCLRKKGKYGEGMNEKVKVILWMNALLEPKLLNPRKTMNCWQPNPITSLESLSDSFLCVHCCMIEDEM

SEQ ID NO: 128258 - protein, 100 aa, Glycine max
  Coding DNA Sequence Number=SeqID_36573
DGYEPGMGWGQNSDCLTNLVEFAENCGRFGLGYKSMNADKRRISLERKERSLARLQGWGPQVERIPICRINESFVNAGWMHEDQVVVLDEETNQDQSNWV

SEQ ID NO: 128259 - protein, 76 aa, Glycine max
  Coding DNA Sequence Number=SeqID_36574
MGEMLATQLAQASKYRHIIPILSNLFLSVDTRRKMTIICLCVLLDTIASGWRKGVRNDKGRIICLCVLTTQLAKSE

SEQ ID NO: 128260 - protein, 300 aa, Glycine max
  Coding DNA Sequence Number=SeqID_36575
  Gene Ontology: Mol. function=methyltransferase activity; Biological process=metabolic process
  Homolog annotation: Hit_ID=A4U162; Match level="QueryCoverage=36%, HitCoverage=31%, E-value=1e-08, Identity=34%"; Hit description =UbiE/COQ5 methyltransferase
  Pfam annotation: Domain name=Methyltransf_11; Domain location=133 -227; Score=73.4; E_value=7.3e-19; Accession=PF08241.3; Description =Methyltransferase domain
  Pfam annotation: Domain name=Methyltransf_12; Domain location=133 -225; Score=64.0; E_value=5e-16; Accession=PF08242.3; Description =Methyltransferase domain
  Pfam annotation: Domain name=Methyltransf_9; Domain location=39-285; Score=-153.9; E_value=0.023; Accession=PF08003.2; Description =Protein of unknown function (DUF1698)
  Pfam annotation: Domain name=TehB; Domain location=123-229; Score= -122.3; E_value=0.065; Accession=PF03848.5; Description=Tellurite resistance protein TehB
  Pfam module annotation: Pfam domain module=Methyltransf _11::Methyltransf_12::Methyltransf_9::TehB; Domain location=133 -227::133-225::39-285::123-229
MGGRWTQGFKSRIGQAIRRRLYRVRDRIMGPDPAVAAAVQSEVHTLEERLAERLTYLQNEISEARQYLRFLLGESERYHQWMSQTRASFNTQWDILPEGAHLVTDEAFVTNASQLIETYTQLPAAWFKGKSILDAGCGNGRWAYAFSRLGANVMAVDQSEHGLQNVRRLCEEFPGFRHQAVNLLEPLPFDDQFDLVWSYGVLHHTGDTNRAFDNIVPAVKSDGSMFLMLYGEPFRPGEYGEINTYVQHRRATVAMTFSEKVDYLKGIYPAELVHGYFDAISPAINDLYRYDEILDWLNLC

SEQ ID NO: 128261 - protein, 265 aa, Glycine max
  Coding DNA Sequence Number=SeqID_36576
  Homolog annotation: Hit_ID=Q5CDC4; Match level="QueryCoverage=10%, HitCoverage=21%, E-value=4e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSRCVGTFVQGSTGEKNGDLFPDEAENGLVGGDGREAQVLVVALVGGGTWDARRGRCCSWRPGGGGPPTSQFWISAPDIPVGNSGPLPQASGTELEFVIMVIAVSCVKLLSAHNSTQHTSRKHKV

SEQ ID NO: 128262 - protein, 121 aa, Glycine max
  Coding DNA Sequence Number=SeqID_36577
  Subcellular localization annotation: CTP_CleavageSite=36; ConfidenceScore=5.35e-01
MRVHYYQASQRPSMTTDSPPLLMFPWTRSPVESPTVATYPSAGGRRGAHGWVFQERKMRGVATNVYSGKTSKKPERCGLRTLSVKGSGVVFTHREGFRKSTFNQEKQRGPFKALDLKMVFR

SEQ ID NO: 128263 - protein, 346 aa, Glycine max
  Coding DNA Sequence Number=SeqID_36578
MALNKLSTKMSRRDAHGESSSASMELSTRRHWTPLVTPMAKFDPEIVLEFYTNAWPTEEGVRDIRSWVRGQWIPFGTDALSQFLGHPLILEEDQRCKFYQRRDQASGFDEEAIAQLLCIPGQDFAQTAAGRREWIMCTSMTTLTQIWMTLLLSNILLSDHNFDLPLPKCQMVYTILTWMTVHVDQIIADAIYLFAGAAPTRHPLDPKRSNRALGFLALIMGLCQFYGVLVIPSKVIRPPITQAFIEKYCTPRQAKGDAQQAADAPPPQQPDPVIPLSVEQYLRHMVRQQMANHRGQGQGSPPFVCPRDWPTEEGTGPAGSSSEAEEAHMDEDMTDLLGYLGKGGAT

SEQ ID NO: 128264 - protein, 67 aa, Glycine max
  Coding DNA Sequence Number=SeqID_36579
  Gene Ontology: Mol. function=aspartic-type endopeptidase activity; Biological process=DNA integration
  Homolog annotation: Hit_ID=A5BPN8; Match level="QueryCoverage=94%, HitCoverage=6%, E-value=1e-18, Identity=65%"; Hit description =Putative uncharacterized protein
MCSASSGESFNAELRGTKRRIDNTNSEALWHKRLGHISKNRIERLVSSGILDSIDFTSFDVCAECIK

SEQ ID NO: 128265 - protein, 59 aa, Glycine max
  Coding DNA Sequence Number=SeqID_36580
MDKILKVGKDEWRERERRGHGIYASNEEVSLAIRELLKEVFSKKLLKEVFSRKLLKEAT

SEQ ID NO: 128266 - protein, 69 aa, Glycine max
  Coding DNA Sequence Number=SeqID_36581
MAERVDSKFRLDCKERCFWSSFFLVDNKPDAILPRKGPVTRAMSKRLQEDWARAAEEGPRILMNLGVDF

SEQ ID NO: 128267 - protein, 79 aa, Glycine max
  Coding DNA Sequence Number=SeqID_36582
  Subcellular localization annotation: CTP_CleavageSite=38; ConfidenceScore=5.32e-01
MLQTKSRTGFRATLSFSRPANLETSLFLNQKSQLAAFLASSKSKESLAQNLKEVLQLLQQEEEEEPPKKEAESSENNDD

SEQ ID NO: 128268 - protein, 105 aa, Glycine max
  Coding DNA Sequence Number=SeqID_36583
NSPLQPIYRKKGEEVAALARLRRARCDSWRLHWGARARLTGVLSKGGKENRRKPVKMKILSSGVVFKFEEGISTSHVDKSGAFAPTYPPLEKKSDLRSSYLGTNQ

SEQ ID NO: 128269 - protein, 213 aa, Glycine max
  Coding DNA Sequence Number=SeqID_36584
MNANEEDGPSRAKSLGEVATSRRFIYQSLQAVCMVSRGGGKKDEYLFHLGESHDMETCPAVEELLQRFMDCGQLEVSIGGREEPQICMQSEEKKVPLTPKALVICFTRKGTGSTPIERVATEVDSLSAKVTNITGLSGITRSGWVFASPHPAEFPSKGKAPMVQEPTDVATPSKEVDPPVVRGAKKKEGLQGKTVTLEEAHEFFHLIQQSEFK

SEQ ID NO: 128270 - protein, 388 aa, Glycine max
  Coding DNA Sequence Number=SeqID_36585
  Homolog annotation: Hit_ID=Q2HW90; Match level="QueryCoverage=89%, HitCoverage=71%, E-value=6e-32, Identity=28%"; Hit description =Putative uncharacterized protein
MGTNQTGKRFYQVKVKSLDTTSIKELGWLMEPLQMQAFRKIYGKILELTIAEVSIEAIASLTQYYDQPLRCFTIGDFKLVPTIEEFEEILGCPLGGRKPYLSSGKRFGPHKTDSERHSGPTTEVPRRHGKGYGQSRRLGPVYGCVSFANFWGRPLSKRRWLVDLAAIDAFLAYHHSKESPVVAVLADLFDTFNRRCKKSSARIICCLLALCVWLVSHLFQQDTRHPCPLQSHRSCTEKRRIDWDQLLAGIRGRTINWFPRWKEGKEGVLFSCGGYPNMPLIGTRGCINYNPVLAIRQLGYPMRGAPMEESMSPFLVRDFGAQNFKAIQRIHKAWETLLRKDQELRGIRNGIIGGYHEWLKVHIRGLDWLAKLKVVSEESFEAPEEDEE

SEQ ID NO: 128271 - protein, 124 aa, Glycine max
  Coding DNA Sequence Number=SeqID_36586
  Gene Ontology: Mol. function=transcription regulator activity; Cellular component=nucleus; Biological process=regulation of transcription, DNA-dependent
  Homolog annotation: Hit_ID=A9PI05; Match level="QueryCoverage=47%, HitCoverage=17%, E-value=2e-24, Identity=86%"; Hit description =Putative uncharacterized protein
  Pfam annotation: Domain name=DUF822; Domain location=16-124; Score =16.7; E_value=8.4e-06; Accession=PF05687.4; Description=Plant protein of unknown function (DUF822)
DAGSRQARQGASAGVGGCRGWLNYAASEQIVLRVHHMRAIGAGLFAITPAGERGMCCKAIKLGNARGNYKLPKHCDNNEVLKALCAEAGWIVEEDGTTYRKGCKRPTSEIGGTPLNLSACSSIR

SEQ ID NO: 128272 - protein, 147 aa, Glycine max
  Coding DNA Sequence Number=SeqID_36587
MVAITPTRFPQPPFFRGYDSNAMCAYHGGTPRHSIEHCMTLKRKVQSLIDAGWLKFKEYRDFQVYAIIVKVTMLNKMDKFDIFVPHPLTSASLLIQLSPECGCKPLVYLFKRPALPSLDFQNCSIRNYSCYTFGEGAVKRQLLVIDY

SEQ ID NO: 128273 - protein, 75 aa, Glycine max
  Coding DNA Sequence Number=SeqID_36588
  Subcellular localization annotation: CTP_CleavageSite=45; ConfidenceScore=5.02e-01
MYVRKEMKWPQGSLPQRDPGKTKPPKEPVPLPNMTAIVLGALSTSSASRPSKDGHSSERDASSLGTMSILTSMKR

SEQ ID NO: 128274 - protein, 138 aa, Glycine max
  Coding DNA Sequence Number=SeqID_36589
MSHHSSSVNGEDTSHKDPLSRILDELSSLKLWKLQLERKEKGKERVKLNQDEREQIREEERRKILRVKKKKHPSYSSHNSCKSLSEELRDYYEGRHMSHLRPHSYRREKERNPQEANINLLYFHGKDNVEANLDWEIR

SEQ ID NO: 128275 - protein, 185 aa, Glycine max
  Coding DNA Sequence Number=SeqID_36590
  Homolog annotation: Hit_ID=A6T6J7; Match level="QueryCoverage=100%, HitCoverage=45%, E-value=1e-87, Identity=82%"; Hit description =Putative uncharacterized protein
  Pfam annotation: Domain name=BLUF; Domain location=1-72; Score=113.0; E_value=9e-31; Accession=PF04940.3; Description=Sensors of blue-light using FAD
MVAAANERNGQADVTGILLFNGTHFFQLIEGPEENVQQIYRHICADPRHYNLVELLCDYAPARRFGKVGMELFDLREHDRDAVLQNVLDKGTTKYQLTYDDRALHFFRTFVEATEKENYYEIPSADSWDFTADESSFYPAVPCIDGAESCCFAFQPVVDPFACEIISWEALLRTVDGEPPAAYFA

SEQ ID NO: 128276 - protein, 91 aa, Glycine max
  Coding DNA Sequence Number=SeqID_36591
MSRNFTDCLTMGVKYLDTAKRRLHPTKQMVLLTHILCEKYQEHLFWPDLRDSKEFENLCLSKLLLNLGLSKEIPILSPDAKDSGISSREGE

SEQ ID NO: 128277 - protein, 419 aa, Glycine max
  Coding DNA Sequence Number=SeqID_36592
  Homolog annotation: Hit_ID=Q84VI1; Match level="QueryCoverage=100%, HitCoverage=61%, E-value=1e-173, Identity=75%"; Hit description =Envelope-like protein
MATSPKETSASGSPAVPSSPHQEQPEFNIQPIQVIPGQASVPEKLVPRRQQGVKIAENPSLATSPREVDTEMDKKIRSMVSSILKEASVPEADEDVPTSSTPNVSMPDVEKDVPTSSGPNDEVLSSPSKERSTEEDDQAAEETPAPRAPEPAPGDLIDLEEVESDEEPIANRLAPGIAERLQSRKGKTPIKRSGRIKTMAQKKSTPITPTSSRRSKVTIPSKKRKEISSSDSDDDVELDVSTSKRAKKSGKKVPDNVPDAPLDNISFHSIGNAERWKFVYQRRLALERELGRAALDCKETMELIKAAGLLKTVTKLGDCYESLVREFIVNIPSDITNRKSDEYQKVFVRGKCIRFSPAVINKYLGRPTEGMMDIAVSEHQIAKEITAKQVQHWPKKGKLSAGKLSVKYAILHRIGAANW

SEQ ID NO: 128278 - protein, 152 aa, Glycine max
  Coding DNA Sequence Number=SeqID_36593
  Subcellular localization annotation: CTP_CleavageSite=72; ConfidenceScore=5.23e-01
MGAYFLTRLFTPYFIFTSTRGRARSSLLLTTINVLTPHDHGFLFGALRGNVTSPKTFEAFSIASPFLGTSLRAFGACPQAPFHRGRNVPLPKGTFKIITILYWRIPMNPSFPNKGSPPIEGIPLKAKGSQWNFSLFANMMASKELFNLHFPI

SEQ ID NO: 128279 - protein, 247 aa, Glycine max
  Coding DNA Sequence Number=SeqID_36594
MVWYRRKTKMFIDPNNANTTTLGEVTETLQYMVSPQGRNTWTIDDLVPYVEKLAILSQEQERITKPVAHGPASERRFPPQQFHMLQSSVETRGFDRRREIVQAEDFSQHMEQRGHGMYYTPPTFAQYPSQMYQYPFEGHDTDMSASEHSFGGVAETQPHFSWPTMTPSQQHDAPMATPNVPLGQQWDVPGAIPAMGDLLGVDLRHEFSAEAEEQGRRQRARRNPDRQARRWDRPCGTSSRHHGHHND

SEQ ID NO: 128280 - protein, 58 aa, Glycine max
  Coding DNA Sequence Number=SeqID_36595
MWYHGDQSGSQCFARMLQSYGINIGLKEHSNHVTPKTYTPKSPSGSLPLDSGSTQKTF

SEQ ID NO: 128281 - protein, 141 aa, Glycine max
  Coding DNA Sequence Number=SeqID_36596
MSLSSNVIYIYVRVVMLVRMIRTRLFAAAQVKSCPGMHSSCVIASLSGCARTVGPPPILGGGPGTVWMSTTLKMRTRSPLMVRACNPLKARRCSPLEVRACSPLLERTCSPFKVRACNPLMVRTCSPLKARTCSPLNGEGN

SEQ ID NO: 128282 - protein, 75 aa, Glycine max
  Coding DNA Sequence Number=SeqID_36597
  Subcellular localization annotation: CTP_CleavageSite=52; ConfidenceScore=5.70e-01
MGVQIATRPTWAFQNIPPKGENPSRGASVTFPWVISRRFSIVLRRSSTFFVRSSSFFGLQPPFGHAVTTLETKKR

SEQ ID NO: 128283 - protein, 273 aa, Glycine max
  Coding DNA Sequence Number=SeqID_36598
  Homolog annotation: Hit_ID=Q9SVH3; Match level="QueryCoverage=95%, HitCoverage=37%, E-value=2e-87, Identity=60%"; Hit description =Putative uncharacterized protein F21C20.90
  Pfam annotation: Domain name=PPR; Domain location=158-192; Score=6.8; E_value=1.2; Accession=PF01535.11; Description=PPR repeat
  Pfam annotation: Domain name=PPR; Domain location=229-263; Score =24.3; E_value=0.00045; Accession=PF01535.11; Description=PPR repeat
  Pfam module annotation: Pfam domain module=PPR::PPR; Domain location =158-192::229-263
  Subcellular localization annotation: CTP_CleavageSite=37; ConfidenceScore=5.57e-01
PTKPRNCGPPFTIPKPTNKFYFFYGHRNPSQNRPTVRGGLFSNRQTLNPNPSQPKPTTKPFNIKNWDPHFLSNPNSNPSPSTLSSASLRLSPIARFIVDAFRRNDNKWCPNVAAELSKLRRITPNLVAEVLKVQTNHTLASKFFHWAGSQRGYHHNFASYNALAYCLNRHHQFRVADQLPELMESQGKPPSEKQFEILIRMHSDANRGLRVYHVYEKMRNKFGVKPRVFLYNRVMDALVRTGHLDLALSVYDDLKEDGLVEESVTFMVLVKGL

SEQ ID NO: 128284 - protein, 44 aa, Glycine max
  Coding DNA Sequence Number=SeqID_36599
SRQVDYGNKPRYIGTDASGDGVTTDRSLPLPGAKQAENVAARQP

SEQ ID NO: 128285 - protein, 160 aa, Glycine max
  Coding DNA Sequence Number=SeqID_36600
MGGLCSKSVKGDKVFAKSDGHSNNHKSNGKKHNSTNMPSDLTSARDHGLDKKKQEVVAAAGNGSDDFYDGLGCCHVQVSSEIDIAFVRDKTVLAPEPLADYPTPYEIPPVDSAKQPSLDNSPSDGSAEYIELYSTLLEYFDLTRYGAVADGRTNSSSISS

SEQ ID NO: 128286 - protein, 299 aa, Glycine max
  Coding DNA Sequence Number=SeqID_36601
  Gene Ontology: Mol. function=biotin-[acetyl-CoA-carboxylase] ligase activity; Cellular component=intracellular; Biological process =regulation of transcription, DNA-dependent
  Homolog annotation: Hit_ID=A7MQP4; Match level="QueryCoverage=99%, HitCoverage=99%, E-value=1e-127, Identity=72%"; Hit description =Putative uncharacterized protein
  Pfam annotation: Domain name=BPL_C; Domain location=250-296; Score =46.3; E_value=1.1e-10; Accession=PF02237.8; Description=Biotin protein ligase C terminal domain
  Pfam annotation: Domain name=BPL_LipA_LipB; Domain location=83-179; Score=66.2; E_value=1.1e-16; Accession=PF03099.10; Description =Biotinlipoate AB protein ligase family
  Pfam annotation: Domain name=GntR; Domain location=2-60; Score=0.9; E_ value=0.052; Accession=PF00392.12; Description=Bacterial regulatory proteins, gntR fam
  Pfam annotation: Domain name=HTH_11; Domain location=6-59; Score =50.5; E_value=6.1e-12; Accession=PF08279.3; Description=HTH domain
  Pfam module annotation: Pfam domain module=BPL_C::BPL_LipA _LipB::GntR::HTH_11; Domain location=250-296::83-179::2-60::6-59
MKDHSVPLKLVALLADGEFHSGEQLGEALGMSRAAVNKHIQTLKSWGLDVYTVTGKGYSLPAPIQLLNEEAILAHLHQPDLAVIPVIDSTNQYLLDRMDQLNSGYACIAEYQQAGRGRRGRKWFSPFGANLYMSMYWRLEQGPAAAMGLSLVIGIVMAEDRKLAGILVELTGKTGDAAQIVMGAGINLVMRGEGTAEINQGWINLQEAGIEINRNELAARLINRLREALPLFERDGLAPFVGRWEALDNFIHRPVKLLIGDREVHGIARGIDKQGGLLLEQDGEIKSWVGGEISLRPAN

SEQ ID NO: 128287 - protein, 165 aa, Glycine max
  Coding DNA Sequence Number=SeqID_36602
MGQLQWQAFCKAYGKIWDLAMVEVSTEAIASLAQYYDHPLRKPYLFSGFYPSLARISKIVQISTQELDHRKQVENGWAPFIDILALLIFGGVLFPNVDGLVDLAAIDAFLAYHNHKESPVVAMLADLYDTFDRRCEKNNTRIKGWANWDQLLSSKEGASVNWGIL

SEQ ID NO: 128288 - protein, 54 aa, Glycine max
  Coding DNA Sequence Number=SeqID_36603
PLIELVRDYVLSWEDGQERGVEETIPEFQEPMDLRSNPFQEGGNDAILPPKGIG

SEQ ID NO: 128289 - protein, 114 aa, Glycine max
  Coding DNA Sequence Number=SeqID_36604
MDEDEWMYEIMSEQEDNDYENEEACGANEPHVDCSDAFNTSQVFECREDVLWWARSVVHENGFVAVILMSYTNTRVASIGVGKKNLSEETLGLGNVGVPSSFVASQWLEEKVEW

SEQ ID NO: 128290 - protein, 50 aa, Glycine max
  Coding DNA Sequence Number=SeqID_36605
ELSPYNQYEEERTPNLESVFEEFMAYHVSYPNFVRGPLLDDMRPFFGPCE

SEQ ID NO: 128291 - protein, 169 aa, Glycine max
  Coding DNA Sequence Number=SeqID_36606
DAGSRQARQGASAGVGGCRGWLNYAASEQIVLRVHHMRAIGAGLFAITPAGERGMCCKAIKLGNARVFPVTTLSTLEDPRYLWNWKEYLDKAVHIILTTDNDPLGQALAEELARRLGRGRETCRASCINESANARGEAVCVLGALPLPRSLTRCARSFGCGERYQLTQR

SEQ ID NO: 128292 - protein, 94 aa, Glycine max
  Coding DNA Sequence Number=SeqID_36607
MALGSKRVFHPLMMKATYQLKIIPLFFESFWKSSMLVLISGIVIIKKGEIVEQRIKLNVLMMPKDYMNHMLLKDLLKTKQLEIFKMDDQDSLES

SEQ ID NO: 128293 - protein, 301 aa, Glycine max
  Coding DNA Sequence Number=SeqID_36608
  Gene Ontology: Mol. function=transferase activity; Cellular component= ribosome
  Homolog annotation: Hit_ID=Q01ZM1; Match level="QueryCoverage=100%, HitCoverage=94%, E-value=2e-85, Identity=51%"; Hit description =Glutathione synthase/Ribosomal protein S6 modification enzyme (Glutaminyl transferase)-like protein
MEDTFPWAFIDKVNELGNGEIIAEPVHIDKLEQGADYGYAVIIDRISHDVPFYRAYLKNAALNGTYIINNPFWWSADEKFFNNALMTKLGIPLPKTVLLPSHERPTNTTETSFRNLKFPHDWEYIFDYVGFPAYMKPHDGGGWRNVYRIENPEDLWNKLGETEQLVMMVQEEIIFDDYYRVYCLGRKYVHIMPYEPRNEPHLRYATNHQTDGEELEKLLKTIHDYTITMNEALGYDFNTVEFAVRDGIPYAIDFCNPAPDADRNSVGEENFAWIVEHAALFAIEKAKEYVPGKPNISWGNF

SEQ ID NO: 128294 - protein, 90 aa, Glycine max
  Coding DNA Sequence Number=SeqID_36609
MVGLKDNGEKKNKDGVEKEKEKNDGLVTSETVEEKVVSEEEKQKSNKQATNKGKVVVNRPPIEYFPYLHAPSKKDKERQYKRFLEIFKRL

SEQ ID NO: 128295 - protein, 82 aa, Glycine max
  Coding DNA Sequence Number=SeqID_36610
MIKKREVRSSNYSHGEDDEYEEDEGGWRNERYRERRSHRRYGGRQREEGIEGVKVKIPTFKGTRDPKVYLEWEMKVEQVFAC

SEQ ID NO: 128296 - protein, 123 aa, Glycine max
  Coding DNA Sequence Number=SeqID_36611
  Homolog annotation: Hit_ID=A6FJQ2; Match level="QueryCoverage=30%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLWGLSRPSRYVPEILAAFFWTVPALFNHVRVPLGTELEFVIMVIAVSCVKLLSAHNSTQHTSRKHKV

SEQ ID NO: 128297 - protein, 159 aa, Glycine max
  Coding DNA Sequence Number=SeqID_36612
MDSSKRKTQMSCYRLWPVHDRSRFVSQEAWDCYSQIIRELIRRNWHKQLTNLTGGSIDVTIVKEFYANLYVPDDKFPKQVRVRGNLIKFDVDSLNTFLETPVVVEQGESLPFYSRFAKLRPDPQELAARLCIPGRGFVLNVEGLPWKLLRKYLTTLAQT

SEQ ID NO: 128298 - protein, 157 aa, Glycine max
  Coding DNA Sequence Number=SeqID_36613
  Homolog annotation: Hit_ID=Q6WAY4; Match level="QueryCoverage=54%, HitCoverage=15%, E-value=1e-07, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEPTYMTPSTDDVKKAMQGLFVVLQLSMWGWFHTFFSKKVGPSIRYKVTARASKKERRIGTNSWLAWGGVC

SEQ ID NO: 128299 - protein, 146 aa, Glycine max
  Coding DNA Sequence Number=SeqID_36614
MPISPADVSVGLCRHDIGIAPTRHPVDPKKSNRALGFPALVTGLCQSYRVPVPPARSCHRDIGIAPTKTPSGPGEVQQGPGGLCPQDTQWTQISPTGSWSCQALITGLCQFYGVPVTSSKGIKPPTNRAFIKKYCIPRQAQGETPQ

SEQ ID NO: 128300 - protein, 25 aa, Glycine max
  Coding DNA Sequence Number=SeqID_36615
MVARPGELMLTPEVTCSPKRAAARP

SEQ ID NO: 128301 - protein, 72 aa, Glycine max
  Coding DNA Sequence Number=SeqID_36616
MENCMPARSIYEAPTCKLVGGGHMNENAIHGGSEKRSHERKRNSWGSEKGLRMENCTKQSLRMAPNSKVEDT

SEQ ID NO: 128302 - protein, 268 aa, Glycine max
  Coding DNA Sequence Number=SeqID_36617
MSSFLVRDFGAQNSKTIQRIHKAGETPLKKDQELRGIRNGIIGGYQEWLKVHIRGLDWLAKLKVVSKESFEAPEEDEEECAGLREENAITARALEQETKRARKEEYGRNKFRGALWGSNSELKLRREERDQSRAHSMVLKEELIACSRSKRSLSQHLCETETNMLAIIAKYQEELGLAMAHEHRIADEYAQVYAEKEARGRVIDSLHQEATMWMDRFALTLNGSQELPRLLAKAKAMADTYSTPEEIHGLLGYCQHMIDLMAHIIRNH

SEQ ID NO: 128303 - protein, 123 aa, Glycine max
  Coding DNA Sequence Number=SeqID_36618
MSLPVEDYTSSPSDDYTSSPSKGCTTSPSEGYIPAPLEDYTSSPSEDYTSSPSEGCMPSPSEYSMSSPSKDYTSSPSEDYTSSPSEGYSPSPSEDYTSSYSEGYKPSPLEDYSSCYQVSFCRV

SEQ ID NO: 128304 - protein, 142 aa, Glycine max
  Coding DNA Sequence Number=SeqID_36619
MRAENFDIYGFLEPQSIQRSGQSQFETESYIKSWMQSSKCDVYLGAYLNGGHWQMVVIMPKEHLVVWFCSLHNRSDNYLKGIINSALKGLDDAPQPKSKAPARWIVVKEVSGITGKRPLEPERLKALRIQWAQYYLRVRAKS

SEQ ID NO: 128305 - protein, 187 aa, Glycine max
  Coding DNA Sequence Number=SeqID_36620
  Homolog annotation: Hit_ID=UPI00016621D1; Match level="QueryCoverage =96%, HitCoverage=37%, E-value=6e-08, Identity=28%"; Hit description =UPI00016621D1 related cluster
ATTRLAFRGLHVLPSRGLQVLTFRGLHVLAFRGLHALTFRGLHVLAFRGLYVLTFKGLHVLTFRGLQRATRPRLQRSTRPSPLGDYTSSPSGTTHPRLQRATHPHLQRANVSRLQRATRPRIHSLPSGLHVLTFRRLHDLAFRGLHVLAFRGLHAVTLRGLHVLTFRGLNVLAFRGLHTHTFRGGIL

SEQ ID NO: 128306 - protein, 62 aa, Glycine max
  Coding DNA Sequence Number=SeqID_36621
  Homolog annotation: Hit_ID=A6FJQ2; Match level="QueryCoverage=61%, HitCoverage=84%, E-value=6e-11, Identity=89%"; Hit description=50S ribosomal protein L5
MRKEKIPHQAPFAIQAAQLLGRAIGSGLFAITPAGERGMCCKAIKLVLPLSVSPISVLGVLL

SEQ ID NO: 128307 - protein, 155 aa, Glycine max
  Coding DNA Sequence Number=SeqID_36622
MAPRKLASKRSRKDRGAEGTSSVPEYDSHRFRSAVHQQRFEAIKGWSSAMGITGYPHGQVLGEGGQWIPFDADAIGQLLGYPLVLEEGQECEYGQRRNRSDGFDEEAIAQLLCIPGQDFAPDCCREASANHAHQHDHPDSDMDDFAAQQHPAHRS

SEQ ID NO: 128308 - protein, 288 aa, Glycine max
  Coding DNA Sequence Number=SeqID_36623
  Homolog annotation: Hit_ID=Q6WAY6; Match level="QueryCoverage=38%, HitCoverage=21%, E-value=2e-11, Identity=34%"; Hit description =Putative uncharacterized protein
KGGANWDQLLASKEGASISWFPRWKKGRTGVLILCGGFPNVPLMGTRGCISYNLVLATRQLGYPMRGAPLEDELTPIISRGFNKTNMETLQKDKELRGNNNGPIGGYHEWLKAHVQGFDWLPSLRTAKREEDEAPEEDEEENAKLRDINIATTKALEQETKRARREEHGRNKFRGALWGSNNELKTPKGGKGPIAETNMLAIINKYQEELSLATAHEHRVADEYAQVYAEKETRGRVIDSLHQEATMWMDRFALTLNGSQELPRLLAKAKAMADTYSAPEEIHGLLSY

SEQ ID NO: 128309 - protein, 90 aa, Glycine max
  Coding DNA Sequence Number=SeqID_36624
MKNVEERSKTFAKFLYGKRYGNVSEAPRLRFSSRKQFFQANSKEREQIGRCLPPSSPRRAGLLPPEATTFWRNILEGPSGSGCYLHPHFY

SEQ ID NO: 128310 - protein, 145 aa, Glycine max
  Coding DNA Sequence Number=SeqID_36625
  Subcellular localization annotation: CTP_CleavageSite=48; ConfidenceScore=5.27e-01
MPISPCKSISWSVSSRHGDRTQETPSGPGKVQQGPGVSSSGYRPLSVLQGARTPPTRSHHHRDRAQDTQWTRRSPIGVLELPSSNYGSLSVLRSTCHPQARASGPLINRAFHQRSTASPGRRRAKHPQQPGDGRQRGNKRTAITL

SEQ ID NO: 128311 - protein, 96 aa, Glycine max
  Coding DNA Sequence Number=SeqID_36626
  Subcellular localization annotation: CTP_CleavageSite=70; ConfidenceScore=5.89e-01
MDTFFLPKSPPFSANLLAGTSSSRVGLASLVSSATTFTFPLASVGHTAGSGAAKMQPLRVTPLRPVMLVTLAEGVPFVSIKGNNDRLLQCFKDKPS

SEQ ID NO: 128312 - protein, 113 aa, Glycine max
  Coding DNA Sequence Number=SeqID_36627
  Subcellular localization annotation: CTP_CleavageSite=34; ConfidenceScore=5.01e-01
MASFSHMQSQLQSQMQSQGLALPLEPKVGPLAARVSTKGSYVDPSPTDPKTGDSDKCRRHIEENSSRLVALGRVYEGSTVVHNIPLLHGQVKVGVKEVKDAEAPVPVPTTRFN

SEQ ID NO: 128313 - protein, 98 aa, Glycine max
  Coding DNA Sequence Number=SeqID_36628
  Homolog annotation: Hit_ID=A5AIY4; Match level="QueryCoverage=53%, HitCoverage=25%, E-value=6e-19, Identity=86%"; Hit description =Putative uncharacterized protein
MVDSDSNSDEATSSSILAELTTKMTGTDWHQVRWQQLSPLVPGGRDTDNAIVKGWIINSMDSSLISNFIRFSTAKLVWDAIATTYFDGSDTSQVYDLR

SEQ ID NO: 128314 - protein, 118 aa, Glycine max
  Coding DNA Sequence Number=SeqID_36629
  Homolog annotation: Hit_ID=A5BWZ5; Match level="QueryCoverage=33%, HitCoverage=3%, E-value=7e-09, Identity=69%"; Hit description =Putative uncharacterized protein
IFRKNDRSPPAQAVAAQERKLLYNHGGCTSSVPSPGLKSYFVSFWDLSVLVDLFCSELISVKHNLHVLKCDVVTSCTTSVPSIRISDQLADILTKAVCSRDFYNALDKLGIRDIYAPT

SEQ ID NO: 128315 - protein, 202 aa, Glycine max
  Coding DNA Sequence Number=SeqID_36630
  Subcellular localization annotation: CTP_CleavageSite=48; ConfidenceScore=5.54e-01
MKMIQGLQAPHGATSPSTLKWTRKATRLRSLATRPVGAERPVVLVNPVAMKADSPHKKKLRTYLGIVARDKVDVTYENWKQVLAAYKDLIWGDIQTTEERWRQFKFDLTSKWALAADKDSVDDTVCEKYNISKEKWTQFCQSRRDHSWEAIQKQNIAPHLLSRGGYEFLENKLMEEKKKKQLEEAAKSGSTDIVIDPSSPIR

SEQ ID NO: 128316 - protein, 63 aa, Glycine max
  Coding DNA Sequence Number=SeqID_36631
MELKRKIKEKRIFQGYAKGIPRICQRHFNIFPLDVTRMTLAHGKGICHKNIPKEYSKNMPKES

SEQ ID NO: 128317 - protein, 16 aa, Glycine max
  Coding DNA Sequence Number=SeqID_36632
MARSCPNAVVVEIQKP

SEQ ID NO: 128318 - protein, 145 aa, Glycine max
  Coding DNA Sequence Number=SeqID_36633
MQSQGLALPLEPEVGPSTTRVSTKGSCVDPSPTDLEMSDLDKCKLYIKENPFCLVALGRVYEGSTVVHNIPLLHGQVRVGVEEVKDTEAPILVPTDEAAVSPAKPPDRPHPEVDDPLYLITLTIPQLFLRPLQVMWDAIVFGVFN

SEQ ID NO: 128319 - protein, 96 aa, Glycine max
  Coding DNA Sequence Number=SeqID_36634
MVSKERRWCAEQLNKSVKAFDSATESVVTWRIGCTSQNGVVGKVVARERVKCCSAGSGYEGEKEVVRWWCNGGSGAYKIEGILILILREYSGVMTK

SEQ ID NO: 128320 - protein, 60 aa, Glycine max
  Coding DNA Sequence Number=SeqID_36635
MGAKHLTRTKERSHVIKQREKKESHEDNTSGGFNLFSVSLTFENSIGAVGGITEGISGNR

SEQ ID NO: 128321 - protein, 134 aa, Glycine max
  Coding DNA Sequence Number=SeqID_36636
MVTGQSAEMPPIQISPEDLTGSEWWLPFPQSASNIYKELSKIGFSFWLILLKKLYIFILETIYERIDQQIYHEKYYIKIHKKKMEQGLPNAVCMEVNESLSSSTNPLSNNSILQQELTGGGNVEPINKKDSRTL

SEQ ID NO: 128322 - protein, 128 aa, Glycine max
  Coding DNA Sequence Number=SeqID_36637
MGKHLIAIKCFKILVHGIPMIIDESLFFSLTQLPSQGAPFEGTLVDDWKFDYSSHDARRMVYIDQANMTGRLLVGSLTFDCRIMHYIIVRILMPRSSNLAQASGLLTLMDLAQEFTGVSQHTQLNATR

SEQ ID NO: 128323 - protein, 477 aa, Glycine max
  Coding DNA Sequence Number=SeqID_36638
  Subcellular localization annotation: CTP_CleavageSite=64; ConfidenceScore=5.20e-01
MVQAFELLCSFFIVRPSVSVFLFFFQIKFSGKIRWVSLNSVSKKLFKFDSNVFFHFKDHFFKVLATDFVADGMPLMFNRDGEPRFPFYWQSDHTRGLTKQFLSNCNLTGSACHLVSSFGERSSRCPGWPLLKQVRPVGGVVPPPVVVPSTGERNQHVGEVGPVTVAAEVAPSTPSSILVKRKRDDAAGPLGHKKLKAPISLYALRQAVGLGPTICRLTTVQDVSPAPLVVEVLVAAATPALLEATKADSIVVSSSTVTALLPSVSVASTGAPTMLPPSLSTSVVLPVIVLAAMVSPSLSFRLRVSLDHLYTSSDANSLCGATYKPEQKTPIGFVSAFDRNLIRLAGVQNATTSSKVFLQRSLTILEKNGLQHQEAMQKTLWRVKRPKVANAIVAFVEAVRANRQFFAKVGAALAKLLGTQLDGDDLFRRCKSLQAKKMDLGGKVESMADEKDGLAKRIVELEARLRESESRLEESEL

SEQ ID NO: 128324 - protein, 76 aa, Glycine max
  Coding DNA Sequence Number=SeqID_36639
  Homolog annotation: Hit_ID=A6FJQ2; Match level="QueryCoverage=50%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARLSGHVGSMVACGEGCDPVRAGVGQVG

SEQ ID NO: 128325 - protein, 177 aa, Glycine max
  Coding DNA Sequence Number=SeqID_36640
MQTLRKRGRKTTSKVLFQVPFSFQPPEFCLKENINLEIYYIHSASQKTLRSHHEVIEFLLDVEIPRKGGSKKAKVVGAVDNQVSGSASHESSRRKEMSFTSQIVNKMKSSDEKGTNELDNKVMSDELKNKMKDLEKEIMPWDDDEMGLYKMVDINEIENELMIQELLNQPGELLFNL

SEQ ID NO: 128326 - protein, 386 aa, Glycine max
  Coding DNA Sequence Number=SeqID_36641
  Gene Ontology: Mol. function=protein kinase activity; Biological process=protein amino acid phosphorylation
  Homolog annotation: Hit_ID=Q2HS67; Match level="QueryCoverage=98%, HitCoverage=97%, E-value=8e-52, Identity=36%"; Hit description =Cyclin-like F-box; F-box protein interaction domain
  Pfam annotation: Domain name=F-box; Domain location=2-49; Score=43.1; E_value=9.8e-10; Accession=PF00646.24; Description=F-box domain
  Pfam annotation: Domain name=FBA_1; Domain location=215-379; Score= -51.3; E_value=0.087; Accession=PF07734.4; Description=F-box associated
  Pfam module annotation: Pfam domain module=F-box::FBA_1; Domain location=2-49::215-379
MPHASLLPEELIVEILSWVPVKALMQFRCISKTWNSLILHPTFVKLHLHRSSKNTHILVMYKDINAEDDKLVTCVAPCSIRHLLENPSSTVDDGCHRFNANYLVSGVCNGLVCLRDSFAGDEFQEYWFRFLNPATRVVSIDSVPLRLHSSNYKTKWYPVKCALGYDDLSETYKVVVVLSDIKLQKMEVRVHCLGDTCWRKILTCLDFHFLQQCDGQFVNGTVNWLALRKLSSDYIWRYELVIFSYDMKNETYRYLLKPDGLSEVSFPEPRLGVLKGYLCLSCDHGRTHFVVWLMREFGGEKSWTQLLNVSYEHLQLDQFPFPSISMIPLCMSEDEDVMLLASYGRKEFVLVNKRDNRMDDIGGFDGKYYWSYSYDYVPSLVLPYRN

SEQ ID NO: 128327 - protein, 383 aa, Glycine max
  Coding DNA Sequence Number=SeqID_36642
  Homolog annotation: Hit_ID=A7PLV1; Match level="QueryCoverage=98%, HitCoverage=53%, E-value=1e-173, Identity=79%"; Hit description =Chromosome chr14 scaffold_21, whole genome shotgun sequence
MTMDREKEREIELESAMYTNCLLLGLDPAIIGVGASNATPRVGHFRHSNPKLGEQLLYFILSSLRGPIQSAKDFDKVWPIFDSAQSRDFRKVVQGIISELESQGALPRSNSRVSSLATCCGPRFVELLWQLSLHALREVHRRTFTADISSNPLPAPLTDVAFSHAATLLPVTKARIALERRKFLKNAEMAVQRQAMWSNLAHEMTAEFRGLCAEEAYLQQELEKLHDLRNKVKLEGELWDDLVSSSSQNSHLVSKATRLWESLLARKSQHEVLASGPIEDLIAHREHRYRISGSSLLAAMDQSSQAPYSDVLSAQSGDLPAMDNKEENDGSHFSNETLTRLDDRTGRAHQTVDVAEVIRRWTHALQRIHKQSLHLVCSLQAFL

SEQ ID NO: 128328 - protein, 92 aa, Glycine max
  Coding DNA Sequence Number=SeqID_36643
MDYKAKIHNMRATRATNNRTINKVMDSLYSFSVHVTTRVVESYHCPSQEEYPTYVAWPAGSGTMSMLARLEEKKLWRRTSCMMAMEMRAIEP

SEQ ID NO: 128329 - protein, 109 aa, Glycine max
  Coding DNA Sequence Number=SeqID_36644
MRHLKVPKQSTSALMAITRPYIHLNPYEGWGKRSHIKGLVSCPCGGLGDRQPLYNDSVGEWNLPPYKAHNALPHHPYKPCKEQLQPTSVIQGISCIAQSSTSCLIEGSR

SEQ ID NO: 128330 - protein, 57 aa, Glycine max
  Coding DNA Sequence Number=SeqID_36645
MENIPDSGVIFTFEEGLLLLRTLHRRRNQTYVALSKGANQVILFYLECGHLRPWTLK

SEQ ID NO: 128331 - protein, 51 aa, Glycine max
  Coding DNA Sequence Number=SeqID_36646
MDSYGEAKDSIAEEDPRPTSSIWSYIMRYQEHLLLGDVLLLPLPFCSVNSL

SEQ ID NO: 128332 - protein, 103 aa, Glycine max
  Coding DNA Sequence Number=SeqID_36647
MLQPYGISIGLKEHSNPVTPKAYTPKSPSGLLPPDSALDFYGKEKCYNARGISLSSDVISEFPTVRILGNGFDGLREKERILVEEERKNEIGRQRRLRSQSEN

SEQ ID NO: 128333 - protein, 160 aa, Glycine max
  Coding DNA Sequence Number=SeqID_36648
MCAFHEGLQIDWAHLVRYHMHKALRLNAPLPYPHLVTFFLQHFNIPLDSEPYVPIKRSFLIGASVIASFGYIKEHDGSWIKKGARNVGEEGHEGEDSSLLSKILEKFDGLQTFVGERFDTLELQVDMRFNEMESRMTKVEEDVSYIRSSFDLPPPPPPSS

SEQ ID NO: 128334 - protein, 256 aa, Glycine max
  Coding DNA Sequence Number=SeqID_36649
  Homolog annotation: Hit_ID=A5CAG1; Match level="QueryCoverage=33%, HitCoverage=5%, E-value=7e-13, Identity=44%"; Hit description =Putative uncharacterized protein
MPKTPKTLRGFLELTAKLLGYEFDIVYKVGASNKVVDALSRRDEDKELQGISRPFWKDITKINEEVQKDPALAKIREELKDNLDSHPQYTLECDILYFRGSYQNVAHCTPFEVVYGKPPPSLAKFVLRKTLVEVVVQDLMDRDEPLKQLKFHIRPHRQTFMPTKLHPKLSARYYGPYLVLQQKSLKFWCIGKANFRKKLPRMFLSSEISFPISTLRTRLFRNEEILLELSPSNNLKQERVCRKRKGSKSCNNHLEG

SEQ ID NO: 128335 - protein, 123 aa, Glycine max
  Coding DNA Sequence Number=SeqID_36650
  Subcellular localization annotation: CTP_CleavageSite=34; ConfidenceScore=5.03e-01
MRFFMAIRLFICSPDTKFKIITGSKHKQQTGTSVCNSYAQTQAYMQCGTMSVKNLVGHLGVHDKTNHTIGDQSGSQCFARMFQPYGINIGLKEHSNRVTPKAYTPKSPSGALPPDSGPTQKIF

SEQ ID NO: 128336 - protein, 686 aa, Glycine max
  Coding DNA Sequence Number=SeqID_36651
  Gene Ontology: Mol. function=protein homodimerization activity; Cellular component=perinuclear region of cytoplasm; Biological process=spinal cord motor neuron cell fate specification
  Homolog annotation: Hit_ID=A7PLU3; Match level="QueryCoverage=76%, HitCoverage=99%, E-value=0.0, Identity=69%"; Hit description =Chromosome chr14 scaffold_21, whole genome shotgun sequence
  Pfam annotation: Domain name=Ank; Domain location=18-48; Score=3.0; E_ value=12; Accession=PF00023.21; Description=Ankyrin repeat
  Pfam annotation: Domain name=Ank; Domain location=187-219; Score=8.8; E_value=1.8; Accession=PF00023.21; Description=Ankyrin repeat
  Pfam annotation: Domain name=Ank; Domain location=221-253; Score =20.3; E_value=0.0072; Accession=PF00023.21; Description=Ankyrin repeat
  Pfam annotation: Domain name=Ank; Domain location=254-287; Score =21.9; E_value=0.0023; Accession=PF00023.21; Description=Ankyrin repeat
  Pfam annotation: Domain name=Ank; Domain location=288-329; Score=1.5; E_value=20; Accession=PF00023.21; Description=Ankyrin repeat
  Pfam annotation: Domain name=Ank; Domain location=336-370; Score =18.8; E_value=0.021; Accession=PF00023.21; Description=Ankyrin repeat
  Pfam module annotation: Pfam domain module=Ank::Ank::Ank::Ank::Ank::An k; Domain location=18-48::187-219::221-253::254-287::288-329::336-370
MPPTYFPLRWESTGDQWWYASPIDWAAANGHYDLVRELLRMDSNHLFKLTSLRRIRRLEVVWDDEEQFNDIAKFRSEVAQKLLLESESKRGKNSLIRAGYGGWLMYTAASAGDLGFVQVLLERNPLLVFGEGEYGVTDILYAAARSKNCEVFRLLFDFAVSPRFLSGKGGIMEENVGDIPSVYRWELTNRAVHAAARGGNLKILEELLANCSDVLAYRDADGSTVLHAAAGRGQVEVIKYLTSSFDMINSTDHQGNTALHVASSRGQLPTAEALVSAFPSLMSLRNNSGETFLHRAVSGFKSHAFRRLDKQVELLRNMLSGKNFHVADIINVKNNDRRTALHMAIIGNIHTDLVQLLMTAPSINVNICDVDGMTPLDYLRQHPKSASSDILIKKLISAGGMFGCQGHSSRKAIASHLRMQSIGSSPGTSFRVSDTEMFLYTGIENVSDASGDHGSGGMSSSSSEHIPYDLNATENRVPIAAKRPSTVNHAAASLKRVLLWPRVKDKKSEGFKKSSTTDEGSVDSCRKRNNSFDETPTPLRQRFSRPSSLPNNKRTLSVRSQQSSPNAKKRFASGPVHGVIQSMPHANVSGRSRSSSFSKSSISSPRSIDKQKGIFIDNDIAGPSCSSQPSPPPDDDESPKLVKRTSVGRKLRDHYFCFGAPGINVKNSVHRQQESQSYKAHVVAVA

SEQ ID NO: 128337 - protein, 118 aa, Glycine max
  Coding DNA Sequence Number=SeqID_36652
  Subcellular localization annotation: CTP_CleavageSite=26; ConfidenceScore=5.47e-01
MEAQTRTPQTRTRQCGCSHGSAAQFVTNTNSGRRRNNNNALGVPFPGLFPFLLFFDLRNKDDLHKHDLHNVVAVMEAQATLTQRRSQAEGERRRTIGFKRAGCAISEVQYIMITTSVF

SEQ ID NO: 128338 - protein, 68 aa, Glycine max
  Coding DNA Sequence Number=SeqID_36653
MRYFLKRPVSLAGGLREWKIVYKDELGMFYLVGFCEKEKSKARRNKVRTMEDEGGSGGRGDQRFLWGW

SEQ ID NO: 128339 - protein, 164 aa, Glycine max
  Coding DNA Sequence Number=SeqID_36654
MGENSKATIEKSQWKMESVKQWKPWRANPKGREIKSHNGKWKNAKRETMETVETQLEVEKHKQIILNPRGRSLGRKKQVGFNVKKRKKLLKFLLMRKHWFKHIVMFFSIATMLTPFKKSKNKFKIESRTFQGSRGNLISRIKNQDSRFKLPRIKIKIQESRFKN

SEQ ID NO: 128340 - protein, 92 aa, Glycine max
  Coding DNA Sequence Number=SeqID_36655
MEEDDDNLYFGDDDDDSLFFSLIDKPNKNMALLDDYEAKELHFDYDLDHRSNLCFALKGEKKRGGGNWRSVAKEGSEEGNVCIDVKEMEKEG

SEQ ID NO: 128341 - protein, 129 aa, Glycine max
  Coding DNA Sequence Number=SeqID_36656
MLIRLRIKLIRNLPCQHPWWRRRRRRRGTYLNNADARTQQHHCQHPRRRRRTKVTKKTKNTRLEGHEEDERRSRRRRRRRSCSRFFERKKKEERRSRRSRNGEEEAGMARKKQKKQKWRRTQKKQKWRK

SEQ ID NO: 128342 - protein, 81 aa, Glycine max
  Coding DNA Sequence Number=SeqID_36657
  Subcellular localization annotation: CTP_CleavageSite=47; ConfidenceScore=5.02e-01
MGLDFLTRLFTLYFIFTSTRRIGRSSLLLTTINVLTPHSHECGVPVSSSMRFFIVIHLFICSPEHKVQDHHRIQTQTASWE

SEQ ID NO: 128343 - protein, 194 aa, Glycine max
  Coding DNA Sequence Number=SeqID_36658
MTSEAAKEIVDRIDILTVAIGRPEHPGCVRITRASVTIKQYFGAASRSSRTSVSMAPEDLEQLTQKIRDQLEEWITEKGLALPLELEVGPSAARVSTKKSCVDPSRQDLDTGDSEKCGLYVNDNRPCLVALGRVYEGSTTVHNIPLGNYQVKIGVEEDEQGAKGLTKLADRSDPDVNPLYLMTLTILQLFLKPL

SEQ ID NO: 128344 - protein, 235 aa, Glycine max
  Coding DNA Sequence Number=SeqID_36659
MSRNLKGLGGLDNIYYTTLVKKLIWDQGVYHVFNKMDEDSKHTLIVKGSVVAKQQKFSKTNLKAMKDHWIKRRHEFATSTLARPLAVNLVIQRLKNLREIDDADEGLARVALQKREIIAPEAPVAKKAKKSQPVVEPRASVLLLPFHDASRRGNKEDPTSSSTDSESIDDTLISPLYNSIPFIKPCPPPSTLHLGDSLSSLAQHAKAKGQEELPSLHLLGVVQKAKKGPKTLCKK

SEQ ID NO: 128345 - protein, 142 aa, Glycine max
  Coding DNA Sequence Number=SeqID_36660
MADGFNEEAIAQLLCTPGQDFARTAVGRRMRIMRTSMTTLTQMWMTLLLSNVLPSDHNSDLPLPKCQLVYATHQAPSRLDKSNRALGFPALITGLCQSFGVPVTPSKVIRPPITRAFIEKYYTLRQVQGDAPQAADAPPPPH

SEQ ID NO: 128346 - protein, 197 aa, Glycine max
  Coding DNA Sequence Number=SeqID_36661
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8GSP4; Match level="QueryCoverage=52%, HitCoverage=28%, E-value=6e-33, Identity=70%"; Hit description =Putative uncharacterized protein
MHNQTLRGRILETILSARFFLFQYGVVYKLRHTGNNTSLAVELIIVDTSKFDDATTLESKQTNKEDESELYKPKVSTWGVFRRPGNLSKTFSGGRVICPGEVLESKEEKIVKEARTKQLLAAYNKKTGLNVDPKLKFEYEEAEKAPTVYVVGDLLVDVGNNNYLSLSIEKEFLQQQQQQQQRLIPLSGVGYMDQLPP

SEQ ID NO: 128347 - protein, 45 aa, Glycine max
  Coding DNA Sequence Number=SeqID_36662
MVTEFQCRERLQMRVRKLSSESERFQITSIFGKTAGNTSLLILIF

SEQ ID NO: 128348 - protein, 323 aa, Glycine max
  Coding DNA Sequence Number=SeqID_36663
MVIDQSLFYDLTQLPSDNVPFEGALDDDWKFDFSVHDARRLVCTNQADMTGRLLVGSLALESHILHYLIVHILLQRSSNLAQVSEEDLIGMWAFHTGRQIDWAHLVRYRMHKALRLNAHLPYPYLVTLFLQHFNIPLDSEPYVPIKRSFLIGAAVVASFGYRKERDGSWVKKGTQPNDDEGQLPVEGDSSLLQSILDRFDGLQTYVGERFDALEQQVDMRFDAMDSRITKVEDVTIIRDCLDLPPPPPSDCHHQKGGDCGSNVFQGYFDDAKESRVKQIPKIQESSFKNQDSRTMKIKIQDSRFKNQEKMIKISTKKAFQNIE

SEQ ID NO: 128349 - protein, 67 aa, Glycine max
  Coding DNA Sequence Number=SeqID_36664
MARRLQEDWAKDAGEDPRVLMSLKCLQSPFILLHFAAIHLQEAKDSIDEEDPRPTSSTWSHINSLRR

SEQ ID NO: 128350 - protein, 104 aa, Glycine max
  Coding DNA Sequence Number=SeqID_36665
MNQVLSDLEAKINTTVPTSNIALAEEKSLFDWNYVKIYTISGNTRDPTSVFRKKRKEEEVNRLGSSSSMDSFASWKMNGSRMEKEEREETPLQGEDESKRSSPP

SEQ ID NO: 128351 - protein, 92 aa, Glycine max
  Coding DNA Sequence Number=SeqID_36666
MAFSNNKWWRWWLLHVEKNMLKHIHDRVEGNFYLHGGSSVLTSTKMVVMEDIDAILPRKGPVTRTMSKRLQEDWARVAEEGPRVLMNLRVDF

SEQ ID NO: 128352 - protein, 268 aa, Glycine max
  Coding DNA Sequence Number=SeqID_36667
  Homolog annotation: Hit_ID=Q2HS67; Match level="QueryCoverage=50%, HitCoverage=35%, E-value=3e-16, Identity=35%"; Hit description =Cyclin-like F-box; F-box protein interaction domain
  Pfam annotation: Domain name=F-box; Domain location=2-46; Score=18.4; E_value=0.027; Accession=PF00646.24; Description=F-box domain
MPHASLLPEELIVEILSWVPVKALMQFRTLTRRMINSLPVSHPARYVIYSRTHHPRLTMVATDSMPITLSLVFAMGWFACVILLLGMNFRNIGFDFGTQPQGETYKVVVVLSDIKSQRMEQCDGQFVNGTNETYRYLLKPDGLSEVSFPEPRLGVLKGYLCLSCDHGRTHFVVWLMREFGVEKSWTQLLNVSYEHLQLDQFSFPSTLMIPLFMSEDEDVMLLASYGRKEFVLVNKRDNRMDDIGGFDGKYYWPYSYDYVPSLVLPYRN

SEQ ID NO: 128353 - protein, 183 aa, Glycine max
  Coding DNA Sequence Number=SeqID_36668
MTSIEQQLNLVVVAQPINAIKDADILERLWKDFEDQLWKAKTIASERLRLGGDSSVAPTFPMIETNASDNTDETSRKTLRKRGRKTTSKVLFQVPFSFQPPEFCLKENINLEIVLLNRFKNESSWGNHVPKFSVEERLKNWVIEKRERMQSKDKEKPDAKMQDYYYIHSASQKTFREGDYVVG

SEQ ID NO: 128354 - protein, 29 aa, Glycine max
  Coding DNA Sequence Number=SeqID_36669
MEGRLGTEDLMKNKEKVKPRELLWALGPY

SEQ ID NO: 128355 - protein, 183 aa, Glycine max
  Coding DNA Sequence Number=SeqID_36670
MASKSAFSIDSRVLNKYRTRLLGDNVQAFLVVERLREMSLTRKPSCEALDEILRDCEEFNPYNHYEEERAPDLESVFKEFMAYHASSKANQNSMQNHEIHFGKSYSLEDHQREPELQTYHQKEAERGFNMDNLLMQFKDTIESIQRAFKSTEIQVGKLVEEVTQAVGRREEEFVEVEAQEESP

SEQ ID NO: 128356 - protein, 196 aa, Glycine max
  Coding DNA Sequence Number=SeqID_36671
  Subcellular localization annotation: CTP_CleavageSite=49; ConfidenceScore=5.18e-01
MGQNTPKDYDDGWLKFSQSPTSQLGSKLVFDQTRWTRSELVQTRESGPSCASLVEKKIPRNGVVFAVTGLGICFPSCLLMHFFFLPQNLALSHSHPHPIGELEELLRALELEDNLVLLEAATCDSRRRATRRLAVVHDGSRQPDNLVHLEAASPNSHEHKVHDEHNPRKRIEVSHKLNQDLYKLLNPNLDLLLHIF

SEQ ID NO: 128357 - protein, 75 aa, Glycine max
  Coding DNA Sequence Number=SeqID_36672
MAVPKSEKMQRQDETNKKQAYNHVSTKNNNGLRWLMVAVGDGESYWDIRNGFGRKKGEEMAFCLSYTKAKTEMLK

SEQ ID NO: 128358 - protein, 178 aa, Glycine max
  Coding DNA Sequence Number=SeqID_36673
MGIREEEFVEVEAQEGSLVKEHDLEEERHEDHEVPIILGQPCLSIASCVLGMGKGKLELNVEDQKISFDLFEAMKHSDDSEACFEEETLEQEIELTASAMVLQSPLEEEFDNVTKCIVSENEGEELASIEELYDPQSQDLDKTWVVNGQRLKLYHGGEFEKANTILNLISPIEVYASS

SEQ ID NO: 128359 - protein, 140 aa, Glycine max
  Coding DNA Sequence Number=SeqID_36674
SLQVIAPPRSILSVEQFIEKVSWPGTLPFVVREGEGPNPQAGRAQVRQEAATSERSPQISPDPPSPVVDQSFLQQPANLPTPVLDLPTDPSTPLLDLPEDPSTPVLGLTTTPLATPVLHLADEEGTQDQETQQDDQSQEF

SEQ ID NO: 128360 - protein, 391 aa, Glycine max
  Coding DNA Sequence Number=SeqID_36675
MTRRLLAGSLAFESRILHYLIVRILLPRSSNLAQRLNAPLPYPHLVTLFLQHFNIPVDFEPYVPIKRSFLIGAAVIASFGYRKEHDGSWVKKGAQPIDEEGHLPVGEDSTLLQKILDRFDGLQTFVGERFDALELQGSSTWVVVTENKRGYISCGSVQVEGTSTWLFKENKGGYIPCGSLLNLDDPTLDAPASSSAPPALAPPPPTPIPAPFGPSTQSIDLLVSMLQSLHHGLCLPSPVGGGEAPTTQEPQPELEVTPEAEAQETPEDTPSTTPAKDTDYAADMAATQISWDPWPTTATRAGNPSNSAPLQQRTSAQPQRAPAQSSAPMQPRPIGGSNPSTGANSGRNPLVKKLPEFAPISVSYEGLLPSLIANQMAVVTPERIYQSPFPQ

SEQ ID NO: 128361 - protein, 40 aa, Glycine max
  Coding DNA Sequence Number=SeqID_36676
MMIWKQRAKLVVATARWDDVPKGKLYKVPELQQTLSTITK

SEQ ID NO: 128362 - protein, 110 aa, Glycine max
  Coding DNA Sequence Number=SeqID_36677
MGKAEEVQGKMKADMEAMKEKMATMMAMMNMRKIMEANAVTFAATSTVAKVNPMPPFGLNQMNHPTLDMTHEIPHHNLVDFEPCLGYATEGQAVGGIPLQNPLEGPQYHP

SEQ ID NO: 128363 - protein, 189 aa, Glycine max
  Coding DNA Sequence Number=SeqID_36678
MGEIEEVQEWMKADMEAMKEQMATMLEAMMSMEKIMKVNATAVATTRAIAENKHTFPPYGLPLNYIPPNVAHTPDENVNNSTPILIEIQQPQSNHAHVSQPMGETHELVMNPCQTLWRALNFCPQPQPLHFTTGRIPPAMVEKGKLDHLEERLKAIERGREYAFANLEELFLVSNVVIPPKFKVPDFDK

SEQ ID NO: 128364 - protein, 195 aa, Glycine max
  Coding DNA Sequence Number=SeqID_36679
  Homolog annotation: Hit_ID=Q6WAY4; Match level="QueryCoverage=97%, HitCoverage=34%, E-value=7e-20, Identity=32%"; Hit description =Putative uncharacterized protein
MSSRTSLKELGQLMGQLQRQAFRKAYDKIWDLAMVEVSTEAIASLAQYYDQPMRFFTFGDFQLSPMVEEFEEILGCPLGGRKPYLFLGFYPSLARISKIVQISAQELDHRKQVKNRVVGIPRKYLEAKAKILASKGEWAPFIDILALLIFRGVLFPNVDGLVDLATIDAFLAYHNHKKGPVVAMLADLYDTFDQR

SEQ ID NO: 128365 - protein, 37 aa, Glycine max
  Coding DNA Sequence Number=SeqID_36680
MEGKLAHTVARSDTQWTFAIVNTDIRRVINHIPPPGF

SEQ ID NO: 128366 - protein, 198 aa, Glycine max
  Coding DNA Sequence Number=SeqID_36681
  Homolog annotation: Hit_ID=A5BZH4; Match level="QueryCoverage=55%, HitCoverage=17%, E-value=8e-09, Identity=34%"; Hit description =Putative uncharacterized protein
  Pfam annotation: Domain name=zf-CCHC; Domain location=155-172; Score =22.6; E_value=0.00058; Accession=PF00098.14; Description=Zinc knuckle
MVEINQDEREKIREEERRKILKELRKEKYATYGSHDSCKSLSEELRDYYEGRHRSHLRPHSHRIEKEKKLQEANINLSYFHGKDNVEAYLDWEIRVEQKLKRKSTLKSYGSHSYPKKDQGLGILGTAPSNPKDDKGKTIEKQPPKASMQEKTSSIKCFKCLGRGHITSQCPTKKTMIMRGQDIYSSQDEATTLPSSSE

SEQ ID NO: 128367 - protein, 88 aa, Glycine max
  Coding DNA Sequence Number=SeqID_36682
  Subcellular localization annotation: CTP_CleavageSite=42; ConfidenceScore=5.23e-01
MNCVFVHASSTLEFGVMRSDCLVQFSILNPSFRSPMNCVFVHASSTHEFGAMRSDCLVQFSILYLFSEPHDIAFSVHASSTQRVWSHA

SEQ ID NO: 128368 - protein, 85 aa, Glycine max
  Coding DNA Sequence Number=SeqID_36683
AANHQAHVQTHDCLYQMSLSMQSQGFASLSCPTPDQFRVEVAWPGDWPEAQAGEAPPEVPSDGEEAHEDEKMADLLDFLGGSGAT

SEQ ID NO: 128369 - protein, 127 aa, Glycine max
  Coding DNA Sequence Number=SeqID_36684
  Homolog annotation: Hit_ID=Q2QVF2; Match level="QueryCoverage=43%, HitCoverage=6%, E-value=5e-07, Identity=41%"; Hit description =Transposon protein, putative, CACTA, En/Spm sub-class
  Subcellular localization annotation: CTP_CleavageSite=41; ConfidenceScore=5.74e-01
MASPPASPPLPPPSPSDALASPSAMKRTQKASRLRSLSTRPASAERPVVHVDPATGKSDGPHRKKLRTYLWIVARDKVDVMYENWKEVPTAQKDLIWEDIQTEFEIPEASDNRTKKKLLQTVGERWR

SEQ ID NO: 128370 - protein, 115 aa, Glycine max
  Coding DNA Sequence Number=SeqID_36685
MAPKKLSTKRSSRDAAAEGTCAAPEERLVQLRDDEYTDFQEEIARQHWTSLVTPMAKFDPDIVLEFYANVWPTEEGVRDMRSWVRGHWIPFDADALSQFLGDLLVLEEGQECKFS

SEQ ID NO: 128371 - protein, 34 aa, Glycine max
  Coding DNA Sequence Number=SeqID_36686
MDSEREGFEPPVNKKPTIAVPMLPLEPLGPSLPT

SEQ ID NO: 128372 - protein, 90 aa, Glycine max
  Coding DNA Sequence Number=SeqID_36687
  Gene Ontology: Mol. function=catalytic activity; Biological process =cellular metabolic process
  Homolog annotation: Hit_ID=A4W8N5; Match level="QueryCoverage=100%, HitCoverage=25%, E-value=1e-43, Identity=97%"; Hit description=NAD -dependent epimerase/dehydratase
MKVLVTGATSGLGRNAVEFLRNKGISVRATGRNEAMGKLLQKMGAEFVHADLTELVSSQAKVMLAGIDTLWHCSSFTSPWGTQEAFDLAN

SEQ ID NO: 128373 - protein, 82 aa, Glycine max
  Coding DNA Sequence Number=SeqID_36688
MKNGEESSRNRTRKRYGNASAWIFSTETIFLTNFERILNTRRTEPKYSALFPLFIGEKRKVVAAQLAQASFHQKAPPSVGTP

SEQ ID NO: 128374 - protein, 219 aa, Glycine max
  Coding DNA Sequence Number=SeqID_36689
  Homolog annotation: Hit_ID=Q2HW90; Match level="QueryCoverage=50%, HitCoverage=31%, E-value=2e-14, Identity=33%"; Hit description =Putative uncharacterized protein
ANVLASQGEWAPFMDILALLIFGVVLFPNMDGLVDRAAIDAFLAFHDRKESPVVAILADLYDTFDRRCEKNSARILCCTPALYVWLVSHLFGQETRGCINYNPILAIRQLGYPARGAPLEKGLTPVIARGFDSSNAGDKELRGSSNGPIGGYHRWLKANTQGLDWLPNMRTTKEVEVETTKEDEEVQALKTELEKAQTVKEKFKSAAIRIRKENAELRD

SEQ ID NO: 128375 - protein, 107 aa, Glycine max
  Coding DNA Sequence Number=SeqID_36690
  Homolog annotation: Hit_ID=A5BEV8; Match level="QueryCoverage=62%, HitCoverage=9%, E-value=2e-07, Identity=41%"; Hit description =Putative uncharacterized protein
MYALNQIVVEFECVSYDGIDSSRCGCVMRTTYGLSCAYELAGYVVGSIPLSVIHMFWRRLSFSYQGLSEPKVSITEEMETIFKRLKSLMLVAKLLYRVNFGKLPTLI

SEQ ID NO: 128376 - protein, 205 aa, Glycine max
  Coding DNA Sequence Number=SeqID_36691
  Gene Ontology: Mol. function=4 iron, 4 sulfur cluster binding; Cellular component=integral to membrane; Biological process=electron transport
  Homolog annotation: Hit_ID=Q83RZ7; Match level="QueryCoverage=100%, HitCoverage=100%, E-value=1e-119, Identity=93%"; Hit description =Anaerobic dimethyl sulfoxide reductase chain B
  Pfam annotation: Domain name=Fer4; Domain location=119-151; Score =0.9; E_value=0.28; Accession=PF00037.18; Description=4Fe-4S binding domain
  Pfam annotation: Domain name=Fer4; Domain location=60-85; Score=4.9; E_value=0.066; Accession=PF00037.18; Description=4Fe-4S binding domain
  Pfam annotation: Domain name=Fer4; Domain location=7-30; Score=7.2; E_ value=0.029; Accession=PF00037.18; Description=4Fe-4S binding domain
  Pfam annotation: Domain name=Fer4; Domain location=92-115; Score =35.7; E_value=1.6e-07; Accession=PF00037.18; Description=4Fe-4S binding domain
  Pfam module annotation: Pfam domain module=Fer4::Fer4::Fer4::Fer4; Domain location=119-151::60-85::7-30::92-115
MTTQYGFFIDSSRCTGCKTCELACKDYKDLTPDVSFRRIYEYAGGDWQEDNGVWHQNVFAYYLSIACNHCEDPACTKVCPSGAMHKREDGFVVVDEDVCIGCRYCHMACPYGAPQYNAAKGHMTKCDGCHTRVAEGKKPICVESCPLRALDFGPVEELRQKHGQLAAVAPLPSAHFTKPSIVIKPNANSRPTGDTTGYLANPKEV

SEQ ID NO: 128377 - protein, 46 aa, Glycine max
  Coding DNA Sequence Number=SeqID_36692
IIIVQEEKESHEDSMNGGFNPFSVSLTFGNSIGAVGGKIGEISGNR

SEQ ID NO: 128378 - protein, 125 aa, Glycine max
  Coding DNA Sequence Number=SeqID_36693
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q2PMS9; Match level="QueryCoverage=89%, HitCoverage=60%, E-value=1e-40, Identity=79%"; Hit description=ATP synthase B chain
  Pfam annotation: Domain name=ATP-synt_B; Domain location=1-114; Score= 18.3; E_value=0.00016; Accession=PF00430.9; Description=ATP synthase BB' CF(0)
MALNPIYLRQEIEKRKILRTIRNSEELREGAIEQLEKAQARLRKVETEADRFRVNGYSEIEREKLNLINSIYTTLEQLENYKNEAIHFEQQRVINQVRQRVLQQALQGALGTLKSCLNNELHLRT

SEQ ID NO: 128379 - protein, 95 aa, Glycine max
  Coding DNA Sequence Number=SeqID_36694
MDEFDILVSLILSQTHLCLFNFHRNASVIHWFVCSKQPAPLSVDFQDRSIRDYSSCTLVGCRKQQVVKTKMDTAEPYTGALRGIVHEPQVNLGAD

SEQ ID NO: 128380 - protein, 184 aa, Glycine max
  Coding DNA Sequence Number=SeqID_36695
  Homolog annotation: Hit_ID=Q2HW90; Match level="QueryCoverage=92%, HitCoverage=31%, E-value=4e-20, Identity=35%"; Hit description =Putative uncharacterized protein
MANQEEWVPFVDILALLIFGVVLFPNVDGLVDQAAIDAFLAYHYSKESPVVAILADLFDTFDRRCEKSSAQIICYLPALCVWLVSHLFQQDIRHPCPLRSHRSCVEKRRVDRDQHLAGIGGRIINWFPRWKEGNEGVLFSCGDYPNIPLIGMRGCINYNPALAIRQLGYTMKGAPAEESLSPFL

SEQ ID NO: 128381 - protein, 90 aa, Glycine max
  Coding DNA Sequence Number=SeqID_36696
MEQEGGLCDGKEVDQFHQPSGSNEVAIANEDGISYGSELIEVDKMVLSGIFFGDRMSLSCRNIWKNFREFRYVHCCRLKQDWVKDQAANK

SEQ ID NO: 128382 - protein, 66 aa, Glycine max
  Coding DNA Sequence Number=SeqID_36697
MKIQKKGEEMMQSYPARALDIRLQVDWARDPREGPRVLMSLRVDFVEAKLHDESTIIQRCWTLWPQ

SEQ ID NO: 128383 - protein, 135 aa, Glycine max
  Coding DNA Sequence Number=SeqID_36698
MNEIKMKVKKTRNELKVSDSKTYPLKNEERMKNGEEQQKTFTDSLTETSRKRYGSTSAWIFFTETFFSTQPIYRKRGEEVAAQLAQASWVASGRAGLLPEAIQLRKILSKTHFKISKLLFAPPFFRNLREIYGSL

SEQ ID NO: 128384 - protein, 115 aa, Glycine max
  Coding DNA Sequence Number=SeqID_36699
VDSRGSPGPPPLDDKKGADNRKGADNRKGADNRKGADNRKGQYDRSCGAADKSNALAPTYPPMRNSDLRADNRKVSPRVTSSWVMTAKGGVVDKSKALAPTYPPMRNSDLRSSGT

SEQ ID NO: 128385 - protein, 119 aa, Glycine max
  Coding DNA Sequence Number=SeqID_36700
  Subcellular localization annotation: CTP_CleavageSite=52; ConfidenceScore=5.24e-01
MGRSMIDAISGGALMDKTPIVSKQLISNMAINYQQFGTRVAAPSRVAASKVSVSMVVDNQRLENKLTELTSLVRQLAIGQTTECDGSQSTKAICHSDLNNNNIILTPTPIILVGEIIRT

SEQ ID NO: 128386 - protein, 248 aa, Glycine max
  Coding DNA Sequence Number=SeqID_36701
  Gene Ontology: Mol. function=motor activity; Cellular component=cell projection
  Homolog annotation: Hit_ID=UPI00016621D1; Match level="QueryCoverage =99%, HitCoverage=44%, E-value=6e-21, Identity=33%"; Hit description =UPI00016621D1 related cluster
PSPSEDCTSSPSEDYTSSPLEGCTPSPPLGTSTLSFRGLHVLTFRGLHVLAFRGLHVLTFRGLHVLAFRGLHVLTFRGLHALAFRGLHALIFRGLHVLAFRGSCTFIFRGLHVLAFRGSCTFTFRGLHILASRGLPVLTFRGLHILTFRGLHALTFRGLHALTFRGLHALAFVGLHALTFRGLHVLASRGLHVLAFRGPHTLFFRGLHVLTFRGLHVLTFRGLHTLAFRGLHALAFRGLHAFAFKRRH

SEQ ID NO: 128387 - protein, 85 aa, Glycine max
  Coding DNA Sequence Number=SeqID_36702
MKENAIHWGSEEGLENGELHKAITTHGSKLVGGGCMNENAIQGAPKQGREWRIALSNHNAWLQTRGWRLHERKRNSWGSDKGLEN

SEQ ID NO: 128388 - protein, 141 aa, Glycine max
  Coding DNA Sequence Number=SeqID_36703
  Subcellular localization annotation: CTP_CleavageSite=58; ConfidenceScore=5.53e-01
MAKIQGPKKRKTFLIFTKKSGSNLGPWAQKSTLRFIRTLGPSLATLAQCSWSLLSNVEAMPSKVILMMPKNQELSKVSSNDSRIKFQVSRFKIQDSRFKNQVQESRIRKNQDQDSRLKIQESREDSIKISIKKFFKTLSST

SEQ ID NO: 128389 - protein, 43 aa, Glycine max
  Coding DNA Sequence Number=SeqID_36704
MGSMWTLRKSRPSKRGLPQKVQEILGAFMGWQVSIKGVGAVLL

SEQ ID NO: 128390 - protein, 66 aa, Glycine max
  Coding DNA Sequence Number=SeqID_36705
MEKSEKKNHSEKKLKKAYITWDENDLESSDDSENEEINLCFMARSYESDEEKRTWHINLLLQEKLQ

SEQ ID NO: 128391 - protein, 40 aa, Glycine max
  Coding DNA Sequence Number=SeqID_36706
MVVRDRVEAPCRACRPWIFFINGVLCLLKINGSGMEKEER

SEQ ID NO: 128392 - protein, 129 aa, Glycine max
  Coding DNA Sequence Number=SeqID_36707
MGIDVVVWKEVVGLDMGGVSKFDETRDGYNKMQTYRGMLLDPARNLRNHLGIGGLAVEDKMLVYLITYILTSRSSNHAQIMLKCHHLLDYEFPYVVLVSRFIDYFKVNVSIEIVDFTKASNEITERHLK

SEQ ID NO: 128393 - protein, 85 aa, Glycine max
  Coding DNA Sequence Number=SeqID_36708
MMTIKDDDKGDEQKAQRSKNNSSESRTSQEFKNQEEFKTQEESLESRIKIQDSRSQESRSRFKISRIKIKIQDSRFKNEEKTQSR

SEQ ID NO: 128394 - protein, 172 aa, Glycine max
  Coding DNA Sequence Number=SeqID_36709
MLKELRKEKQATYSSHDSCKSLSEELRYYYEGRHRSHLRPHSHRREKERKPQEGNINLPYFHGKDNVETNLVWEIRVEQQLKKKSTSKSYGSHSYPKKDQGQGILGVTPSKPKDDKGKTKKHYFSMPTKKTMIMRGQDIYSSQDEATTSPSSSESEEAKWEESSEEIYPQEE

SEQ ID NO: 128395 - protein, 117 aa, Glycine max
  Coding DNA Sequence Number=SeqID_36710
MLPLDFRCVTETYGLCINIFLVFRHVLEFHKLPNDGKAGVAAHDVQRYVKESDRAAQCTRQDKMSNEELKLQDPRCRIQCPGHPARKCTRQDKRIEAAGSTMSDTMSRTSCPKILDT

SEQ ID NO: 128396 - protein, 430 aa, Glycine max
  Coding DNA Sequence Number=SeqID_36711
  Homolog annotation: Hit_ID=Q6WAY6; Match level="QueryCoverage=97%, HitCoverage=75%, E-value=7e-37, Identity=28%"; Hit description =Putative uncharacterized protein
STLEDPTDLARVEVSTEAIASLAQYYDQPLRCFTFGDFQLSPMVEEFEEILGCPLGGRKPYLFTGFYPSLARISKIVQISAQELDHRKQIENGVVGIRRKYLEAKARILAGKGEWASFIDILALLIFGGVLFPNVDGLVDLPAIDAFLTYHNQKENPIVAMLADLYDTFDRRCEKSSTRIVCCTPALYVWLVSHLFRQEVRHACPLGSYRSCTEKGGANWDRLLANKEGAGFPNVPLMRTRGCISYNPVLAIRQLGYPMRGAPLEEELAPVISRGFNKTNVETLQKVHKAWEVVQKKDKELRGSNNGPIGGYHKWLRAHVQGLDWLPSLRTAKREEVEAPEEDEEVQALRTELEQAPTVKERFKSAALKIRKENAELRDINTATTKALEQETKRARREEHGRNKFQGALWGSNSELKLQREERDQSRVTV

SEQ ID NO: 128397 - protein, 107 aa, Glycine max
  Coding DNA Sequence Number=SeqID_36712
  Pfam annotation: Domain name=zf-CCHC; Domain location=43-60; Score =19.6; E_value=0.0016; Accession=PF00098.14; Description=Zinc knuckle
MIVNQQVMDGILGAAPSKPKDDKRKAIEKEPPKACMQEKTSSVKCCKCLGRGHIASQCPTKKTMIMRGQEIYSSQDEVTTSPSSSKSEEAKGKYLVKKSTPKKKGIF

SEQ ID NO: 128398 - protein, 80 aa, Glycine max
  Coding DNA Sequence Number=SeqID_36713
MEEKVKQKINGASMRSFNGDFPPWRCSGIQRRRGERRRHPLGNKPWKKELHHQDERWIRSLERMLQWRKRKRERKTEGGA

SEQ ID NO: 128399 - protein, 107 aa, Glycine max
  Coding DNA Sequence Number=SeqID_36714
MVVIPAMKYLVVWFCSLHNRPYNYLKGIINSALKGLDDAPQPKSKVVARWIVVNCNRQKGSTECGDYVMHWMSTIILGSFRNNWKATIGAREIKGASDPVGTLLSPS

SEQ ID NO: 128400 - protein, 101 aa, Glycine max
  Coding DNA Sequence Number=SeqID_36715
  Gene Ontology: Mol. function=cysteine-type endopeptidase activity; Cellular component=endoplasmic reticulum; Biological process =proteolysis
  Homolog annotation: Hit_ID=Q9FS02; Match level="QueryCoverage=95%, HitCoverage=27%, E-value=2e-43, Identity=87%"; Hit description =Cysteine proteinase precursor
  Pfam annotation: Domain name=Peptidase_C1; Domain location=1-100; Score=-33.0; E_value=2.9e-09; Accession=PF00112.14; Description =Papain family cysteine protease
MRRHILQKAVANNPVSVAIDASGSDFQFYKSGVFTGSCGTELDHGVTAVGYGVSDDGTEYWLVKNSRGPEWGEEGYIRMQRGVDSEEALCGIAVQASYPSA

SEQ ID NO: 128401 - protein, 37 aa, Glycine max
  Coding DNA Sequence Number=SeqID_36716
PRRFRNASVSDSVEILHRSSSFFTVLHPFFVRSSFFN

SEQ ID NO: 128402 - protein, 136 aa, Glycine max
  Coding DNA Sequence Number=SeqID_36717
MARVEIASWPRTCAPPACAWWPAAWRRPGALFRRKLAMLKIRRTQRLQEHHRVVLNAWAAPWGRAAAGRPGSWPGPDRRLAAMRKRNAAASSAAPSRPWPMTSPAATSTTSPPRPAHLRRLQRNPEEHHLQDDPGC

SEQ ID NO: 128403 - protein, 38 aa, Glycine max
  Coding DNA Sequence Number=SeqID_36718
MDMLADAEVMFNASYLTLPIGEIDHDPLLGRPLTPTKR

SEQ ID NO: 128404 - protein, 93 aa, Glycine max
  Coding DNA Sequence Number=SeqID_36719
RDGSWVKKDAQPQAADDRSPSPPPQRDDSSSFMQNVLDKLDGLLTFVGERFDSLDSRIDVIDARFAGMDTRITQLEEDMSFICQCFDLPPPSS

SEQ ID NO: 128405 - protein, 128 aa, Glycine max
  Coding DNA Sequence Number=SeqID_36720
MLHCHIQHFNFSLDSEPYVPIKRSFLIRAAVIASFGYRKEHDGSWVKKGAQPIDEEGHLHGGEDSSLLQKILDRFDGLQTFVGERFDTLELQVGMHFNEMESRITKVEEDVSYIRTSFDLPPPQPPSS

SEQ ID NO: 128406 - protein, 147 aa, Glycine max
  Coding DNA Sequence Number=SeqID_36721
MKKKLEEATQSGSIDGVIDPPSPVRHHVKWKMARTKKTGEMTTEAAKEIAEKIISHFQLTITIIFQYFLMPCTTVCFLCRIPLRSKQHRDPSSPMDVKMFSPLLLDIQSTLDVSVLLEPVSPSNNTLDQLHGRPTALPPYLPKNCSS

SEQ ID NO: 128407 - protein, 98 aa, Glycine max
  Coding DNA Sequence Number=SeqID_36722
MAKFDPDIVLEFYANAWPTEEGVRDMRSWVRGQWISFDADTLSQFLGDPLVLEEGQECEFRFCPDHCQEMGADHAHQHDYLDLDVDDVAAQQHPAQRS

SEQ ID NO: 128408 - protein, 231 aa, Glycine max
  Coding DNA Sequence Number=SeqID_36723
LAMRDEPGSWVTVPKLRANLDPTKGVGRLRQQDGGHGSRNPLRRRGGRCKTQGASPGGAVVGADLGGSSKYSNESGEGRRGERFHVNGTCTWVSQDPNGREARLIVYPKSECACSPLETVIIAIGMAARALGARAPARSWRRPVPCGLRPPNPESSVQGIRNETHTCRDPKDGELCLSGAKPEETLVEARSDTDVQIVRLTWDGAAALLSRAMESRAPSGPFLVSRTGDAG

SEQ ID NO: 128409 - protein, 155 aa, Glycine max
  Coding DNA Sequence Number=SeqID_36724
MAECGEFKPAHIHGTLPKDEFQLANDQGATPFTLRRWQACVPFEVEAHVIKDLGQTLRIKGIRGAQTRYDRAQLIEDEDLDKSRLRYCKFHGKGDLVSCEEKKCHAVKPSRDNGPRPILLNVMSAPWPFSMWGRALSSGSPGAYQHGWRSIALIL

SEQ ID NO: 128410 - protein, 151 aa, Glycine max
  Coding DNA Sequence Number=SeqID_36725
  Subcellular localization annotation: CTP_CleavageSite=42; ConfidenceScore=5.17e-01
MQRANASLCKEKSSSTKVLKTRQYDNGSAQTLSLVVKLTYARCMLFNAGKCREFANFPKGALLQSYSRDRSVFKLCKPPAPLARLLWLLHVAKTPLPLAGSMVSPAPLAISPCKGSSQSNWRVPSTGRRLLSLFRLFSWQAFSVGRGRGTG

SEQ ID NO: 128411 - protein, 217 aa, Glycine max
  Coding DNA Sequence Number=SeqID_36726
MRGAPLEEELTPVISRGFNKTNGETLQKVRKAWEVVQKKDKELRGSNNGPIGGYRREEVEALEEDEEVQALRAELEQAQTVKERFKSAALKIRKENAELRDTNIATAKALEQETKRARREEHGRNKFRGALWGSNNKLKLWREERDQSRVHGMVLKEELAACSRSKKSLAQHLEATEQSMLAIIGQYKEELNQSLTHEQKLEEDFAQAYAEKEARGR

SEQ ID NO: 128412 - protein, 136 aa, Glycine max
  Coding DNA Sequence Number=SeqID_36727
TASRVVGGDTLWSSAPFIDREERIQQYQDDVGRSVLTIFKIFAVFFTLAVLKHLSPTMHGILLCWAETIGCNGKGKHLTPIVRQSVKFHDMSGVERKRQCAIRKVPKQGCTNSSQWAFQDVPTEGGAFWWKQPSSP

SEQ ID NO: 128413 - protein, 168 aa, Glycine max
  Coding DNA Sequence Number=SeqID_36728
  Homolog annotation: Hit_ID=A5C7Z4; Match level="QueryCoverage=72%, HitCoverage=42%, E-value=7e-09, Identity=31%"; Hit description =Putative uncharacterized protein
MRAGNSDIYGFLEPQSIQRSGQSQFESESYIKSWMQSSQRDVYWSLPKWMVVILPKEHLVVWFCSLHNRPDNYLKGIINSAIKGLDDAPQPKSKTPARWIVVKCNRQKGTTECGYYVMHWMSTIILGSFRNNWEAYFNDPRPLEPERLKALRIQWAQFYLRVRDQPRI

SEQ ID NO: 128414 - protein, 225 aa, Glycine max
  Coding DNA Sequence Number=SeqID_36729
MAFLGETLSQMIVNSRLTFIFPNGVVIHNECGVYFQSSTPVPMRVPNLCDFSTLKSIIHNTLQLNNNQVVDEIHYRRPLKDTGNNIHFHCMQLKHDMDVNTMLMCNDQFSCVEPIELLCTIGRTPDAILNLLECPSIRTHDAVLYYNGRWNMPRPNNFVGYAFTGINPQKFDVPKGCTIDELKDLIKQVTPKGNPPHGIHESQLVRRLFYQQPAHLEYSDKVLRI

SEQ ID NO: 128415 - protein, 53 aa, Glycine max
  Coding DNA Sequence Number=SeqID_36730
MTMLVSACQRTRLPLVDKRCAMQSYLARALARRLQVDWARDPRKGPRVLMSLR

SEQ ID NO: 128416 - protein, 99 aa, Glycine max
  Coding DNA Sequence Number=SeqID_36731
DVAEQQRHPYLGQGGHASAHDPHPSPCSNLGEILPWNAQKLSNGLLIKTRDLTPPLAEFILLTLFQNQRVAQELAKGVCIQGDPLAPCSFAGKYTGSRN

SEQ ID NO: 128417 - protein, 132 aa, Glycine max
  Coding DNA Sequence Number=SeqID_36732
MECLEGVWETFEGNERCRFRGTIRLTATSLVHPEEPARTLQQPVGWILPTPTPYRLVEPVQVIEVSSSEEDLEEDPEKLPPEPAMDALDLPEDDEDPLPDVDSPEDIMSASEADSTEESGPGGTAISDDSSS

SEQ ID NO: 128418 - protein, 120 aa, Glycine max
  Coding DNA Sequence Number=SeqID_36733
FIEKYCTQRQAQGNAPQVADAPPPHQAGPAGSFDTEQYLRHLVRQQAANHRISLSLQSQGFTSFPCPTPDQFRAEVAWPGDWPEARAGEAPAEAPDEADEAREDEEMTDLLDFLGGSGAT

SEQ ID NO: 128419 - protein, 155 aa, Glycine max
  Coding DNA Sequence Number=SeqID_36734
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=2e-22, Identity=35%"; Hit description= UPI00006A17C9 related cluster
  Subcellular localization annotation: CTP_CleavageSite=97; ConfidenceScore=5.66e-01
MAMTCNPLKVRFCSPLLARMCSPLKVRACSPLKARTCSPLMARACSPPKVRACSPTKVRTCSPLMARACSPTKVRTCCPLEVRACSPLMVRTCSPLKARTLPKVRACSPLKARTCSPLEVRACSPLMVRTCSPLKARTCSPLKARTCSPLNGEGN

SEQ ID NO: 128420 - protein, 59 aa, Glycine max
  Coding DNA Sequence Number=SeqID_36735
  Subcellular localization annotation: CTP_CleavageSite=36; ConfidenceScore=5.33e-01
MAVSSEDQGAGNPNGKPFTAPHDSFTKRSLRRTPASASKEVSKIPPGDQVKVNSPEQIF

SEQ ID NO: 128421 - protein, 191 aa, Glycine max
  Coding DNA Sequence Number=SeqID_36736
  Subcellular localization annotation: CTP_CleavageSite=20; ConfidenceScore=5.22e-01
NHPNLILSSPQQQQQQPAPSFQNAAGPSRPYIPPPIQQQQQPQKQPTVEAPPQPSLEELVRQMTMQNMQFQQETKASIKSLTNQMGQLATQLNQQQSQNSDKLPSQAVQNPKNVSAISLRSGKQCQGPQPVAPSSSANEPAKLHSIPEKGESSSTGNSDLQKQHIPPLPFPPRAVSNKKMEEAEKRDLGNV

SEQ ID NO: 128422 - protein, 73 aa, Glycine max
  Coding DNA Sequence Number=SeqID_36737
MRYHVNEKPRRAPRSKIIRRPVRVTMFCENASIIWDQHRLKGALKPDDPQGLHSEESSQGRSLLIQVQPKKTF

SEQ ID NO: 128423 - protein, 170 aa, Glycine max
  Coding DNA Sequence Number=SeqID_36738
  Homolog annotation: Hit_ID=Q6WAY6; Match level="QueryCoverage=43%, HitCoverage=12%, E-value=1e-11, Identity=45%"; Hit description =Putative uncharacterized protein
MASMDTSAMVNSRGGSEGKEGVLFSCGGYPNIPLIGMRGCINYNPALAIRQLGYSMRGAPMEESMSPFLVRDFGAQNFKAIQRIHKAWETPLRKDQEHRGIRNGIIGGYYEWLKVHIRGLDWLAKLKDVSEESFEAPEEDEEVQALKSGVRKGETCQGEVSSWPLHTSGK

SEQ ID NO: 128424 - protein, 85 aa, Glycine max
  Coding DNA Sequence Number=SeqID_36739
MERKLITMIVDTLSVSSYEKMVDYMPSSFADLVFVGETVKVGLRRGKFDCLTLTSKKPGANGENEKEEGTHVLAAIPTWPNFPPA

SEQ ID NO: 128425 - protein, 138 aa, Glycine max
  Coding DNA Sequence Number=SeqID_36740
MKRAAQELFVVHWLSMCGWFHTFFSKKGRPVYPLQGHRSCVEKGKANWDQLLASMEGRLLIGSLARRKEESGSIFMRESKVGAINGSTSTASLRQLVPTVKHEERMPKELRKEAIIFSSTAIAIRTQGLDWLPNLQDR

SEQ ID NO: 128426 - protein, 113 aa, Glycine max
  Coding DNA Sequence Number=SeqID_36741
MSYFLMRGIRFGSILGRIDSLLRGNPSLVLEVMDLFMSWRGSITMPIGWTSQKNGAHAEEEEPTNLRSNPLQGRGDHAILPRKGLVTRAMNKRLQEDWARVAEEGPRVLMNLR

SEQ ID NO: 128427 - protein, 140 aa, Glycine max
  Coding DNA Sequence Number=SeqID_36742
  Subcellular localization annotation: CTP_CleavageSite=40; ConfidenceScore=5.39e-01
MAIQRISGHAGAPATQRRTDTLNGRVGSPRAPLPPTARPPAAADTSGSSAPAAPAAADDCPAPPPGRDAAPEWSRHRRWSTIGGRSPPAWCARGSHAARAGSPVRCPSRCWRSPRRGSGSSAPAPTPAPSPAAVSARPTR

SEQ ID NO: 128428 - protein, 182 aa, Glycine max
  Coding DNA Sequence Number=SeqID_36743
MAAQPVQRRALIATERQHLQAIVGGKAQVCLVAQLCPQLHLQRQQLLMRRDKAHLAVAERRQAAHVGQLKTKAAQVVRPQHLFRHGKLGQPAFVAEHVHAGAGAPMMMQNLLGDRRRQIGSVQLLAAVVIHPRAVAGDQVALQPQLRHDRLRVEVVPPGGERHHHLPFHQLVQHRQRFRANP

SEQ ID NO: 128429 - protein, 62 aa, Glycine max
  Coding DNA Sequence Number=SeqID_36744
MTLSSWQNKLDKYFMCKTLVMKGGAWFYRAKQLVLMIMASPPASPPPPPPPSPPPHPPLFDA

SEQ ID NO: 128430 - protein, 122 aa, Glycine max
  Coding DNA Sequence Number=SeqID_36745
  Gene Ontology: Mol. function=phosphoprotein phosphatase activity
  Homolog annotation: Hit_ID=A5AWR0; Match level="QueryCoverage=84%, HitCoverage=10%, E-value=5e-15, Identity=37%"; Hit description =Putative uncharacterized protein
  Pfam annotation: Domain name=DUF1723; Domain location=81-121; Score =28.7; E_value=2.2e-05; Accession=PF08330.1; Description=Protein of unknown function (DUF1723)
MASSSSCSSNIKIKSGPIDGGVLWMQAKHVSKHVWNGKEDWKLLIRRAVPTYQGEEEIPEEIIPLLRQCDFYWIMKMGYLKISVSLITTLIERWRPETHTFHMRCRECTITLQDVCIIRSAC

SEQ ID NO: 128431 - protein, 121 aa, Glycine max
  Coding DNA Sequence Number=SeqID_36746
  Homolog annotation: Hit_ID=A5ATR3; Match level="QueryCoverage=95%, HitCoverage=25%, E-value=1e-12, Identity=38%"; Hit description =Putative uncharacterized protein
MNQNETIQDMQKRFTHIVNHLTSLGKIFPNEDLINKVLRCLSRERQPKEYKMELMRLNQHEENDKKKKGIALKASSSIQEESDREYWNEIEEDDDFRFLVNRFNKFIRNKGNQRRTNFNPK

SEQ ID NO: 128432 - protein, 73 aa, Glycine max
  Coding DNA Sequence Number=SeqID_36747
QEVPYQDDELVGLQDVLEVDPDVINESLVDVDGGGEEINADLLKHLDLIGPNEDECILSENEIESNFDDTDPS

SEQ ID NO: 128433 - protein, 184 aa, Glycine max
  Coding DNA Sequence Number=SeqID_36748
MMKAMMSMKKIMEANAVIVAAISAVAKVNPMLPSGLKQMNHPTSNMAHISQTMGETHEIPHHNLADFEPWLGYATEGQAVGGIPFENTLEGPQFRPQPQPLHFAVGRAPPAMAEKGKVDHLKERLRAIEGGEDYAFANLEKLFLIPKHGHSQVQGAGLWQVQGDYSLQEPSKDVLSEDGGIRKR

SEQ ID NO: 128434 - protein, 219 aa, Glycine max
  Coding DNA Sequence Number=SeqID_36749
  Gene Ontology: Mol. function=chlorophyll binding; Cellular component =integral to membrane; Biological process=photosynthetic electron transport
  Homolog annotation: Hit_ID=Q2MI75; Match level="QueryCoverage=95%, HitCoverage=47%, E-value=1e-103, Identity=79%"; Hit description =Photosystem II P680 chlorophyll A apoprotein
  Pfam annotation: Domain name=PSII; Domain location=1-212; Score=88.4; E_value=2.3e-23; Accession=PF00421.10; Description=Photosystem II protein
MWYGSATTPIELFGPTRYQWDQGYFQQEIYRRVGAGLAENQSLSEAWSKIPEKLAFYDYIGNNPAKGGLFRAGSMDNGDGIAVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFKNLEIHYKKQVV

SEQ ID NO: 128435 - protein, 92 aa, Glycine max
  Coding DNA Sequence Number=SeqID_36750
MATADALERETKKALKEEHVPAKLEDEYAKISAESEARERVIDSLHQEATMWTDRFALTLNRSQELPPLLAKAKAVADTYSAPEEIHGLLSY

SEQ ID NO: 128436 - protein, 178 aa, Glycine max
  Coding DNA Sequence Number=SeqID_36751
  Homolog annotation: Hit_ID=UPI00016621D1; Match level="QueryCoverage =97%, HitCoverage=46%, E-value=1e-10, Identity=29%"; Hit description =UPI00016621D1 related cluster
MRGPLDESIFCLLIEVDPSVQKPIAFRGLHVLSFKGLHALTIRGLHALAFKGLHVLAFRGLHVLAFRGLQALAFRGLHVLAMRALHALALRGLQVLAFIGLHALAMRELHVLAFRGLHVLAFRGLHNLAFRGLHILAFTRLHVLVFTGQHVLAFKGLHVLTFRGLHVLAFRGLHALAF

SEQ ID NO: 128437 - protein, 172 aa, Glycine max
  Coding DNA Sequence Number=SeqID_36752
  Gene Ontology: Mol. function=lactaldehyde dehydrogenase activity; Cellular component=cytoplasm; Biological process=metabolic process
  Homolog annotation: Hit_ID=Q6DAY4; Match level="QueryCoverage=99%, HitCoverage=35%, E-value=2e-65, Identity=69%"; Hit description =Aldehyde dehydrogenase A
  Pfam annotation: Domain name=Aldedh; Domain location=1-166; Score= -165.4; E_value=3.4e-07; Accession=PF00171.13; Description=Aldehyde dehydrogenase family
MRQVKFGDPAQQADVDMGPLISAAACDRVGQKVASAVAQGGKVVLGGKRAGERGFYFEPTIITGVRQEMAIMREEIFGPVLPVMRFNTLDEAIALANDCDYGLTSSLYTRDLNTAMIALRRLKFGETYINRENFEAMQGFHAGWRKSGIGGADGRHGLEEYLQTHVSYLQFA

SEQ ID NO: 128438 - protein, 72 aa, Glycine max
  Coding DNA Sequence Number=SeqID_36753
MRLFFLSQLCQLYTGLWKQVADPPAPVHERLADPSTPTMEMPEDPTTLVLRLSSTPPATPVLHLTDEEDMQD

SEQ ID NO: 128439 - protein, 233 aa, Glycine max
  Coding DNA Sequence Number=SeqID_36754
  Gene Ontology: Mol. function=DNA-directed RNA polymerase activity; Biological process=regulation of transcription, DNA-dependent
  Homolog annotation: Hit_ID=A4AUM1; Match level="QueryCoverage=61%, HitCoverage=68%, E-value=7e-38, Identity=55%"; Hit description=RNA polymerase sigma-70 factor, ECF subfamily protein
  Pfam annotation: Domain name=Sigma70_r4; Domain location=173-222; Score=35.9; E_value=1.5e-07; Accession=PF04545.7; Description=Sigma -70, region 4
  Pfam annotation: Domain name=Sigma70_r4_2; Domain location=167-217; Score=39.9; E_value=9.3e-09; Accession=PF08281.3; Description=Sigma -70, region 4
  Pfam module annotation: Pfam domain module=Sigma70_r4::Sigma70_r4_2; Domain location=173-222::167-217
MGKEHYIADKTFNKGHKNELTLKDLEFFTWEKLDKVEEIKTTFGVEGTNKYIAPKVGVTLFGLLDLTAGYAFPFGDAELNGKQLKGVNDTFMKIIVMLKEGRYNEEGKFILWAKRIAYNLIIDHFRLKSKNIKVSETTFETDEYSIFDLIREPSENIEDQLVTNQIQEDLLRMLQYLPQNQQEVIKLRFFDGLSFKEIADHTDMSINTTLGRVRYALINLRKIMEENNIILTR

SEQ ID NO: 128440 - protein, 135 aa, Glycine max
  Coding DNA Sequence Number=SeqID_36755
VEKFLKKYFPESKTAEGKAAISSFHQFHDESLSEALERPQTKKLLDASAGGKIKLKTPEEATELIENMSASDHAILRDRTHQPTKKSLIELSSHDALLAQNKPMYSLLKKTLKKFIIWEINNGKGILNEDFQLPA

SEQ ID NO: 128441 - protein, 190 aa, Glycine max
  Coding DNA Sequence Number=SeqID_36756
MTGRLLAGSLALESRILHYLIVRVLLPRSSNLAQVSEEDLIVMWAFHTGRKIDWAHLVRSFLIGAAVVASFGYRKERDGSCVKKGAQPNDDEGQLPVEWDSSLLQSNLDRFDALEQQVDMRFDAMDSRITKVEEDVTIIRDCLDLPPPPSDCHHQKGEIVEAMSSKVIPMMPKNPELRSSFQESRFKIPE

SEQ ID NO: 128442 - protein, 125 aa, Glycine max
  Coding DNA Sequence Number=SeqID_36757
MWAFLTGRQIDWAHLVRYRMHKALRANAPLRYPQLITLFLHHFQIPLDDEPFVQVKRSFAIGAGAVTSFGYLLTELRGLRSYVGERFDSLDTRFAGMDIRLTQVEEDVSFIRTCFDPPPPPPSSS

SEQ ID NO: 128443 - protein, 253 aa, Glycine max
  Coding DNA Sequence Number=SeqID_36758
MLVSFGDLVPVLPILNAIVRQRRVWRQTTDGGYASPKAGYLAAIAGRASRPRRDQARLDGAGHRLGASPAPSLDMIFLTLSLTVWGLRWTMPAISALDRPCASRPRIFRSEALSPCFSAARRLSMHCASRSLSSPASPASGAPCTSSAMRAYMAIAMRVRSSNRVTRCDFSVTSDCSALREGLVDVTGDAHGARPLSRPASAGRVQHLEMDDTAVAMARLVQLHAAVRISTMSRRPAAARSSAAPAPPSGPGG

SEQ ID NO: 128444 - protein, 143 aa, Glycine max
  Coding DNA Sequence Number=SeqID_36759
  Gene Ontology: Mol. function=hydrolase activity
  Homolog annotation: Hit_ID=A7QB13; Match level="QueryCoverage=37%, HitCoverage=16%, E-value=5e-17, Identity=79%"; Hit description =Chromosome chr5 scaffold_72, whole genome shotgun sequence
MYRVAAPTIRVILGGAFVVNGNVNPTVEVNIFGYSEAADVVFTSGVDVLAVGINVTHQVVLTEFMHKTPVPPWSLIVTVFGVSSTNSASRPSRDGLSTGRDKYPDFQGDISCRHWARLVTPMAKFDPEIVIEFYANAWPTEEG

SEQ ID NO: 128445 - protein, 229 aa, Glycine max
  Coding DNA Sequence Number=SeqID_36760
  Homolog annotation: Hit_ID=A6TFZ2; Match level="QueryCoverage=98%, HitCoverage=55%, E-value=4e-96, Identity=72%"; Hit description =Putative uncharacterized protein yidR
MARHWCVLVSRTTANPLPGSDEINRAYEEGWVGNHALAFIGDTLAENGDKVPELFMVTLPRDEAGWKRQGDMPLAGTATTLPAPPAGINQRRLTFTHQRRYPGLVNVPRHWVRANPQATEIAFLMRDDAGVVQLWLIPPAGGEPRQLTHTVMGIQSAFNWHPSGAWLGCVVENKIALCDARSGAVSYLTNDRENPPSADAVVFSPDGKYLAWMEDVDGYRQLWITETQR

SEQ ID NO: 128446 - protein, 126 aa, Glycine max
  Coding DNA Sequence Number=SeqID_36761
MGEFVDGRWEWKLSWRRDFFDYEIQMAADFVDEIHSDPKNHFLQFTQWNNKASINNRWKFLWLALSFFVWHHRNAMIFKNHPFDPEKRRTTPGTTPSICSSCMWRSTPGCLMNDNSISHLPAVNDM

SEQ ID NO: 128447 - protein, 76 aa, Glycine max
  Coding DNA Sequence Number=SeqID_36762
MYLPKRDKAYFRWDTCTKARLGPDRRMSSTYTSKMTKEFPEPMALLEDKTCSLMREEWKQVLNSQNFLRHDSQVPF

SEQ ID NO: 128448 - protein, 134 aa, Glycine max
  Coding DNA Sequence Number=SeqID_36763
MIRGDTLRLSAPFCHPEAVGPMTSRDKIWSFCTLVSSRGGGPDDTRRYLTVIRTLLSSRGGGPDDKQRQNLGHSAPLVSSRGGGPDDTRRYLRGYPYKHSFAICAWHPSLGDLRNSGNDKSWSPATLVNREERN

SEQ ID NO: 128449 - protein, 59 aa, Glycine max
  Coding DNA Sequence Number=SeqID_36764
MATIQHLAIANKKTRPIICMIKLELNRTSKETTKATEVAQVLLTTLMRVLQIGVHNSNN

SEQ ID NO: 128450 - protein, 41 aa, Glycine max
  Coding DNA Sequence Number=SeqID_36765
MESPNKVENGELANSATQRYVAITSRGSRLEGGGHMNSAWQ

SEQ ID NO: 128451 - protein, 95 aa, Glycine max
  Coding DNA Sequence Number=SeqID_36766
MQRMELYMQHVADQQVANHKGQVHLNESFYQYTLDQKSQDPSPYSWPTLEQFGATVAWPGDRPSFQVEAGPAGAPGDEDGAQEDYDMADVMDFFL

SEQ ID NO: 128452 - protein, 172 aa, Glycine max
  Coding DNA Sequence Number=SeqID_36767
  Homolog annotation: Hit_ID=Q0KIL1; Match level="QueryCoverage=55%, HitCoverage=10%, E-value=2e-07, Identity=33%"; Hit description =Gag/pol polyprotein, 3'-partial, putative
  Pfam annotation: Domain name=G-patch; Domain location=38-82; Score =13.0; E_value=0.0051; Accession=PF01585.14; Description=G-patch domain
MPYVEAAEESLETAFQSFEVVSIASVDSFSGQPCLSDTAMMVARVMLGNGYEPRMGLGKNNGGKTSLISTRGNRGKFGLGYKPTQVDIRKRVAGRKSGSQGSQLGRKVEGGPPCHISRSFISTGLGHKGQVIVICEDDAPSESDLVRPCPPDFRLGNWRVEECPDIYATSIM

SEQ ID NO: 128453 - protein, 93 aa, Glycine max
  Coding DNA Sequence Number=SeqID_36768
MHVVGHVFKVTLYKKLFGMVSRYALNEIAAEFKRVAYAGKNPSRCGCVMRSTHGLPCAWLSETQATITEEMEIISKRFEKLDVCGKIHLKSKL

SEQ ID NO: 128454 - protein, 301 aa, Glycine max
  Coding DNA Sequence Number=SeqID_36769
  Homolog annotation: Hit_ID=A5BSR3; Match level="QueryCoverage=37%, HitCoverage=36%, E-value=6e-12, Identity=39%"; Hit description =Putative uncharacterized protein
MASLTLHPPVRRHVKWKMARTKKTGEMTTEAAKEIAEKIDSFEEQATQGSFVPHGRQDVLAAAIGRLEHPGRVRAAGADVTIKQYFGSAPRTSRSASSLPPDKLQQLTQQIRDQLKESITEKVMRQGLAVPPEPLVGPGPSGPRVSTKGSCVDPSGNDPETGDSNRCGLYIEADAARLVAMGRVYEGSTLVHNTPLLPGQVKALHTFLAWPTHLVMSLSQQVAVSPPKPPPKPDPEVDDPLYLMTLTIPELFLRPYQVRWDATVFGVVNPDFPLYIKHEDLSEIAHGGQCLSISVLQLWIL

SEQ ID NO: 128455 - protein, 128 aa, Glycine max
  Coding DNA Sequence Number=SeqID_36770
MVGYTPSSFADLVFTSERIDVGPKRGKFSHSAWMNEKTGANEEGENKGETHVVTAIPIWPSFPPTQQCHYSANNNPFPYPPPNHSQRPSLNQPQSLSTTLPITNTTFSSNQNTDKEMNFAAKKPINSP

SEQ ID NO: 128456 - protein, 65 aa, Glycine max
  Coding DNA Sequence Number=SeqID_36771
  Subcellular localization annotation: CTP_CleavageSite=27; ConfidenceScore=5.28e-01
MALWSPVGLTEALTSSKLPAARVKSCPGMHSRCVIASLSGCARTVGRPLISGGGPGTDKRKLLAP

SEQ ID NO: 128457 - protein, 125 aa, Glycine max
  Coding DNA Sequence Number=SeqID_36772
  Subcellular localization annotation: CTP_CleavageSite=41; ConfidenceScore=5.32e-01
MAESSKKRKGSSSTTAPAGHRHHGPSEAPTTPIYPSLSSPRSSTLFSSDDQCLRYLSQFSSRIILDPKYLDIDFFNDETFDCYQVFQNSDLVDFMYLKFPYYPELVKVFYCNLKIQDGIISSEVH

SEQ ID NO: 128458 - protein, 146 aa, Glycine max
  Coding DNA Sequence Number=SeqID_36773
MTEGCGEGFCLANLPGDAFSLWGNFFEAKKQMMVMPSLGKPLVEIFAPRSTSWFLPVVGLARVGGAGFMAPILPTLACAPLAKSVPRWWIIMQNEREPTNGSLFWPNIVEEERDTGLIGEGRIKATRAESQWIVAARPLCHLQYPV

SEQ ID NO: 128459 - protein, 142 aa, Glycine max
  Coding DNA Sequence Number=SeqID_36774
  Pfam annotation: Domain name=G-patch; Domain location=1-42; Score =26.1; E_value=0.00013; Accession=PF01585.14; Description=G-patch domain
MVARVMLKHGYEPGMGLGKDGLGNADVVDIRGNSYKYGLGYELGMPGRRNASSRFWADSAWPDHVSQCFTSARIMYEEEVAAIGEECPQDPPSFVRPCHPDSQVGNWCVISQSEVYTADSIYEGRFFEDPNNEGLTIDFDRD

SEQ ID NO: 128460 - protein, 405 aa, Glycine max
  Coding DNA Sequence Number=SeqID_36775
  Gene Ontology: Mol. function=transferase activity, transferring alkyl or aryl (other than methyl) groups; Cellular component=cytoplasm; Biological process=aromatic amino acid family biosynthetic process
  Homolog annotation: Hit_ID=A4ATP4; Match level="QueryCoverage=99%, HitCoverage=98%, E-value=1e-104, Identity=51%"; Hit description=3 -phosphoshikimate 1-carboxyvinyltransferase
  Pfam annotation: Domain name=EPSP_synthase; Domain location=3-399; Score=189.9; E_value=6.2e-54; Accession=PF00275.11; Description=EPSP synthase (3-phosphoshikimate 1-carboxyvinyltransferase)
MKLEKSKLEGDQTIQISGSKSISNRLLILESLFNNIQIGNLSNSQDTEMLTKALSENSEVVDIHHAGTAMRFLTSYFSILEGRDTILTGSGRMKERPIKNLVNALRDLGADIEYMENEGFPPLRIKGKRITQSVVNVPANISSQFITSLLLIAGKLENGLEINLVGDITSRSYIEMTLDIITRFGIKATFTGNVIKVEPFANPSSVIHYEVESDWSSASYFYSICALGRKTIHLKSFYKQSTQGDSAIANIYEKFFGITTTFSEEEHKITLKADPDFSFPEKIELDMNDCPDIAQTLCVTAAALKIPFAISGLGTLRVKETDRLQALYNELKKIGTETEITDFTIESVSFGEPEENISIKTYQDHRMAMSFAPFCLIKELTIEEENVVEKSYPMFWKDLSTILIS

SEQ ID NO: 128461 - protein, 451 aa, Glycine max
  Coding DNA Sequence Number=SeqID_36776
  Gene Ontology: Mol. function=phosphotransferase activity, alcohol group as acceptor; Cellular component=cytoplasm; Biological process =coenzyme A biosynthetic process
  Homolog annotation: Hit_ID=Q5PDD7; Match level="QueryCoverage=54%, HitCoverage=100%, E-value=1e-88, Identity=65%"; Hit description =UPF0289 protein yacF
  Pfam annotation: Domain name=APS_kinase; Domain location=1-81; Score=- 101.6; E_value=0.039; Accession=PF01583.11; Description =Adenylylsulphate kinase
  Pfam annotation: Domain name=CoaE; Domain location=3-180; Score =319.6; E_value=5.8e-93; Accession=PF01121.11; Description=Dephospho -CoA kinase
  Pfam annotation: Domain name=DUF1342; Domain location=207-451; Score =476.1; E_value=4.5e-140; Accession=PF07072.2; Description=Protein of unknown function (DUF1342)
  Pfam annotation: Domain name=SKI; Domain location=12-187; Score= -43.7; E_value=0.032; Accession=PF01202.13; Description=Shikimate kinase
  Pfam module annotation: Pfam domain module=APS_kinase::CoaE::DUF1342:: SKI; Domain location=1-81::3-180::207-451::12-187
MPFTVALTGGIGSGKSTIANAFAALNVDIIDADVIAREVVEPGTPALNAIVKRHGESILTAEGTLYRARLREIIFQQPQEKNWLNQLLHPLINARTQQLKAQAASPYVMWVVPLLVENGLQHQADRVLVVDVDEATQLQRTRQRDGISLSQAQRILAAQASRQQRLACADDIIDNSGTPEQALPRVADFTSAIYAWQQPDGINIMSTVVLFEHPLNEKMRTWLRVEFLINQLHETLPVNSSVAALGVFRIIGDLLDIFERGDMRTELLKELERQQQKLRAWLDVPGVDEHTVSQLRDQLKQQSSELMAAPRMGQQLREDRLIASVRQRLSIPGGCCSFDLPGLHIWLHQPQALRDTLVNSWLASLDPLRNSLTMILNLIRQSGVFRHQTSLNGFYQDNAEGADLLRLQLTLEDALYPQVSGHKSRYAIRFLPLDSERGEVPARLNFELACC

SEQ ID NO: 128462 - protein, 210 aa, Glycine max
  Coding DNA Sequence Number=SeqID_36777
MTTLTQTWMMLLLSNILPSDHNSDLPLPKCQLVYAILTRMSVHMAQLIADAIYLFTGMPPTRHPLDPDKSNRALGFPALITSLCQSFRVPVTPSKAADAPPPPHQADPAGSFGMEQYLHHLVHQQAANHRGQVQIHECLYQLSLSQQSQGFDPFACPTPDHFRAEVAWPGDWPGDQTEEAPTGAPDGVEGARLDEEMTDLLDFLGGSGAT

SEQ ID NO: 128463 - protein, 99 aa, Glycine max
  Coding DNA Sequence Number=SeqID_36778
MKKFKWSELFTRMYDSGVSHIETLEIEQRKLSRNSNGHNFSLRCPIQALHISRCIKLNNGSYEEIQMVITFHLDVRFRRITYLDAQISSTEALKKCKWS

SEQ ID NO: 128464 - protein, 59 aa, Glycine max
  Coding DNA Sequence Number=SeqID_36779
MEELINKTQLSSQNNPNVITSAWRLLNRISSLHPTAVILLPRVRFTIITSINHTIQNCE

SEQ ID NO: 128465 - protein, 140 aa, Glycine max
  Coding DNA Sequence Number=SeqID_36780
  Gene Ontology: Cellular component=periplasmic space
  Homolog annotation: Hit_ID=A4WF13; Match level="QueryCoverage=92%, HitCoverage=100%, E-value=2e-60, Identity=78%"; Hit description=OstA family protein
  Pfam annotation: Domain name=OstA; Domain location=1-105; Score =123.9; E_value=4.7e-34; Accession=PF03968.5; Description=OstA-like protein
MLAASLPALAVTGDTDQPIHIESDTQSLDMQGNVVTFTGNVVMTQGTIKINADKVDNGKPVKGRATHMHYELAKDLVILTGNAYLEQLDSNITGDQITYLVKEQKMQASSEKGKRVTTVLVPSQLQDKGKGQAPAQKKSN

SEQ ID NO: 128466 - protein, 382 aa, Glycine max
  Coding DNA Sequence Number=SeqID_36781
  Gene Ontology: Mol. function=ATP-dependent helicase activity; Cellular component=cytoplasm; Biological process=regulation of transcription, DNA-dependent
  Homolog annotation: Hit_ID=P0A9P7; Match level="QueryCoverage=100%, HitCoverage=59%, E-value=1e-158, Identity=79%"; Hit description=Cold- shock DEAD box protein A
  Pfam annotation: Domain name=DbpA; Domain location=324-382; Score =63.3; E_value=8.3e-16; Accession=PF03880.6; Description=DbpA RNA binding domain
  Pfam annotation: Domain name=Helicase_C; Domain location=104-180; Score=121.3; E_value=2.8e-33; Accession=PF00271.22; Description =Helicase conserved C-terminal domain
  Pfam module annotation: Pfam domain module=DbpA::Helicase_C; Domain location=324-382::104-180
MLRMGFIEDVETIMAQIPDGHQTALFSATMPEAIRRITRRFMKEPQEVRIQSSVTTRPDISQSYWSVYGMRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLRNIERTMKLTIPEADLPNAELLGKRRLEKFAAKVQQQLESSDLDQYRALLSQIQPTAEGEELDMETLAAALLKMAQGERTLIVPPDAPMRPKREFRDRDDRFERRGDRNDRGPRGDRPERGGEDRPRRERREAGDMELYRIEVGRDDGVEVRHIVGAIANEGDISSRYIGNIKLFASHSTIELPK

SEQ ID NO: 128467 - protein, 182 aa, Glycine max
  Coding DNA Sequence Number=SeqID_36782
  Gene Ontology: Cellular component=chloroplast thylakoid membrane
  Homolog annotation: Hit_ID=Q69VD1; Match level="QueryCoverage=24%, HitCoverage=11%, E-value=9e-14, Identity=75%"; Hit description=SOUL heme-binding protein-like
MATATATATATDGNSNTLELEIRSMVQYLDTASRTLTHTIVFDEGIIHLGLFNSICLDNDGLLVAKDYGYFTNKCHSTWDEICYGKNIGFYTLSPMKQYRLGGYSYGDYSVRYIRPNRCKGPYEITTSWAMVVKFVLLPWKPQLIFTETSIMGINPENGKFYSHVVGSNYLVVVLCYQVMSF

SEQ ID NO: 128468 - protein, 53 aa, Glycine max
  Coding DNA Sequence Number=SeqID_36783
MAEDLLQVVATCPSQASEGEAHGCAFQRRKDARSRHQRLFVENVGKTEGNRSK

SEQ ID NO: 128469 - protein, 95 aa, Glycine max
  Coding DNA Sequence Number=SeqID_36784
MAPKKLSTKRSRRDATGEGSSAASEFDSHCFQSAKHQQRFEAIKGWSFHRERRVQLMEDEYPDFQGEIARRHWPRLVTPMAKFDPEIVIKFYANA

SEQ ID NO: 128470 - protein, 327 aa, Glycine max
  Coding DNA Sequence Number=SeqID_36785
  Gene Ontology: Mol. function=receptor activity; Cellular component =outer membrane-bounded periplasmic space
  Homolog annotation: Hit_ID=B0IST3; Match level="QueryCoverage=100%, HitCoverage=100%, E-value=1e-147, Identity=80%"; Hit description =Putative uncharacterized protein precursor
  Pfam annotation: Domain name=Bug; Domain location=48-324; Score =408.0; E_value=1.4e-119; Accession=PF03401.5; Description=Bordetella uptake gene (bug) product
  Subcellular localization annotation: CTP_CleavageSite=24; ConfidenceScore=5.32e-01
MKILKTVSGLAAAAAVSLFALSASAQTYPERNITMVVPFSAGGPTDTVARLVAESMSKDLGQQIIVENVGGAGGTLGAGRVASADPDGYTILLHHIGMATSATLYRKLAYDTTSAFEYVGLVTEVPMTILSRKNLETTDLKGLIDYAKANKDKVTVANAGIGAASHLCGMLFMSAIETPLVTVPYKGTGPAMTDLLGGQVDIMCDQTTNTTKQIQGGTVKAYAVTSPKRLDVLKDVPTVAEAGLPKLEVGIWHGIYTPKGTPAEINEKLSKSLQVALKDKNVAARFAELGTTPSPESDATPAALKAKLESEIARWKPVIEAAGSYAD

SEQ ID NO: 128471 - protein, 242 aa, Glycine max
  Coding DNA Sequence Number=SeqID_36786
  Homolog annotation: Hit_ID=Q6WAY6; Match level="QueryCoverage=85%, HitCoverage=41%, E-value=7e-25, Identity=31%"; Hit description =Putative uncharacterized protein
KIKGLDYHSIRSGAVMGLSECKPFARHFQLVPTVEEFEEILGCPLRGRKPYLFSGFFPSLSKVTVVVRDSARGLDRVKQTRNDIVGLPRKYLEDKARDMANQEEWVPFMDVLALLIFGVVLFPIVDGLVDLAAINAFLAYHRSKESPVVAILADLFDTFDRRVDWDQHLAGIGGRIVNWFPRWKEGNEGVLFSCGGYPNISLIGTTGCINYNSALAIRQLGYPMRGAPTEESLSPFLVRDFG

SEQ ID NO: 128472 - protein, 325 aa, Glycine max
  Coding DNA Sequence Number=SeqID_36787
MAKFDPEIVLEFYANAWPTEEAVRDMRSWVRGQWIPFDADAIGQLLGYPLLLEEGQECEYSQRRNRSDGFDEEAIAHLLCIPGQDFARTAAGKRVRIMRTNMTTLTQIWMTLLLSNIQPSDHNSDLPLPKCQLVYAMLTRMSIHVAQLIADAIYIFAGMAPTRHPLDPDKSNRALRFPALITGLCQSFGVPVAPSKVIRPPITRAFIEKYCTQRQVQGDAPQAADAPPPHQAGPAGLFDTEQYLRHLVRQQAANHRAHSQGFTSFPCPTPDQFRAEVAWPGDWPEARAGEAPTEAPAEAPDEADEAREDEEMTDLLDFLGGSGAT

SEQ ID NO: 128473 - protein, 195 aa, Glycine max
  Coding DNA Sequence Number=SeqID_36788
  Homolog annotation: Hit_ID=Q6WAY6; Match level="QueryCoverage=33%, HitCoverage=11%, E-value=9e-07, Identity=39%"; Hit description =Putative uncharacterized protein
MGTRGCINYNPVLAIRQLGYPMRGAPTEESLSPFLVRDFRAQSLKVVQKVHKAWRSPLRKDKELRGIHNGIIGGYHEWLRVHTRGLDWLSKLKVINEENFEASEEDEEVQALKLELGKARLAKEKFKSAATNIRKECAELREENAATARALEQKPRGLARKSMVEINSEELCGAATMSSSSGERKETSHEYIAWS

SEQ ID NO: 128474 - protein, 75 aa, Glycine max
  Coding DNA Sequence Number=SeqID_36789
TLVSIATLLRLEFIPQVKELLDEGLVRKSLSPCALLVPKIGFEGRSPEYEEPRDLRSNPFHGEGTDAILPFKGIG

SEQ ID NO: 128475 - protein, 143 aa, Glycine max
  Coding DNA Sequence Number=SeqID_36790
MDNEEGVQEQMKVDLSALKDQMASISEVMLKLQKTIEDKATATASSIVREAEPVLQPALNPGRDRNTEVFGRRYSPQAYPYGLLPDFTPRATPEDLSQAPTFEGQLPPYDDYPGQDDEEGDTHLGPLLHLKDPFPHELPQPNI

SEQ ID NO: 128476 - protein, 110 aa, Glycine max
  Coding DNA Sequence Number=SeqID_36791
DIMLLSRGDIPSVSTMFAKLQHFCRVSGLSISSDKSAIYSPGIRPHELSHIQQLTGFSLGKLIRAVIQEIVNFWMGIFPLPQSVLDRINALCRNFLWGKADIGKHKPLVA

SEQ ID NO: 128477 - protein, 178 aa, Glycine max
  Coding DNA Sequence Number=SeqID_36792
MASNSQQFSARSNAIVIRGVHEVATKSSSSGETKKLEGKLDVLVNLVTQLAMNKKSAPVARLCGLCSSIDHHTDLCPSVQQSEAIEQPEAYAANICNRPPQPQQQNQPQQNNYDLSSNSPYVPPPIQQQQQQQQPQKQQTVEAPLQTSLEELVRQMTMQNMQFQQETRASIQSLTNQM

SEQ ID NO: 128478 - protein, 221 aa, Glycine max
  Coding DNA Sequence Number=SeqID_36793
GLHVLTFRGLHALAIRGLHVLTLRGLHVLTIRGLHALTSRGLHVLPSPWVLVTLTVERTTRPRLERTTRPRRERTTYPRHQRTTCPRHQRTTCPRHQRTSCPRHQRAARPHLQRTTRPRLERATRPHLGGLHVLALRGLARPHHQGVGYTPSPWVLVTLTVERTTRPRLERTTRPTPSEGCTPSPPEDYMSSALEGYTPSPWVLVTLTVRGLHVLAFRGLH

SEQ ID NO: 128479 - protein, 77 aa, Glycine max
  Coding DNA Sequence Number=SeqID_36794
MSLHFSSSVNDEGSTPKDPLYKILDELRSLKLWKEKQERKEKAKREKFHWLPLAFKGMPYIGGLPLLGNEGFMGILQ

SEQ ID NO: 128480 - protein, 63 aa, Glycine max
  Coding DNA Sequence Number=SeqID_36795
  Subcellular localization annotation: CTP_CleavageSite=17; ConfidenceScore=5.14e-01
MGVQIAIRPTWVLQKAVASGGSNPARLGELGGKLLPQFSINRGRSEVFDRSSTFFIRSSVFNG

SEQ ID NO: 128481 - protein, 135 aa, Glycine max
  Coding DNA Sequence Number=SeqID_36796
  Gene Ontology: Mol. function=phosphoribosylaminoimidazolecarboxamide formyltransferase activity; Cellular component=integral to membrane; Biological process=purine nucleotide biosynthetic process
  Homolog annotation: Hit_ID=Q6DAL2; Match level="QueryCoverage=100%, HitCoverage=25%, E-value=4e-68, Identity=95%"; Hit description =Bifunctional purine biosynthesis protein purH [Includes: ...
  Homolog annotation: Hit description=Phosphoribosylaminoimidazolecarbox amide formyltransferase (EC 2.1.2.3) (AICAR transformylase); IMP cyclohydrolase (EC 3.5.4.10) (Inosinicase) (IMP synthetase) (ATIC)]
MVDASQLRVVSQRQPTEQELRDALFCWKVAKFVKSNAIVYARDNMTIGIGAGQMSRVYSAKIAGIKAADEGLEVKGSAMASDAFFPFRDGIDAAAAVGITCVIQPGGSIRDDEVIAAADEHGIAMIFTDMRHFRH

SEQ ID NO: 128482 - protein, 86 aa, Glycine max
  Coding DNA Sequence Number=SeqID_36797
  Homolog annotation: Hit_ID=Q51617; Match level="QueryCoverage=40%, HitCoverage=50%, E-value=4e-11, Identity=91%"; Hit description =Putative uncharacterized protein
MTVKTSDTCSSRRRSQLVCKRMPGADKPVRARQRMRKEKIPHQAPFAIQAAQLMGRAIRAGLLDINPAGEKVSSCSAATKSTCGSS

SEQ ID NO: 128483 - protein, 22 aa, Glycine max
  Coding DNA Sequence Number=SeqID_36798
IPRKRNNSPGIHSNSSKKDWIP

SEQ ID NO: 128484 - protein, 75 aa, Glycine max
  Coding DNA Sequence Number=SeqID_36799
  Subcellular localization annotation: CTP_CleavageSite=33; ConfidenceScore=5.17e-01
MGSKSTLRLMRTLGPSLRSLANLLGVFYPMPLRGRIASNTQERRSLEQTNQWLAPSFQWKLNKHRCVRERMRDKD

SEQ ID NO: 128485 - protein, 316 aa, Glycine max
  Coding DNA Sequence Number=SeqID_36800
  Gene Ontology: Mol. function=oxidoreductase activity; Cellular component=nucleus; Biological process=metabolic process
  Homolog annotation: Hit_ID=Q5EXK1; Match level="QueryCoverage=100%, HitCoverage=79%, E-value=1e-155, Identity=84%"; Hit description=3 -hydroxybenzoate-6-hydroxylase
  Pfam annotation: Domain name=DAO; Domain location=6-305; Score=-12.1; E_value=6.9e-05; Accession=PF01266.15; Description=FAD dependent oxidoreductase
  Pfam annotation: Domain name=FAD_binding_3; Domain location=4-316; Score=-92.9; E_value=2.7e-06; Accession=PF01494.10; Description=FAD binding domain
  Pfam annotation: Domain name=Pyr_redox_2; Domain location=6-216; Score=-45.5; E_value=0.053; Accession=PF07992.5; Description =Pyridine nucleotide-disulphide oxidore
  Pfam module annotation: Pfam domain module=DAO::FAD_binding_3::Pyr _redox_2; Domain location=6-305::4-316::6-216
MAKVMRAIIVGGGIGGAATALSLARQGIKVMLLEKAHEIGEIGAGIQLGPNAFSALDSLGVGDVARERAVFTDHITLMDAVNAQEVVHIETGQAFRDHFGGPYAVIHRVDIHASVWEAVLTHPDVEYRTSTQVVSISQTTDDVTVFDEQGNRWTADILIGCDGVRSVVRQYLLEDAPRVTGHVVYRAVIDCDEMPEDLRINAPVLWAGPHCHLVHYPLRGGKQYNLVVTFHSRQQEEWGVKDGSKEEVLSYFSGIHPRPRQMLDKPTSWRRWSTADREPVEKWGNDRITLVGHAAHPVAQYMAQGACMALEDAVTL

SEQ ID NO: 128486 - protein, 136 aa, Glycine max
  Coding DNA Sequence Number=SeqID_36801
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q2PMS9; Match level="QueryCoverage=87%, HitCoverage=64%, E-value=4e-45, Identity=81%"; Hit description=ATP synthase B chain
  Pfam annotation: Domain name=ATP-synt_B; Domain location=1-115; Score= 14.9; E_value=0.00026; Accession=PF00430.9; Description=ATP synthase BB' CF(0)
MALNSYLLTARKLKNGKILRTIRNSEELREGAIEQLEKAQARLRKVETEADRFRVNGYSEIEREKLNLINSIYTTLEQLENYKNEAIHFEQQRVINQVRQRVLQQALQGALGTLKSCLNNELHLRTVSANIGMFGR

SEQ ID NO: 128487 - protein, 101 aa, Glycine max
  Coding DNA Sequence Number=SeqID_36802
CSFGYHKERDGSWVKKDAPVRATKDCSPSPPPQRDDSSSLMHNILDRLDGLHTFVGERFDLLDCRINAMDARFAGMDTRITKLKEDVSFVRQCFDLPPPST

SEQ ID NO: 128488 - protein, 73 aa, Glycine max
  Coding DNA Sequence Number=SeqID_36803
MERSMIDAASGGALGDMTPTEARNLIEKMASNSQQFNHHTDLCPSLQQSGVNEQPEAYAANIYNRLPQQQNQQ

SEQ ID NO: 128489 - protein, 43 aa, Glycine max
  Coding DNA Sequence Number=SeqID_36804
DKIEPVSRAEALIPDDVNLSRSGSLDTGYRVWMTPLPVKEDKS

SEQ ID NO: 128490 - protein, 110 aa, Glycine max
  Coding DNA Sequence Number=SeqID_36805
  Gene Ontology: Mol. function=RNA-directed DNA polymerase activity; Biological process=RNA-dependent DNA replication
  Homolog annotation: Hit_ID=A8ND31; Match level="QueryCoverage=62%, HitCoverage=12%, E-value=4e-09, Identity=37%"; Hit description =Putative uncharacterized protein
VPMNPKRIKVIPEWPAPPSVRKIWGFQDLANFYKRFAPYFSILVAPLIELVRNHVPSWEDAQKMSFQTLPYFNILNIRVLDRKLQVDWARDAREGPRVLMSLRVDFGPMG

SEQ ID NO: 128491 - protein, 88 aa, Glycine max
  Coding DNA Sequence Number=SeqID_36806
MLNPAQFQAKEEKVKAANDSLSEADLLSEMHPLNEASNSLSGWETLEEDKSEISTPNEQPACLVWMLSLLALRAPPLAKQKFTNYRLA

SEQ ID NO: 128492 - protein, 159 aa, Glycine max
  Coding DNA Sequence Number=SeqID_36807
  Gene Ontology: Mol. function=peptidase activity
  Homolog annotation: Hit_ID=Q8H6W2; Match level="QueryCoverage=49%, HitCoverage=83%, E-value=1e-12, Identity=43%"; Hit description=Gag -protease polyprotein-like protein
MASSNPLFPEGNSIHRPPIFNGEGYHYWKTRMQIFIEAIDLNIWEAIEIGPYIPTAVDVSTSTTTQKPRDKWTEEDRRRIQNMRWNFNVLIRMKKTDKKKISIALKTSSSMQEENEEEDSDDEEDSSLFVKKFQKFVKKRRIERRQNFNNGRRSQEDSQ

SEQ ID NO: 128493 - protein, 43 aa, Glycine max
  Coding DNA Sequence Number=SeqID_36808
MPFLFLLLYSFASVHILFHDSLTTVLKVTRLCPWKSWDRLLKE

SEQ ID NO: 128494 - protein, 44 aa, Glycine max
  Coding DNA Sequence Number=SeqID_36809
MAKIQDPWKKAGSFFNEVLRGDFPSTMEMQRKTKEQEVRGGTIH

SEQ ID NO: 128495 - protein, 171 aa, Glycine max
  Coding DNA Sequence Number=SeqID_36810
  Subcellular localization annotation: CTP_CleavageSite=44; ConfidenceScore=5.64e-01
MVRLLPPRDSLTLSTSSLSSVSIPVRPPDVAPTPSPPPTKARPSSSHVNGRGPSQVHASTPSLSYVDARGPSPVPTSTPFPSPPVGSMPTNEDTINLAMEDPSLNDRPMVTLINRAFHPSNVAAKAVTLSIRQQFGQPWPTWGTIPKDQNELLFLVFIRENWSGDPRKRMK

SEQ ID NO: 128496 - protein, 214 aa, Glycine max
  Coding DNA Sequence Number=SeqID_36811
  Homolog annotation: Hit_ID=Q6WAY4; Match level="QueryCoverage=94%, HitCoverage=36%, E-value=3e-22, Identity=34%"; Hit description =Putative uncharacterized protein
MGSSQMPSLKRRFYQVKVKSLGTTSLKELGQLMGQLQRQAFHKAYGKIWDLAMVEVTTEAIAFLAQYYDQPLRCFTFGDFQLSPMVEEFEEILGCPLGGRKPYLFTGLYPSLARISKIVQISTQELDHRKQVENGVVGIPRKYLEAKARILAGKGEWAPFIDILALLIFGGVLFPNVDGLVDLAAIDAFLTDHNHKESPVVAMLAGLYDTFDRR

SEQ ID NO: 128497 - protein, 202 aa, Glycine max
  Coding DNA Sequence Number=SeqID_36812
LGELDGVPGRRAVVTDPIGSWSEQHAGGVLRRGGRPCRGIGDRLPDRGAAVRLAGDGAAARYGEVPAERRAAGGDGAAGDDARSGRRRRSGCGQGDAPRPDGGADEQGATRDRADPMTALPPALPAPDPAEARFVAGEPAELPPFSADVWSGRYVPRGILVPFRGQVGTPAPYALDTASLVVRRGGALLREGTDYVVDAVYG

SEQ ID NO: 128498 - protein, 49 aa, Glycine max
  Coding DNA Sequence Number=SeqID_36813
MSEIGRFGGLGMEERRKEEGAAQGFLENVIFIEHDAWPSVLVESITVFM

SEQ ID NO: 128499 - protein, 89 aa, Glycine max
  Coding DNA Sequence Number=SeqID_36814
MENKKNDMFIMMLRDVYAVHDMNAFTDTRARKLSLFTAHLGAQCPMCAVKKMIWIFRLPTTKDETHIQCMCDGMMHMRNRGMHKVRQYP

SEQ ID NO: 128500 - protein, 280 aa, Glycine max
  Coding DNA Sequence Number=SeqID_36815
MALRKLPSKRSRKDTVGEGSSTAPQADVDFDKHRFRSAEHQQQVQLRDDEFPNFQEEIGHRRWAPLVTPMAKFNPEIVMERPQSVLRPPADLGRGSLVQIQPEEESGHRSAIVHTGVGFRSNRYQEMGADPAHQHDHRYPDMDDLAAQQHPTQDKAYETPYRLEEVQQGPGVPSFDHGPLPVLRSARRPQQGHSASHYKSLHREVLHPQESAGLGTTAARGRLATNGRCATSATRGGTIFEMFYRYNLHQQSQDPSLFPWPTPEQFEATVTWPGDETEFE

SEQ ID NO: 128501 - protein, 84 aa, Glycine max
  Coding DNA Sequence Number=SeqID_36816
MSLPSAVHVSSTFEIGAMLHDCLSVDPQVQSSIHHFFGAPRMSLRSAIHMSSTFECGAPRMSLPSAICQFSILHFFRSPMNVIA

SEQ ID NO: 128502 - protein, 46 aa, Glycine max
  Coding DNA Sequence Number=SeqID_36817
MENWRTALRNNFAGLQTRRRMENWRTALRNNILGLQTRWWRIHEQR

SEQ ID NO: 128503 - protein, 74 aa, Glycine max
  Coding DNA Sequence Number=SeqID_36818
MKSGDMRGYRMVIRTFRQPGANEPIEAQRLTSSFAPFVIQGQRVRWQVEIPYGHPHPPPPFSRGKRIRRFTLVS

SEQ ID NO: 128504 - protein, 120 aa, Glycine max
  Coding DNA Sequence Number=SeqID_36819
  Pfam annotation: Domain name=zf-CCHC; Domain location=50-67; Score =14.9; E_value=0.0086; Accession=PF00098.14; Description=Zinc knuckle
MQEEEEKESDHEEDFSLFVKKFHKFVKNRRMERRHNFDNGKRSQEVSTTLKCYKFNRPGHIKAHCPTNESWPKKNEKKSHEERRSKKAYIAWDDNDSSDGSEKEMNILSKDYESDENISQ

SEQ ID NO: 128505 - protein, 554 aa, Glycine max
  Coding DNA Sequence Number=SeqID_36820
  Gene Ontology: Mol. function=penicillin binding; Cellular component =integral to membrane; Biological process=peptidoglycan-based cell wall biogenesis
  Homolog annotation: Hit_ID=A6BUV8; Match level="QueryCoverage=100%, HitCoverage=94%, E-value=0.0, Identity=91%"; Hit description =Penicillin-binding protein 3
  Pfam annotation: Domain name=PBP_dimer; Domain location=32-188; Score= 213.8; E_value=4e-61; Accession=PF03717.6; Description=Penicillin -binding Protein dimerisation domain
  Pfam annotation: Domain name=Transpeptidase; Domain location=226-521; Score=388.5; E_value=1e-113; Accession=PF00905.13; Description =Penicillin binding protein transpeptidase domain
  Pfam module annotation: Pfam domain module=PBP_dimer::Transpeptidase; Domain location=32-188::226-521
MVGLMLRVAYLQVINPDRLVKEGDMRSLRVQEVPTARGMISDRAGRPLAVSVPVNAVWADPKELNERGGITLDSRWKALSDALNIPLDQLSNRINANPKGRFVYLARQVNPAIGDYIHKLKLPGIYLRQESRRYYPAGQVTSHIIGVTNIDGQGIEGVEKSFDRWLTGQPGERTVRKDRFGRVIEDISSVDSQAAHNLVLSVDERLQALVYRELNNAVAFNKAESGTAVLIDVNTGEVLAMANSPSYNPNNMAGTPKETMRNRAITDIFEPGSTVKPMVVMTALQNGVVRENSVLNTIPYRIQGHEIKDVARYSELSLTGILQKSSNVGVSKLALAMPSSALVDTYSRFGLGKATNLGLVGESSGIYPKKQRWSDIERATFSFGYGLMVTPLQLARVYATIGSLGVYRPLSITKVDPPVAGERVFPEPLVRTVVHMMESVALPGGGGVKAAIKGYRIAIKTGTAKKVGPDGKYVNRYIAYTAGVAPASNPRFALVVVINDPQGGKYYGGAISAPVFGAIMGGVLRTMNVEPDALPTGDKSELVINKKEGSGGRS

SEQ ID NO: 128506 - protein, 19 aa, Glycine max
  Coding DNA Sequence Number=SeqID_36821
MQYLGSDPRLSPTSNGQPN

SEQ ID NO: 128507 - protein, 251 aa, Glycine max
  Coding DNA Sequence Number=SeqID_36822
  Subcellular localization annotation: CTP_CleavageSite=68; ConfidenceScore=5.76e-01
MRRNSPASSSDTSFLPQPSFFSERPFTGIFSFGVGIILSFCSSSIFGFPLTFEVCVGRSGGENTLPLRVTSLSPVILVTLADNELMSGASSFLSLGGAYLHGTAWLFWLRPSKTSLICALHTYMLLFTPLIADFQPASVYHLLQQGLVDKPPGCRHVLQRLGPTWPTRLDGITFSPSMIGEQVRFDVGPVLLKRQPSDVYQMLDLVFKGQAAFGGVAQDFPMIFPGDITAIWLVMRDGKRSSYVIGIGVNS

SEQ ID NO: 128508 - protein, 96 aa, Glycine max
  Coding DNA Sequence Number=SeqID_36823
MVTPRTPRVVPRAPQTDIPHVPEAGASSTSAEEPRHAVEVCDDIVERLERHLSLGVVTPSSSTHEVIEECLRLARSVTQDHLVYSRCRRRRRTDQA

SEQ ID NO: 128509 - protein, 48 aa, Glycine max
  Coding DNA Sequence Number=SeqID_36824
MLATKGIKELEKKFMKKHDKGKWSLKNNDDSLQIQKKEIPYNSNHKPK

SEQ ID NO: 128510 - protein, 70 aa, Glycine max
  Coding DNA Sequence Number=SeqID_36825
MSVKNLGGRLGVHDKTNHTISQVTLTRMLQPYGINIGLKEHSNRVTPKAYTPKSPSGPLPPDSGPTQKTF

SEQ ID NO: 128511 - protein, 176 aa, Glycine max
  Coding DNA Sequence Number=SeqID_36826
  Homolog annotation: Hit_ID=A7UQU7; Match level="QueryCoverage=56%, HitCoverage=17%, E-value=8e-11, Identity=38%"; Hit description=IMP dehydrogenase/GMP reductase, putative
  Pfam annotation: Domain name=DUF1723; Domain location=97-146; Score =49.8; E_value=9.8e-12; Accession=PF08330.1; Description=Protein of unknown function (DUF1723)
MAPVDVEDTGADIPADTGAQAAEDEHEGFPGGPSDPFVLTQYADHVACSVWTGDKRPELKLSSHGRKVHSLGRPVLAIEGLVAGTRLCPLIACLVDTSDRGLLSSFVERWHRETSSFHLPVGEVMITLDDVSSLLHLLVAGDLHAFQPLHVDDAVQMLMDLLMVSAEVARVETGQC

SEQ ID NO: 128512 - protein, 132 aa, Glycine max
  Coding DNA Sequence Number=SeqID_36827
MSNHKSTESALKNLELQVGQLAKQIADKSSNSFVENREKNPKEECKAVMTRSKRFVEAEDEESVGHKNKAAEKKGTDGKKNEVRGESNQEKEKQIMVKKNEFNDQEKENKKIEKDEKNENEEKSRSDKAVNE

SEQ ID NO: 128513 - protein, 104 aa, Glycine max
  Coding DNA Sequence Number=SeqID_36828
MVKEECKETLVSTVTPLGLEVIPQVKELLDEGLVHKSLNPCALLVPKIGIISHQIPKIGDMMNVLSGATLFCKITNAPNIFMIRVHSDSLGRFQYKPRCSYGIP

SEQ ID NO: 128514 - protein, 109 aa, Glycine max
  Coding DNA Sequence Number=SeqID_36829
MAPKKLSTKRSRRNAHGESSSASMEFDSHRERRVQLIEDEYSDFLEEIACRHWTPLVTPMAKFDPEIVLEFYANAWPTEEGTSGFDEEVIAQLLCISGQDFARTAAGRR

SEQ ID NO: 128515 - protein, 656 aa, Glycine max
  Coding DNA Sequence Number=SeqID_36830
FCRALVLILNGITPIAQRAHEDLAGVDIAHELHVDVAVALHAGRHADLLHRAGGVGVEPLPGVNPVLLDGDQAAAGIRRVDRHLDLFARLVFRLVQFQLQFGVAIQRTAQVGVAGHAVGDAVERFALRIFNHQHEVARLIGRQPQIRALPAQRQRLFRQLHFLHLRLVFVNARILFGQHRNVFLLDQYLLQIRQGDLLQIRIDGDHVQMPLRVAVDVAQIAVRLHPDQVIVRRNQRAGGRRHRAPAAGDERLRQQLQLISGVGVGFQIERDIGRAVLIGGAIFQLGFEPVAVLPIFIERIIREAIEARIHRPQRQPGAHAAILRRSTEQVLHIDAGLQLGRFDPALLTVRRQRQLHFQLIRFELLHIDRGMAEQRGGIVVFADQIQIDVPLAGRRVFIGGIAQLIETAGAQRQRHGGHQLVARIADFGAHRHAGQANAPVGGAGDQADVKGIPRPINAAIGEQVTAERARIGRRLFTGDVEAREVQPAIVIAAGRQEGDIPLLFHQEHHRLALVGVHVERRETHVAVGPGGLAEQRHAIFGHHRHVGAADRRAALNRLHKDVARLILRALGDDAQIGHHHKARIADVGLIFPSALVRFLFWLGARLFRRRFPVRLPFGQRQQEYSAMGTGVGGEIAGEIDALIVHFPRPLVVERRL

SEQ ID NO: 128516 - protein, 176 aa, Glycine max
  Coding DNA Sequence Number=SeqID_36831
  Homolog annotation: Hit_ID=Q6WAY6; Match level="QueryCoverage=95%, HitCoverage=30%, E-value=7e-10, Identity=27%"; Hit description =Putative uncharacterized protein
MGSSQKPSLKKRFYQVKVKSLGIISLKELGQLMGQLQRQAFRQAYGKIWDLAMVEVSTESIASLAQYYDQPLRCFTFGNFQLSPMVEEFEEILGCPLGGRKPYLFSGFYPSLARIPKIVQILAHELDRQKQVENGVVGIPRKCLERMGPVHRHSRTVDLWRNPLSKYGWVGGPSND

SEQ ID NO: 128517 - protein, 177 aa, Glycine max
  Coding DNA Sequence Number=SeqID_36832
MSALKEQMASMMDAMTGMRQLMENNMASVAVVSSDAEADPATAHHPLPNVVGQERSTLGHISNPHLGYNRVAYPYGLPPNYTPPVMRDDAGHVPSPILKGSLLDSRTRFTRIIESMPKETSISTPRFPLKGRHPTHCLSQTSRENLETSQHSQYSCPQKDHPQQRKKKGNSISSKRD

SEQ ID NO: 128518 - protein, 166 aa, Glycine max
  Coding DNA Sequence Number=SeqID_36833
  Homolog annotation: Hit_ID=UPI00006A2D9E; Match level="QueryCoverage =78%, HitCoverage=84%, E-value=3e-09, Identity=16%"; Hit description =UPI00006A2D9E related cluster
MTGPLDGPTSCFLIKVDPWVLVPIFFRGLHVLTIRGLHVLTFRGPHTLAFRGLHVFNFRGLQVLVVKGSYTFTFVGLHALTFRGLHVLAFRGLHVLAIRDYMSPIFKGRHALTFRGLHVLAIIGLHSLAFKRRHVLNFRGLHTLAFRGPRVLIFSVLHTHTLEEYK

SEQ ID NO: 128519 - protein, 112 aa, Glycine max
  Coding DNA Sequence Number=SeqID_36834
QILEPSPAPIHDDAIPSAPTSELEQPISQDSPAAQPLEENEHVIGIMTKNVSQFVRLIVKECIDCISVRLLAKPICRLSEPSAECTTPTAEREEESGRRMSWTHALSEGSSR

SEQ ID NO: 128520 - protein, 130 aa, Glycine max
  Coding DNA Sequence Number=SeqID_36835
MNTSSSNVSVANVIEVPFAYHRQWSSNYPSYVLFDYEGDKHFIKLHKYGNRFFFGDGLKELRRTHGIHKSVLMHFVGRDKNTTFSVDIVGPLHQRAATTIRHHVFTIDVSEDMIQHNYQLIVVVVGITNG

SEQ ID NO: 128521 - protein, 70 aa, Glycine max
  Coding DNA Sequence Number=SeqID_36836
MKIKSPKNDFKIESRTIQESRERFKRKFHQEDSRFKRKFHQEDSRFKNNQDQDSRLKDSRIRRRLNQDKY

SEQ ID NO: 128522 - protein, 22 aa, Glycine max
  Coding DNA Sequence Number=SeqID_36837
MAVEAGEEMNDLSNAEVDNDLA

SEQ ID NO: 128523 - protein, 149 aa, Glycine max
  Coding DNA Sequence Number=SeqID_36838
MVKEECKEVSVSSKRLAKKESHFAIKTNVKETSPLRQPPHLLHCKKTLVSTSTPLGLKIIPQVKELLDDGLVHKSLNPCALVPKIGIMRHQIPMIGGLMNVLNGATLFCKITHASNIFMIHISRDSLGRSYQHENIGKVINGFPQTLRE

SEQ ID NO: 128524 - protein, 203 aa, Glycine max
  Coding DNA Sequence Number=SeqID_36839
  Homolog annotation: Hit_ID=Q6WAY6; Match level="QueryCoverage=47%, HitCoverage=17%, E-value=2e-12, Identity=43%"; Hit description =Putative uncharacterized protein
MVGLSVNWFPRWKEGGAGVLCSCERFPNVPLMGTRGCINYNLVLAIRQLGYPMRGVPSEDSIASFIARGFSDPNAKMLQRVRKAWNTVQRKDKELRGSNNGVIGRYHKWLKARMQGITWLPKLKSSGGEEADVPEESEEVQALKAELERTQVVKEKFKTIDIRVRKECDELRDVNIATAEALERETKKARKEEWGQNKFRGAL

SEQ ID NO: 128525 - protein, 62 aa, Glycine max
  Coding DNA Sequence Number=SeqID_36840
MVKAREKREVVAAQLAQASSAHSGELSSPRRAGLLPPKGTTFCWNTLEGPNGPGSYLHTPFY

SEQ ID NO: 128526 - protein, 100 aa, Glycine max
  Coding DNA Sequence Number=SeqID_36841
  Subcellular localization annotation: CTP_CleavageSite=48; ConfidenceScore=5.23e-01
MHLADRRNPERNLSRKHALSTSSARSTSHLSPSSLSASLALSENSLTRAKHENDAKHDVEVSEPFFKPGIAEKRERALNSRKSLKSEIHRGKEQSKEAKF

SEQ ID NO: 128527 - protein, 113 aa, Glycine max
  Coding DNA Sequence Number=SeqID_36842
MRGAPTEESLSPFLVRDFGAQSLKVIQRVHKAWRSPLRKDKELRGIRNGVIGDWLPKLKVINEENFEAPEEDEEVQALKLELGKARLAKEKFKSSATNIWKECDAILPRKGIG

SEQ ID NO: 128528 - protein, 114 aa, Glycine max
  Coding DNA Sequence Number=SeqID_36843
EDAPQAADAPPPHQAGPAGSFDTEQYLWHLVRQQAANHRAHVQTHDCLYQLSLSLQSQGFTSFPCPTPDQFRAEVAWPGDWPEAPAEAPDEADEAREDEEMTDLLDFLGVSGAT

SEQ ID NO: 128529 - protein, 265 aa, Glycine max
  Coding DNA Sequence Number=SeqID_36844
MASRKLASKRSRKDKAAEGTSSAPEYDSHRFRSAEHQQRFEAIKGWSFLRERHVQLRDDEYTDFQEEIVRRRWASLVTPMAKFDPDIVLEFYANDWPTVEGVRDMRSWVRGQWIPFDADALSQFLGYPLVLEEGQECEYGQRRNQADGFDEEAIAQLLCILGQDFARTAAGRRVRIMRTSMTTLTQIWMTLLLSNIQPSDHNSDLPLPKCQLVYAILTRMSIHVVQLIADAIYLFAGMAPTKPPLDPDKSNRALGFPALITGLCQ

SEQ ID NO: 128530 - protein, 157 aa, Glycine max
  Coding DNA Sequence Number=SeqID_36845
MCAKARAMSEIEEVQEQMKADMEAMKEQMATMMEAMMSMKKMMEVNMAIVVATSIAIEVDPTHPSGLNPVNPPVSDIVGQRGEVLGSAGGPHFVQVQNKHSFPPYGLPPNYTPPDVAHAPDENVNNSTPIFIESQQPQSEHAHVSQPMGGGGTHEAP

SEQ ID NO: 128531 - protein, 43 aa, Glycine max
  Coding DNA Sequence Number=SeqID_36846
MGGNKRVRLAYKERLRHFGWLRWVVGVNAVITVVDEVKTKRCN

SEQ ID NO: 128532 - protein, 128 aa, Glycine max
  Coding DNA Sequence Number=SeqID_36847
MVIDAAMWKEVVGLDMGEAKNDDLQIVYGMKSGIKMNWVLLIKGIMLKSHRLVDYEFPYAVVASKFIDYFNVDVSNEIVDFTEASSENTKRHLKKLEIKFVDHEWIMTRQSTAGNFNQMEDVAKVEAP

SEQ ID NO: 128533 - protein, 100 aa, Glycine max
  Coding DNA Sequence Number=SeqID_36848
MVEHKFNTSVYKNFHGFVSREAQDLVFHELQQVDIVGTDSSACGCTLRVTRVLPCACELTKFISIYGYIPLKSIHIKTEDAPKFVKSTKYEPSKWEYVDE

SEQ ID NO: 128534 - protein, 334 aa, Glycine max
  Coding DNA Sequence Number=SeqID_36849
  Gene Ontology: Mol. function=protein serine/threonine kinase activity; Cellular component=mitochondrion; Biological process =protein amino acid phosphorylation
  Homolog annotation: Hit_ID=A7P5C3; Match level="QueryCoverage=99%, HitCoverage=78%, E-value=1e-103, Identity=55%"; Hit description =Chromosome chr4 scaffold_6, whole genome shotgun sequence
  Pfam annotation: Domain name=PPR; Domain location=125-159; Score =26.2; E_value=0.00012; Accession=PF01535.11; Description=PPR repeat
  Pfam annotation: Domain name=PPR; Domain location=160-194; Score=4.6; E_value=2.2; Accession=PF01535.11; Description=PPR repeat
  Pfam annotation: Domain name=PPR; Domain location=19-53; Score=16.4; E_value=0.088; Accession=PF01535.11; Description=PPR repeat
  Pfam annotation: Domain name=PPR; Domain location=54-88; Score=11.0; E_value=0.39; Accession=PF01535.11; Description=PPR repeat
  Pfam annotation: Domain name=PPR; Domain location=90-124; Score=21.1; E_value=0.0042; Accession=PF01535.11; Description=PPR repeat
  Pfam module annotation: Pfam domain module=PPR::PPR::PPR::PPR::PPR; Domain location=125-159::160-194::19-53::54-88::90-124
MILEWILEKMLKENEKDRDLFSELIFLCGKVKDVMLGMRVFSSMEATGVKPNSLVFNSLISVCLSSHDIVTAVSLFEIMESSESYKPDFHTYNIFISAFSKSGNVDAMLAWYSAKKAARLGPDLQMFESLISGCVNSRKFKIADRIFEEMMISGIVPSASIIESMLNGICKQKRLGRAEEFFTFAMDSGWEINENMVDKLVAMYLQLGKAEEMEGLLKTMMKPCVTTTGVLTRIHCGIVKMYAMVDRLDDIEFAVGRMLKQGLSFTSADDVEKVICSYFRREAYDRLDIFLECLKRCYVLNKSTYDLLISGYKRARLLEKVERVMEDMKSAGLV

SEQ ID NO: 128535 - protein, 67 aa, Glycine max
  Coding DNA Sequence Number=SeqID_36850
  Subcellular localization annotation: CTP_CleavageSite=51; ConfidenceScore=5.10e-01
MVMGVTTYPSAGGQRGAHGCVFHRRKMRGVATNVYSRKTSEKPERCGLRTLIMKGSGVVFMHGEDEA

SEQ ID NO: 128536 - protein, 88 aa, Glycine max
  Coding DNA Sequence Number=SeqID_36851
MCTSFVTNCHNVPFCGRARRGSRVRFPKEERCPESLPTFICGKRRENGRKPVKMKILSSGVVFTLEEGRQKRGSCSYVPSIKEEIRPT

SEQ ID NO: 128537 - protein, 123 aa, Glycine max
  Coding DNA Sequence Number=SeqID_36852
  Homolog annotation: Hit_ID=Q84VH5; Match level="QueryCoverage=61%, HitCoverage=11%, E-value=1e-31, Identity=94%"; Hit description =Envelope-like protein
MKRESPLSLHYKLFEGTHVPDIVSTSGKAASGAVSKDALIAELKDTCKVLEATIEATTEKKMELERLITRLSESGIDDEEAAEEEEEAAEEDKEAAEEEEEAAEEEEDAAEETESDDDSEATP

SEQ ID NO: 128538 - protein, 309 aa, Glycine max
  Coding DNA Sequence Number=SeqID_36853
MWSVFRKYGNIKEVFILAKKDKRKERFDFARFEDVGDERLQEGHKQESDGSWEDMKIWNECSLETEDPKDVGEYINEGTDWVFRWFEEITSWKTSHMDNEILVCLKATVQAWTYSFFKLLASLYKQFMYVKVVTEKKERLDVSRFVIRTNSLDLINYSVRVPNNLECAQEGLVEEVAKNGEQEGRKRFGLGGKLDMALGHIPIRSGLEGASESLGPLSFSHLKPKHGIPKEPSLERQLMGAGLTMKAPSGMGRRYSLGEVPSILMSRTRIVGVPPKIWGLAKVIGVDGLEPDVVYVHHIDNLKDKDADG

SEQ ID NO: 128539 - protein, 90 aa, Glycine max
  Coding DNA Sequence Number=SeqID_36854
MGELSKSDGRREQLGRMESTFVMEACFGRQRRRGERRRHPLGNKPWKKELHHQDEPWIRSLEGCFNGGKEKGRERERGEHEIEGIKEGEK

SEQ ID NO: 128540 - protein, 482 aa, Glycine max
  Coding DNA Sequence Number=SeqID_36855
MVRAFEILCPFFNIRPSVPIFLFFIQMNLTGKIGLVSLNSVSNKLFEFNSNVFHRFKDHLFKVLATNVVANGIIGNFAWRTFVKQPCCWGYPSAPSSILAKRKQDNGVGPFGCKKLRAPMGLRALRQAVEMTPGMGPPSSLQDLPPAPSVVEAPALATTVAATLAPPCPPVVPVWEVTPVVGVDALATSVSFVAASTSTVTTPLLSDDVATTSAPVMLPPHFLAPSVPPSTMLAVASPSLSSRPHVFLDHLYTSSDVDSLWAFERNLMRSARVHNATYSAKVFLFRSLAILEKNGQRHQEALHKWSSLETKVAKWRATARMVWRQECLKVANTTITFAEAISSNHQLSSKVGNVLAKLLSTWLDSDELFARCKGIVAEKDKLAKVVANLEARLKESVFGLEESELQVVEEREDNKELEEELTMYKKEDALKKAVFFAKDLNLGLFDPFKDVKDDVMLDKEEIFATEETTDEEQVLRSEAMML

SEQ ID NO: 128541 - protein, 168 aa, Glycine max
  Coding DNA Sequence Number=SeqID_36856
MRDHKAQELASVDPESTFFQVEAHVIFVELFQDLFQIYHVLGYALGFDNHVVNVDLDISFDLLLEHSVHQSLDISDAPMFMAGEVPTELHTLPVFGFELQLDELFDGLLASSRSVTARIYIEFVVHAHLVDDQGSDGRPFVHVHDLTTLSLYRVRLGRLPSGRIGCHL

SEQ ID NO: 128542 - protein, 26 aa, Glycine max
  Coding DNA Sequence Number=SeqID_36857
MEKLRFYGAVDLASFLGVSKPQVGFS

SEQ ID NO: 128543 - protein, 159 aa, Glycine max
  Coding DNA Sequence Number=SeqID_36858
  Subcellular localization annotation: CTP_CleavageSite=44; ConfidenceScore=5.33e-01
MATQLNQAQSQNSDKLPSQTVHNLKNVSAITLRSGKKIQVPPPVAAPAPQPVKLHSTPEKEDDLVAQEKKLPDHEGVNKNFHAGGPSSSSSDLQQPPITLPFPPRAIPNKKMEEVEKEILETFRKVELYMILVHDLTIGIFEKMFGVCVKIPFPRAFLI

SEQ ID NO: 128544 - protein, 248 aa, Glycine max
  Coding DNA Sequence Number=SeqID_36859
  Gene Ontology: Mol. function=zinc ion binding
  Homolog annotation: Hit_ID=O04238; Match level="QueryCoverage=81%, HitCoverage=24%, E-value=8e-24, Identity=37%"; Hit description =Transcription factor
MFSFDFRHITELHGLRNNGCQVPRSGQTRVASQQTDGPRTKLGYDKGHSCKHFWVTIPTSASLNVQQIVTASYVILSLILTNVGENITGVIVLANGSWKAVLEKDHDVDKMQEKAHNYEKEQTQPQESTCPPSTVDLTKDDDGLDSVGSWDIVERKPTSTSIHSQFVTPNSTSLGVHLGDVWLMLMLIRTLLVLIKMSDTQTIGNSELPILPDTVSPAFSQQFVGCDNNLVVNSAMHNQFSRPNNLQM

SEQ ID NO: 128545 - protein, 65 aa, Glycine max
  Coding DNA Sequence Number=SeqID_36860
MASSSSSSSHININMFHNMFGIGKKIGNYISDELFPRIKGKNKFLSKFFLFFYNLVSPGLSRWGT

SEQ ID NO: 128546 - protein, 189 aa, Glycine max
  Coding DNA Sequence Number=SeqID_36861
MKASLRSISTSTYMQRLDGLRIPDVCWMPYGEHRPIQKFDLISCYSEIDDQWMHYSDHLALAGQIYVVPGRCALEYMVLPHFSFIHDSGIAIRSADNKAITFSSTISCNLNLIPKFFPTPHLLIVLTERLWFTSENSSPLRPHASSRCGSQSTTLVHVLSHSRHISFSQQTLVHVREFTFSFISAGVKS

SEQ ID NO: 128547 - protein, 165 aa, Glycine max
  Coding DNA Sequence Number=SeqID_36862
MYQYPFEGHQSDTSPSEHSLGGVAETYPKFSWPTMTPSQQHDAPIPTPNAPLGTQWNVPGAIPDMDDLLGIDLHHQFSVEADQVEPGRHWGIRNPDRQARRWERPCGTSSRHQRHQCLSQSISLLILVDFGRPFAWSVLGSRISVHESSEGGIVASFPRGHHCAE

SEQ ID NO: 128548 - protein, 137 aa, Glycine max
  Coding DNA Sequence Number=SeqID_36863
MKKVLQNSLGDLCSVWNVMNNMMTLQHTQIKASFETNHGLCEVKVNIKEEIDRIYKRFEELDVCGKVTFKSKPREFTYLDENSMCHPPSKVNTKGAPKNLMKRSQRSTKCDPPYWEYVDLSFSSKQQHFSQTYCTIF

SEQ ID NO: 128549 - protein, 50 aa, Glycine max
  Coding DNA Sequence Number=SeqID_36864
MGELICAIARLPPSTTYDGVVPGDMSRGSRDLGDVRWGAIAQNQAWPIPT

SEQ ID NO: 128550 - protein, 141 aa, Glycine max
  Coding DNA Sequence Number=SeqID_36865
MSYTGSLSAPFHLTKRTASVYPLREKGALGQKSPTCAKRSIHALRARAKQGHLFKPEIRFCEESLDWDSELCMSKVSRERKVQVPESFERFCSPLELVGLGSSSSMDSFASCKMNGSEMEKEEREEMPLQEEDEPRRSSLP

SEQ ID NO: 128551 - protein, 244 aa, Glycine max
  Coding DNA Sequence Number=SeqID_36866
  Homolog annotation: Hit_ID=UPI000166267D; Match level="QueryCoverage =53%, HitCoverage=26%, E-value=2e-09, Identity=36%"; Hit description =UPI000166267D related cluster
GLHALAFRGLHALTFRGLHFLAFRGLNVLAFRGLHTLFFRGLHALAFRGLHVLAIRGLHVLAFKGLHTLTFRGLHVLTFRGLHVLAFRGMHTLSFNGLHAFAFRGLDALAFKGSVPRPPLDPRGEPTVQAQLEEEAIVQPLCILGQDFTRAVTKRRVRIMGRAHKTPSGPGEVQQGHGVSNSGYGPLSVLQGAHPPQQGHAIVTWGSRPQGHPVDPEKSNRVLGVSSFDYGPLLVLRSARRPQQ

SEQ ID NO: 128552 - protein, 75 aa, Glycine max
  Coding DNA Sequence Number=SeqID_36867
MGVKYLEAVKQRLHATKQWSSNEIRETGNPLPESKNSGSKFTTLCLAPPSRLAQVRGFGLSASRALSLTEDTCYS

SEQ ID NO: 128553 - protein, 24 aa, Glycine max
  Coding DNA Sequence Number=SeqID_36868
MANDNGEEVDDVHAHDYTTKLPSS

SEQ ID NO: 128554 - protein, 242 aa, Glycine max
  Coding DNA Sequence Number=SeqID_36869
VVDPLDADALSQFLGDPLVLEEDQQCEFNQRRNRADEFDEEAIAQLLCTPGQDFTRIAAGRRVRIMRTSMTTLTQTWMTLLLSNVLPSDHNSDLPLPKCMPPTRHPLDPDKSNRALGFPALITGLCQSFGVPVTPTKVIRPPIIQQAQGDAPQAADAPPPPHQADPIHECLYRFSLSQQGQGFAPFAFPTPEQFGAKVAWPRDWPEAQAGEEPAGSPGAAEEARMDEEMTDLLGFLGGSEAT

SEQ ID NO: 128555 - protein, 179 aa, Glycine max
  Coding DNA Sequence Number=SeqID_36870
MSSRSTSLEPKNLDLRRKQRKEIPNRKSGGESKKKEGKKIPDQKSEENRRNMQKGLRTRQYLNNTELSPKTNYGHSAHLFAIHTQSCLMARRDKLWSFCALLSSRGGEPDDMQRQIMVIPLTFSPFRHNRVRWHTETNYGHSAPFCHPEAVSPMTWGDKLWSFRSPFRHSDMTIVSDGT

SEQ ID NO: 128556 - protein, 54 aa, Glycine max
  Coding DNA Sequence Number=SeqID_36871
MIQICHHEQVRATTGSEELWRVTSWSKCHIGSVSCSLKSWCCCPESSSLQGIYP

SEQ ID NO: 128557 - protein, 219 aa, Glycine max
  Coding DNA Sequence Number=SeqID_36872
TTYPPSLHNLRFIDVKIIVDKVCPCLLVWDSAKKKDFKLYYNEEMPSRKVKMEIVSHLWNWSSLFSKRRLVHSPDAYDAKTFWSQLQWIDTQKVSTYGDRCRTGCHDITLQNMQIVCVRRKSTLNSVSSRSNNPCLQPSHLTTTHTPEINSVQKGSTLHNRDQLYTQEINSTHSGPTLDNSCSLHDYIAVYDSGPQVLDAGGDLSSSEKSAVKELKDNF

SEQ ID NO: 128558 - protein, 210 aa, Glycine max
  Coding DNA Sequence Number=SeqID_36873
  Gene Ontology: Mol. function=unfolded protein binding; Cellular component=cytoplasm; Biological process=response to stress
  Homolog annotation: Hit_ID=O65069; Match level="QueryCoverage=22%, HitCoverage=22%, E-value=7e-12, Identity=78%"; Hit description=Heat shock protein
MNFGLPLFWERCLVIGEDAQKGEWILRRWNRNQITSGNFGRSMPQSCLVIFGPKIKGFLVPYHHNEVLHLLPYIQSLVWSHFYSRVKIIVVGDVVCRQQLRRSPYNRLCNVRRQRQCAVNNSRHIHQINDAHYRKPVVVLEHFNVGVYDTGQVLGRGTKITLYLKEDQLEYLEERCLKDLIKKHSEFISSYQLVGLSPITLHFSNSNPHQ

SEQ ID NO: 128559 - protein, 67 aa, Glycine max
  Coding DNA Sequence Number=SeqID_36874
MQNSKRDVCLGVYLNGAYWQMVIILPKKNVVIWFCSLHNRPDNYLKGIINSALKGLDDKSKSKASAR

SEQ ID NO: 128560 - protein, 209 aa, Glycine max
  Coding DNA Sequence Number=SeqID_36875
MARIADKIKTINGSKETLKLAVRITELWFVGTPGRSKQAEMVIVDSDPLVRYFYDSQGDQIHVVCKQDQLKTWKMDLKEGSYPCLVSNSLKASKLTINQPVAPIEEFNQKLSELGIEIRSVLTCRSQWSSQPSGFAQLSSRETFISKSEAKTISEINNLCEEFVCVTIGTITRIVMDNHSWCYATCIQCHKKTNVYTEPLVCPCGKHND

SEQ ID NO: 128561 - protein, 77 aa, Glycine max
  Coding DNA Sequence Number=SeqID_36876
MVDSDDGDDMDSEDLVKITAEVVDFRRPYVVLRRSTLYGVGSMTPEWVSLSFKDQILSLFYNTLYPDTYNQEKDIKI

SEQ ID NO: 128562 - protein, 130 aa, Glycine max
  Coding DNA Sequence Number=SeqID_36877
  Homolog annotation: Hit_ID=Q2V3G8; Match level="QueryCoverage=27%, HitCoverage=9%, E-value=8e-08, Identity=70%"; Hit description =Uncharacterized protein At4g20010.2
MEVMARLLAAETFSHTVAVQVKPKHPDFKRKDGYSFWLGKDEKWVLPKLEGLQFDVPTAISKKAHMSQVMVVSPGMICGSNDFQDYFDDDKESRVKQVPKNQESKSFKNQDSRLKRRLNQDKYRKSFSKH

SEQ ID NO: 128563 - protein, 58 aa, Glycine max
  Coding DNA Sequence Number=SeqID_36878
MNVSMLTYFRFDLYLKFLLTNMEFKEAINLEVVKLFSRNLALIPLVGLSGLRIIKKRG

SEQ ID NO: 128564 - protein, 202 aa, Glycine max
  Coding DNA Sequence Number=SeqID_36879
MASCKRKATTSVSQARRNWHKELTNFSEGSIDAAFVKEFYANLYDPEDKSPKQVRVRGHLMKFDADSLNTFMHTPMVLEQGESLPSYSKFCRLRPNPQELAAWLCIPGRGFELNANGLPLKILRKNLTTLAQTWSVLSFSNLAPTSHTSYITLDRARLTYRLIIKMDINLRYIISGHISLISQHDSSRLGFPTLITALCKAR

SEQ ID NO: 128565 - protein, 172 aa, Glycine max
  Coding DNA Sequence Number=SeqID_36880
MKNFHIIAYGSVTEALRLDFSSRKRNVAKLYGLRNNALFDFQNVAELYGLRNNLSISRWSSEGCMPPNNGPRMKLGYDSGAAAILGGHHHRLELLEVDVSVTVGIDGLDHVAAFIDRALEAKVVEREADEAVAVSVKVFYDAHTVELISGDLIVAVGVKVVEDCLEFVHVFE

SEQ ID NO: 128566 - protein, 25 aa, Glycine max
  Coding DNA Sequence Number=SeqID_36881
MDTRLRVIGDPMNGVQRGWGSQLTL

SEQ ID NO: 128567 - protein, 155 aa, Glycine max
  Coding DNA Sequence Number=SeqID_36882
MVWAEEIVMIPMMLHNVDDLSHPHGGSDKPVLPTPDVEADVFSDDPMAPTDVADTGVDIPADTSTQAAEDEHEGFLGGPSDPSVLTQYADHVACSVWTGEERPELKLSSHGTKVHSLGRPVPAIEGLVVGTGLSPLIACSVDTSDRGLLSSFVER

SEQ ID NO: 128568 - protein, 128 aa, Glycine max
  Coding DNA Sequence Number=SeqID_36883
MAEPLKKRKDTSSRSQRHSGSQETPIPPFIPSGPLFSSEEQRIRYTNFFSSHSIIDPKFIDMEFFSNENFECFQAFENSNLIPFMSLKLPVYSELVKAFYSNLEIHEGTLMSEVYGIKMVIDQSLFYD

SEQ ID NO: 128569 - protein, 105 aa, Glycine max
  Coding DNA Sequence Number=SeqID_36884
  Homolog annotation: Hit_ID=Q2HW90; Match level="QueryCoverage=69%, HitCoverage=14%, E-value=1e-08, Identity=42%"; Hit description =Putative uncharacterized protein
MSSHQVENGVVGVPRKCLEVKARTLASQDEWDLFMDVLALLIFGVVLFPNADGLVDLAAIDAFLAFHDHKESPVVAILANLYDTFDRRCEKNSARIICCTPTLYV

SEQ ID NO: 128570 - protein, 44 aa, Glycine max
  Coding DNA Sequence Number=SeqID_36885
MVKYCAKSKTEMNQGARGQVRVDATSVISRSSSRVWLRTIKKHY

SEQ ID NO: 128571 - protein, 595 aa, Glycine max
  Coding DNA Sequence Number=SeqID_36886
MVIHTFCHPKTTSPMTCGGNLWLSDTFGQPDAREPVDTQRLTSSSAPFVNQGQASPYGESDDMRAYLMVIRTFCHPQTASSMTFEGTKIIFCTVCHPEMANPMTCGGSLWLSTPFVNQRDDESDDMRGYLMFIRNFGQPNANELVNTDGESDDMRRYLMFIRNFGQPKANELASEPVDTQRLTSSSAPFVIQRRASEPDDTQKLTSSSAPFFDQGQASPWESDDMWGTLVIRTFRHPESVGHMTAGSYGYSHFVIKRHRAMTCGGALWLSHLLSSSDDESDDMGVASEPVDTQRLTSSSAPFVNQGHASLLTCRDKCRFLHLLSSRDGESDDMRGKRAHLHAETNIVFYTFCHPEMASPMTCGGHLMVICTLCQQKESEPVETQRLTEGESDDMRGYLMVICTFCQPEASNPVDTQRLTLSSARFVNQRQASSLTCRDYRRLLHLLSSRDDKSDDMRGVPFGTNVVFCTFCHPETTSPMTCGDGQSDDMRGYLMVIRTFCHARASEPVDTQRLTSSSAPFVDQGQASPLTRRDKRRLLHLLSSRDGESDDMRGYLMVICTFCQQQASEPVDTQRLTSSSAPFVNQRQASPLTHRD

SEQ ID NO: 128572 - protein, 245 aa, Glycine max
  Coding DNA Sequence Number=SeqID_36887
MVNLGFEVPLEKQDLPRVDLGFYKPWRSKTHQGWTLGLTSLRRRETHQGADLGSGKHLEKQDLPRENIGSDDPLGKQDSPREDNVTLSSLLLVYPDNHDFSHQDFEPLECLPVKYVHGVSLVNEDLRHHEIGDHNGYNHGEGDFLAIVFDTIHLNILDGVEMKLLGLTRQPSIGKSIYNDVDYTFDLLGGLIFLLLLRPVSRSYWIIIDAILPRKGQVTRAMSKRLQEDWARAAEEGHRVLMNLR

SEQ ID NO: 128573 - protein, 214 aa, Glycine max
  Coding DNA Sequence Number=SeqID_36888
  Homolog annotation: Hit_ID=A5BU47; Match level="QueryCoverage=76%, HitCoverage=8%, E-value=8e-08, Identity=26%"; Hit description =Putative uncharacterized protein
  Subcellular localization annotation: CTP_CleavageSite=46; ConfidenceScore=5.24e-01
MATPPTFPPQSNQQSEAMSRNTRRSTWLRMLTRRTLDQPRPIVAVDAATGRGSGPHKEKFHNYLGVVAREKVPIVHNSWKDVPVTLKELVWNEILAKFDIPEALHAKKKVMSTTVTRWRQFKSSLTILPTLYVKPHGIRKKMQEIQKNNDCPHLLSCGGYDLLEKKLLDERMKKRKHDALLTENLALIEDLPISHSKTCQVEDGLHESIWEDDI

SEQ ID NO: 128574 - protein, 129 aa, Glycine max
  Coding DNA Sequence Number=SeqID_36889
MTSVVTSSGVSSCGGTAQASEYPFSELSCPTTCLQEVIIEILILGTDVVPDVTTSRFRTCRLYVSPLFTTFSPNHYPCNLYLRATLRYENPAHSLSIHTPVFTNKSKTHQRSTLNKRDQPYTLEINSTH

SEQ ID NO: 128575 - protein, 30 aa, Glycine max
  Coding DNA Sequence Number=SeqID_36890
MEINGSGMEKVEREEMPLQGGDESRRSSPP

SEQ ID NO: 128576 - protein, 199 aa, Glycine max
  Coding DNA Sequence Number=SeqID_36891
MSRGSRDLGDVRRAPGSQPIKEQRPQSKEACVVAGQLWILSDIWNMASGNRLPRIVMATQLIHDRVEMECLEGVWETLKGNARCRFRGTIRLTATSLVHPEEPAHTLQRTVEWILPTPTPYRLVEPVQVIEVTSSEEDPEEDPEELPPEPAVDALDFLEGDEDPLPEVDSPEDVMSASEADSTEESGHGGIATSRGSSS

SEQ ID NO: 128577 - protein, 47 aa, Glycine max
  Coding DNA Sequence Number=SeqID_36892
MVVVVYLVALIFLPFQCIFSFALAVLFRQEYLRIMTKAGVAKALGSP

SEQ ID NO: 128578 - protein, 79 aa, Glycine max
  Coding DNA Sequence Number=SeqID_36893
MYKDNWTQPWPMGSEIYPKVHENPRAFFNSSSPIFLEPLAHGSSDWSLPREDCISGPHTPSLHSSVSCIKHPSYYTMDN

SEQ ID NO: 128579 - protein, 91 aa, Glycine max
  Coding DNA Sequence Number=SeqID_36894
MGIFGETGWEWKFSWRRYLFDNELGGASAFIDQTAAISTNAALMDSWVWGAEPTGILSTNSAYNCIRPDQLFYQPNSGFRQLWEIKIPPPT

SEQ ID NO: 128580 - protein, 118 aa, Glycine max
  Coding DNA Sequence Number=SeqID_36895
MVHLLWISSSGSILVEGASTRLFIENKEGYIPCGSLLVKEFTRLKRNLKDHKSLGDSMGELSDERLGLGRCGRGDLNDDDQRNSGATESTEVTRVLFESRDYNAMPTTTVSSKARSSK

SEQ ID NO: 128581 - protein, 185 aa, Glycine max
  Coding DNA Sequence Number=SeqID_36896
  Gene Ontology: Mol. function=ATP-dependent peptidase activity; Cellular component=integral to membrane; Biological process=ATP -dependent proteolysis
  Homolog annotation: Hit_ID=A7P5B8; Match level="QueryCoverage=77%, HitCoverage=30%, E-value=2e-35, Identity=53%"; Hit description =Chromosome chr4 scaffold_6, whole genome shotgun sequence
MYLRTIFPFEGVGSEVEYTPIPSGPGSDIAKDTRNEEVSMLENVYWKEFGLLVFVWVSFLGIQIAMNQTSKCSTIYWVLNMLQIPISVGVSGYEAASLYKGRRQISSVGDQGKTFTSQQLTIYCIFGVLAGIVGGLLGIGGGFVMGPLFLELGVPPQFLYLEIIHVSPAKYTNSYLSLHIHFQFL

SEQ ID NO: 128582 - protein, 95 aa, Glycine max
  Coding DNA Sequence Number=SeqID_36897
MTRQTTLASQVTLTRNYLIVIIKKGENVTACIHDFDDAKEESNKAASKDKHYFKINTRLLQQTKPCFKISSRSSLASKQRVSKSPKALVIDYQTV

SEQ ID NO: 128583 - protein, 153 aa, Glycine max
  Coding DNA Sequence Number=SeqID_36898
MESTKEVVMILHEIRRPNSLKTVPSGVTNCRNLPFDGRATWGSRVRLPREEGARSRHQCLFEENVGKIGKVWSTNFECERRKEGGGCRPTSPGELSSPKRAGLLLPKGTIFCWNPLEGPSGSGCYLHPHLDKFTPVFRNLWKSYRSLTEAYRT

SEQ ID NO: 128584 - protein, 764 aa, Glycine max
  Coding DNA Sequence Number=SeqID_36899
  Homolog annotation: Hit_ID=A2Q4W6; Match level="QueryCoverage=42%, HitCoverage=47%, E-value=5e-18, Identity=24%"; Hit description=RNA -binding region RNP-1
  Pfam annotation: Domain name=RRM_1; Domain location=120-191; Score =21.4; E_value=0.0016; Accession=PF00076.13; Description=RNA recognition motif. (a.k.a. RRM, RB
  Subcellular localization annotation: CTP_CleavageSite=39; ConfidenceScore=5.04e-01
IKRSNNHGPPVAGRTTPKGCKPPNSYDPPKGCKGCKVRRCESRGHDPWEQSQPTVMIRPRGASTEQENANDNNANFGDWIEVSRKRRKRAEENSSRVVGNGKQRRYKNLHRRDHEDVTTFYFSRFPDGTRETDLWKIFQKWGRVREVFIPKYKNKEGHKFGFVRFKEVMDERRLERDLDNNIFIDGMKLFVNRPKFDRGRVFRAKPFEEPLQKMPSCQEKHNGKQLGDKAPCYDGEPRSYLDVVKETTRAKGSSYLMKEDPQGDTIEIQRLVVLNSTKEDREWLEKAWIGRLKNRGMFEKLEEELRWVVDREVNPCYWGDDWIILPGMDESNANRWINAELKNGSTPIMDLQKWSPDIRPEFRLTWVLLRGLPLSVWKPEYMKKVMEDIGEMVEVDDYVEERRRMDVARTLIRTNQRLGFHESVRAMIDGEEHQLTVVEDMSSMGAKMKSYQNHSWFPPSPVSTPPNTPLPFTDDTPGRDSGNDDSGDSDAELDGADTGTPNHWHNSRLSKRRPSKLHRDHWVKPHGRSPSVRSISDVADVDHSKVVNAGGNSDLPRGVDSELHNGHITHSGKACINEGESQKWTNINIVSSSQKNDATQEGRAGQTYEEKKESSTIDAKGDREEVWPIEKGFPHRVHALNIKEAGANFHFGRHAVNEAIGEVGLKIKGPIKSATKVYVRRKEVQLSHGKAQYSQGPDVESVLVPEADHTLAVQGDKIDQELSLIRDLGLTYGGDDKEIKEILKDMDNKDTMKAAAMGIKNQIL

SEQ ID NO: 128585 - protein, 235 aa, Glycine max
  Coding DNA Sequence Number=SeqID_36900
MSYHTFTAALSTCGGIKGEEDIVGRSIWRHRNNVIFSDQQPHVKQLLHSIEFISWAWMRAKPEKFGATYYDWMIQPKQCLAAVKASDRKRQTNLIKSIIDGMRGTVTEGVLYQFVAKIAMDDAELGMERRCGGECGKGRERERVRQRGFESVNARGQRNGGGSVDSSSGMVVVAPTTIVGWNSSGGDNNDGGGGMATKVRCSGDAILPPRALDIRLQEDWTRDARKGPRVPMNLR

SEQ ID NO: 128586 - protein, 70 aa, Glycine max
  Coding DNA Sequence Number=SeqID_36901
MAYSLVDGASPLLFSFAFRCISMVGKSPLKDLIEAQRSSLHRSSTSKLPSLGLAPELHWSVKKQGMQRGR

SEQ ID NO: 128587 - protein, 185 aa, Glycine max
  Coding DNA Sequence Number=SeqID_36902
MASPMTHRDQYGHLLPLLKTRCLSIETTLVSLRHPETTSLMMRRDQHGRLYPLSKTQHLSNETTLVSPFVSQRQASRQRHASMLTCRDQYSHLLFSSKTQCLSIETTLVSISSTRGKQACRNVPFCGRARARLTGALSKGGKMRGVATNEGISTSHVNKSGALAPTYPPSKRKSDLRSSSLCVNQ

SEQ ID NO: 128588 - protein, 107 aa, Glycine max
  Coding DNA Sequence Number=SeqID_36903
MGETDEVQEWIKANLEAMKEQMATMMEAMMSMKKIMEVNAATIAATSAVAKVDPTPPSSLNQINHPTSDMVMEAKNWEVRAAPILCKFRASMPSYHTACPPTMHHPV

SEQ ID NO: 128589 - protein, 138 aa, Glycine max; identical to SEQ ID NO: 126160
  Coding DNA Sequence Number=SeqID_36904

SEQ ID NO: 128590 - protein, 67 aa, Glycine max
  Coding DNA Sequence Number=SeqID_36905
MARNKSASCPYSRGLYGRELTRLLVIIPKVVRSVLMVFRGIIPFEEHIAAVGTTSNNMLSKRKTLDE

SEQ ID NO: 128591 - protein, 122 aa, Glycine max
  Coding DNA Sequence Number=SeqID_36906
FVGDLEGRFLHFDIQSTGQKSLDCSTPGEEAPKGPFPIRPPTGTRRPALAAEAARAVHRQPTGSGLGPPCPALRANPFPEYDRAWEALGPPDFQGPPGAHRTPLDVRCSSSRWTLPPADPFP

SEQ ID NO: 128592 - protein, 51 aa, Glycine max
  Coding DNA Sequence Number=SeqID_36907
MAYTHIPPLARIQLDLAPYASELLLNEPPGLNDDKHTIALRVVFSETQWKG

SEQ ID NO: 128593 - protein, 25 aa, Glycine max
  Coding DNA Sequence Number=SeqID_36908
MAEINQGKTMTSHDWPRIVCLLLAG

SEQ ID NO: 128594 - protein, 91 aa, Glycine max
  Coding DNA Sequence Number=SeqID_36909
MGVQIASRPTWPSRIFLQNAVASGGSNPARLGELGGKHLPYFAINRGGSEEEKAEALPKHFRNIFREEFRKGFDRSSTFFIRSSSFFDLQR

SEQ ID NO: 128595 - protein, 63 aa, Glycine max
  Coding DNA Sequence Number=SeqID_36910
MEKMIKNKELKPWIFFINGVLFFLKVNGSGIEKEERTSSPPQEAMDRSLKVGEDEYWERERGQ

SEQ ID NO: 128596 - protein, 58 aa, Glycine max
  Coding DNA Sequence Number=SeqID_36911
KQQTIINKERKRERRRHFKEKMSLEEAHHHRRPWIRAWRKKEMNEGRGREEHEILCSK

SEQ ID NO: 128597 - protein, 88 aa, Glycine max
  Coding DNA Sequence Number=SeqID_36912
MTQESGSMRRYLIVIRTFCQLEANEPVDTQRLTSSSAPFVNQGQAKPVDTQRLTSSSAPLSSRDGESNDMRIYPSGYPYKTISVNPDP

SEQ ID NO: 128598 - protein, 137 aa, Glycine max
  Coding DNA Sequence Number=SeqID_36913
AKARILAGRNEWAPFIDVLALLIFGGVLFSNVDGLVDLAAIDAFLAYHNHKESRPVYPLQGHRSCIEKGKANWDQLLASMEGRLGCINYNPVLAIRQLGYPMRGVPSDESITPFIARGFSDHNARVLQGVRKAWDAA

SEQ ID NO: 128599 - protein, 87 aa, Glycine max
  Coding DNA Sequence Number=SeqID_36914
VVIIKKGETLEAKLHGESKVIQRCFDDNNDDDKGNDKKLKDQSKKNSSESRTIQEFKIRIQDSSRKSRDKNQDSRFKISRIKIKIQE

SEQ ID NO: 128600 - protein, 67 aa, Glycine max
  Coding DNA Sequence Number=SeqID_36915
MSSWHRECQSPPAKSSDPPTNRAFIKKYCAPRQAQGETPQQPGDGQQRATDAPPSPLEFTSAHPQKG

SEQ ID NO: 128601 - protein, 139 aa, Glycine max
  Coding DNA Sequence Number=SeqID_36916
LCQSFGVPVAPTKVIRPPITRAFIEKYCTQRQAQGDAPQAAGTPPPPHQAGQAGAFDMEQYLRHLVRQQAANHRAHSQGFASFSCPTPDQFRAEVAWPGDWPEAQAGEAPPEAPGDGEEAREDEEMADLLDFLGGSGDT

SEQ ID NO: 128602 - protein, 49 aa, Glycine max
  Coding DNA Sequence Number=SeqID_36917
MVLTSAPSLKVSILRRCLHQQRLRMPTFKDVVECINYQEGLSGFHNVNL

SEQ ID NO: 128603 - protein, 125 aa, Glycine max
  Coding DNA Sequence Number=SeqID_36918
MIIIKTSKPIASTVPTDTTVSECKGVRIPMTKLGLCVPSDTTVSEWQRGADNRKVSPRIIMTKLGLCVPSDTTVSEWQRGADNRKVSPRIIMTKLGLCLSSGPPPLDDKRGADNHKVSPRIMGAE

SEQ ID NO: 128604 - protein, 87 aa, Glycine max
  Coding DNA Sequence Number=SeqID_36919
  Subcellular localization annotation: CTP_CleavageSite=30; ConfidenceScore=5.25e-01
MQQGQADILIARFPDPNYGVKTRSLSRSCLSVQRKSLLRQNERNFSIGFENKVKGNIRGQIPLSKHKGMRVFRVLQKGNMFLKFRSR

SEQ ID NO: 128605 - protein, 129 aa, Glycine max
  Coding DNA Sequence Number=SeqID_36920
MGYYFYQPSNHKVFVARGANFLEREFLVEGNHSKEIELDETQVTNDNITQEHEMETERPFFDVLKLGQNSSTQTIMAQEPAIVQEQVVVQEEVNEPILEQLQQPLNPTQEPLRKSTRMHRAPDKLNLMV

SEQ ID NO: 128606 - protein, 135 aa, Glycine max
  Coding DNA Sequence Number=SeqID_36921
MSRKGPSMKNLLGDLSEEAKGEKSSEEIYPQEEGQPLVVKEKCKEVSVSSKSLAKKETHFTIKTNIKETFPLRQPPHFRFCKKTLVSIATPLGLEFIPQVKKLLNEGLVCKSLNPCALLVPKIGIIRHQVPKIVV

SEQ ID NO: 128607 - protein, 60 aa, Glycine max
  Coding DNA Sequence Number=SeqID_36922
MEVDEPWLGLWLPLNYQVDMGANFVVDLGMAFVDNWVVGKEKVCYWLSNDIVGLVGNLAV

SEQ ID NO: 128608 - protein, 145 aa, Glycine max
  Coding DNA Sequence Number=SeqID_36923
  Homolog annotation: Hit_ID=A5AZ88; Match level="QueryCoverage=34%, HitCoverage=4%, E-value=2e-07, Identity=44%"; Hit description =Putative uncharacterized protein
MDIEEDDEIPLILGRPFMLTANCVVDIGKGNLEMGIDDQKITFDLFDAEKNLLDRNPRLLQTLEVICVKLVTLKKCLLGGNLSQHALLWACEARFTGALSKGGKMRGVAPNVDKSGAFAPTYPLSKRKSDLRSSFLRVNQAIPFT

SEQ ID NO: 128609 - protein, 116 aa, Glycine max
  Coding DNA Sequence Number=SeqID_36924
MSRKRYGSASAWIFFTETIFLTNFKRILNTRRAERNYSTLFPLFIGEKREVVASTSRHHLLLEHPGRPKTLRIARQCSLSTSGMSRNFTDYLTMGVKYLKAVKQRLQTIKQWCRTK

SEQ ID NO: 128610 - protein, 156 aa, Glycine max
  Coding DNA Sequence Number=SeqID_36925
MHRSPIGSLVPLDLEIEATLKRNRAERRTKLLQDRTTTSILEEEAQSSDSTSSDSQSSRESATDLSEAFFMVEEHQYRVTLEDYSSSSVPQFFTREAKKWLHSFKGNSLKMWEEVVEKFFEEILSRVKDCRKEKLLFHHFTSSLMSPLSGALERFR

SEQ ID NO: 128611 - protein, 203 aa, Glycine max
  Coding DNA Sequence Number=SeqID_36926
  Homolog annotation: Hit_ID=A5BVL8; Match level="QueryCoverage=81%, HitCoverage=43%, E-value=3e-10, Identity=28%"; Hit description =Putative uncharacterized protein
  Pfam annotation: Domain name=zf-CCHC; Domain location=23-40; Score =29.8; E_value=1e-05; Accession=PF00098.14; Description=Zinc knuckle
MRGSQRRQNFKPKRRTEESSQIPKCFECNQPGHLRADCPIFKRKIEKSEKKTIGDKKANRAYITWDDNDLESSDDSEKEMINLCLMGKNHESKEEVTSSNKSISFDELQDAFAELRSESIKLAKLVSSSKKTISDLEKEISKLNKEIDILKTEVSISKSSDKVHVSTMTNEKGENVNVCIHDFDDVKEESNKAASNDKHLLQE

SEQ ID NO: 128612 - protein, 281 aa, Glycine max
  Coding DNA Sequence Number=SeqID_36927
  Homolog annotation: Hit_ID=Q095D1; Match level="QueryCoverage=98%, HitCoverage=56%, E-value=2e-14, Identity=32%"; Hit description =Putative uncharacterized protein
MRCARRPGPSARYHGGAIAAHFEGAVGIGRVGLPGAVGAERDGFGPASARNHPVQRVGVGGADDAAGSRDGAYQVVELGFDGRQIREDVRVIVFQVVQDGGARAVVDELRTLVEEGRVVFIRLDHEGAARGVVARRYVQVRRDAADQEVGGETRGFQDPGQHRTGGGLAVGAGHRQHMGAGQDVVAQPLRARHVAGAGFQDGFHQRIAAADHVADHVQVRLEGHLFGAEALDQLDALFGQLGAHGRINARVATRDLVAGGARDQRQAAHERTADAKNMQMH

SEQ ID NO: 128613 - protein, 46 aa, Glycine max
  Coding DNA Sequence Number=SeqID_36928
  Homolog annotation: Hit_ID=A5B7I7; Match level="QueryCoverage=78%, HitCoverage=4%, E-value=4e-09, Identity=77%"; Hit description =Putative uncharacterized protein
ECGIIPQYTMSGSPSMNGVAETRNKTLKDMRQGLISQMKGNWTLEQ

SEQ ID NO: 128614 - protein, 227 aa, Glycine max
  Coding DNA Sequence Number=SeqID_36929
MQNFAVKISATGFWLAQKNACAWLAVERVVQNEFWMFAMRKAVILVDVLSRVFCLCSVLLGCDSLCCLNVVLLGCCGSLGGLMGTRGWWVYARIVDVENLLCTIARPPPSTTCDGVVPGDMSRGSGDLGDVRRAPGGQPIKEQRPQSKEACVVVGQLWILSGIWNFASGNRLPRIAMAAQLIHDRVEMECLEGVWETLEGNERCRFRGTIRLTATSLVHPEEPARTL

SEQ ID NO: 128615 - protein, 70 aa, Glycine max
  Coding DNA Sequence Number=SeqID_36930
MASSGVLSFILPPIEASKSLLDCGLNPSMKIFSCMGSENPCDVNLTRSRPLDTGYGDLDDATSKEEDKSG

SEQ ID NO: 128616 - protein, 105 aa, Glycine max
  Coding DNA Sequence Number=SeqID_36931
MSVKCSKVINQGHMPTNNGPQTNLGYGNPITVPKTQETLRERLRSQDYLNEATKGRIEGIFSIESLRWILRIPLRLKRSSWCRGSAASNGGLWWPPVVVGGGRRC

SEQ ID NO: 128617 - protein, 102 aa, Glycine max
  Coding DNA Sequence Number=SeqID_36932
  Subcellular localization annotation: CTP_CleavageSite=34; ConfidenceScore=5.00e-01
MPLRALADLGMNSTSRLSQTKVTIPGYNADSQPSARFVSCVCQTWDLKTENEKYQMGETRYFNEIYYLTKMAVSPSACHDHNYQDSTVFCFAAATPFLTCPH

SEQ ID NO: 128618 - protein, 390 aa, Glycine max
  Coding DNA Sequence Number=SeqID_36933
  Gene Ontology: Mol. function=ATP-dependent helicase activity; Cellular component=cytoplasm; Biological process=regulation of transcription, DNA-dependent
  Homolog annotation: Hit_ID=Q7MYZ2; Match level="QueryCoverage=83%, HitCoverage=49%, E-value=1e-123, Identity=74%"; Hit description =Inducible ATP-independent RNA helicase
  Pfam annotation: Domain name=DbpA; Domain location=233-317; Score =148.8; E_value=1.5e-41; Accession=PF03880.6; Description=DbpA RNA binding domain
  Pfam annotation: Domain name=Helicase_C; Domain location=22-98; Score= 122.0; E_value=1.8e-33; Accession=PF00271.22; Description=Helicase conserved C-terminal domain
  Pfam module annotation: Pfam domain module=DbpA::Helicase_C; Domain location=233-317::22-98
EDFDAAIIFVRTKNATLEVAETLERNGYNSAALNGDMNQALREQTLERLKDGRLDILIATDVAARGLDVERISLVVNYDIPMDAESYVHRIGRTGRAGRAGRALLFVENRERRLLRNIERTMKLTIPEVELPNAELLSQRRLAQFAAKVQQQLESSDLDQYRALLAKMQPEEELDMETLAAALLKMAQGERPLILPPDAPRPQRREFRDRDERGGDRPRRDSRDSREGGDRPRRERRDVGEMQLYRIEVGRDDGVEVRHIVGAIANEGDISSRYIGNIKLFGTHSTIELPKGMPGEVLQHFTRTRILNKPMNMQLLGDAQPHERTERRSGGRDFGGERRGNREGGNREGGAPRRFSERREGGREGGRFSREGGRGPRRDEGAAAPRRRDA

SEQ ID NO: 128619 - protein, 165 aa, Glycine max
  Coding DNA Sequence Number=SeqID_36934
MLQSSIETQGIDRRRDTVEAEEYSQQMAERGHGMYYTPQTFAEYPTQMYQYPFQGHHTDTSASQQSFGGVAETQAHFSWPTMTPSQQYHGPIPTPNAPLGTQWNVPGQIPNTGDLFGVDLRHAFSAEADEEEAGRHRGRRNSDRQSRRWDRPCGTSSRHHGHQNE

SEQ ID NO: 128620 - protein, 85 aa, Glycine max
  Coding DNA Sequence Number=SeqID_36935
MGESKKKEAPGQRNQKKCVERSLDRTISEQIQNCHQMNKKGRKGNHDLKWSSPFDYQPKSRNNLQSQVMIYLWFGIRMKHLPVRD

SEQ ID NO: 128621 - protein, 104 aa, Glycine max
  Coding DNA Sequence Number=SeqID_36936
MLRNFMDYATRLFLTSGMLQNFTDCATMLPFNFRNIAELHGLPNDGSASREKRRLQLLELEEMKFIAYESSNLYKERVQMYHDKKLLKKDFYPGQPGVAFQLKT

SEQ ID NO: 128622 - protein, 58 aa, Glycine max
  Coding DNA Sequence Number=SeqID_36937
MACLDFRCCHHQKGGDCRQKIKLKVLMMPKDYMNHMLLKDLLKTKQLELIKMDDQDSL

SEQ ID NO: 128623 - protein, 103 aa, Glycine max
  Coding DNA Sequence Number=SeqID_36938
MKSGDMRGYRMVIRTFRQPDANEPVDAQRLTSSSAPSVILTREVLLLSSRDIQVRQRARFFSARQGRSSSIACGNVMVIPFYRFRGIEVLLTLLMPFLFFFPE

SEQ ID NO: 128624 - protein, 137 aa, Glycine max
  Coding DNA Sequence Number=SeqID_36939
MEGLVDLAAIDAFLAFHHGKESPVDAILAMYDTFDRGGEKSGARIVCCALALYVWLVSHLFLQEGRKNRDSIFIRKMSKGSLDGTRGCINPVLAIRQLGYLMRGVPSDESITPFIARGFSDHNARVLQGVRKAWDAA

SEQ ID NO: 128625 - protein, 212 aa, Glycine max
  Coding DNA Sequence Number=SeqID_36940
  Gene Ontology: Mol. function=transporter activity; Cellular component= membrane; Biological process=transport
  Homolog annotation: Hit_ID=A1FW83; Match level="QueryCoverage=99%, HitCoverage=44%, E-value=7e-94, Identity=83%"; Hit description=RND efflux system, outer membrane lipoprotein, NodT family precursor
  Pfam annotation: Domain name=OEP; Domain location=61-211; Score=21.8; E_value=0.0006; Accession=PF02321.9; Description=Outer membrane efflux protein
  Subcellular localization annotation: CTP_CleavageSite=42; ConfidenceScore=5.07e-01
MVIRTLAMAVSSLVLAGCVSVGPNYKAPVQEPVVLRGAQQPVFSTTSPVASWWAQFDDPVLEQLVHGALSDNLDLRVAVARVSQARAVFVESRFDQAPHITAGGSYDRRKQPDPQLGGQRVFSESYQLGFDAGWELDLFGRKRRAAEAARADLDAEQANLADAQVLVAAEVARNYFELRGTQKRIAVAQHTLVNLRDTQKLTEARWELGAGQ

SEQ ID NO: 128626 - protein, 25 aa, Glycine max
  Coding DNA Sequence Number=SeqID_36941
KVKTKGAQKKSMTKHQKSTKRDPSY

SEQ ID NO: 128627 - protein, 289 aa, Glycine max
  Coding DNA Sequence Number=SeqID_36942
EGVRDMRSWVRGQWITFDADALNQFLGDPLVLKEGQECEFSQRRNRVDWFNEEAIAQLLCIPGQDFARTAAGRRVRIMCTSMTTLTQIWMTLLLSSVLPSDHNSDLPLPKCQLVYAILTWMSVHVAQLIADTIYLFVGMPTTRHPLDPDKSNRALGFPALITGLYQSFGVPVTPSKTHRHRLIRLIPAGSLGMERYLQHLVRQQAANHRGQVQIHDCLYQLSLSQQGQGFVPIACPTLDQFRDEVAWLGDWPEAQAGEAPAEAPGDAEEARMDEEMMNLLGFLGGSEAT

SEQ ID NO: 128628 - protein, 274 aa, Glycine max
  Coding DNA Sequence Number=SeqID_36943
  Gene Ontology: Mol. function=transcription factor activity; Biological process=regulation of transcription, DNA-dependent
  Homolog annotation: Hit_ID=A8GGC0; Match level="QueryCoverage=77%, HitCoverage=69%, E-value=2e-35, Identity=42%"; Hit description =Transcriptional regulator, LysR family
  Pfam annotation: Domain name=HTH_1; Domain location=5-64; Score=77.5; E_value=4.2e-20; Accession=PF00126.18; Description=Bacterial regulatory helix-turn-helix protein, lysR family
  Pfam annotation: Domain name=LysR_substrate; Domain location=88-271; Score=-2.5; E_value=0.0064; Accession=PF03466.11; Description=LysR substrate binding domain
  Pfam module annotation: Pfam domain module=HTH_1::LysR_substrate; Domain location=5-64::88-271
  Subcellular localization annotation: CTP_CleavageSite=21; ConfidenceScore=5.27e-01
MNNKLNAISTFLCVAQAGSFSAAARQSGMKQSAVSQQIAALEQELGVVLLHRTTRTMKLTEQGERYRRDMQLLLDAMREAERRLNPVDHQFQGSVHVQLPSGLGQIVLPHLLTLQRLHPELHLMISLDDRIADLVTEGVDVAIRLSSEPPQAHAARVLARIETALFAAPGFPAVDDVSELATLPHVRFSGIPPDVPLRLIAAEETLEVKRRAVTGAGGRHRDRRPAAPACGPRAAGRHAGTGIARLAVTRPRSLCRLPRRALYSTTRPQRRGRD

SEQ ID NO: 128629 - protein, 195 aa, Glycine max
  Coding DNA Sequence Number=SeqID_36944
MTLLLNNVLPSDHNSDLPLPKCQLVYAILTWMSIHVAQLIADAIYLFAGMPPTRHPLDPDKSNRALGFPALITGLCQSFGVPVTPSKVIRPSITRAFIEKYCTPRQAQGDAPQDADAPPPPHQADPAGSLGMERYLQHLVRQQAANHRGQVAWLGEWLEAQAGEALAGSLSDAEEARMDEEMMDLLGFLGGSGAT

SEQ ID NO: 128630 - protein, 55 aa, Glycine max
  Coding DNA Sequence Number=SeqID_36945
MGVQIATRPTWAFQKIPPEGGCFWRKQPSSPGELGGGEVKGKNVQPFWYFEITKN

SEQ ID NO: 128631 - protein, 194 aa, Glycine max
  Coding DNA Sequence Number=SeqID_36946
MSALKDQMASMIEAMLGMKRLLESNAATAAATSTAAKADPVLPSTTNLAHQLAPDMVGRGRDALGNANSPHLGYNQSAYPYRLPPNFTPPVMHENANHPVGGACEESREHAQGDVDSYPPFTTEGLAPNALPQPNIAGVSQARPMQPLLFSVEGPPPTVEGREKLDLIKERLRAVEGFDDYSFADMTDLCLVPD

SEQ ID NO: 128632 - protein, 171 aa, Glycine max
  Coding DNA Sequence Number=SeqID_36947
MGIDQSLFYDLTQLSSEGVPFEGTLIDDWKYDFSVHDARRLVCTNQADMTGRLLAGSLAFESRILHYLIVRILLPRSSNLAQVSEEDLIVMVLNPLMKKDIYMVEKIPLFFKRFWTGSMVFKPLLVKGLILWSYKWTVRFNEMESKITKVEENVSYIRTSFDLPPPPPPSS

SEQ ID NO: 128633 - protein, 136 aa, Glycine max
  Coding DNA Sequence Number=SeqID_36948
FSIKSQETESAIRNQEVQVGHLAKQLAKTSTNIFRANTEKNPKEECKVIFIKSRRRENAEREKRAKGVLEDVSNEEGENNKIEEGDEEKEESKEKGEKVLPTKTKSQLAMEARKEIPLVPVKDIPYPLVPSKKDKE

SEQ ID NO: 128634 - protein, 54 aa, Glycine max
  Coding DNA Sequence Number=SeqID_36949
MCIIDIGDLSIEKIHRPETKRKKGRSVWEVRSSLDISSSVKIVDVKTQRQKADL

SEQ ID NO: 128635 - protein, 257 aa, Glycine max
  Coding DNA Sequence Number=SeqID_36950
  Homolog annotation: Hit_ID=Q6WAY6; Match level="QueryCoverage=48%, HitCoverage=21%, E-value=2e-13, Identity=34%"; Hit description =Putative uncharacterized protein
MVSHLFQQDTRHPCPLQSHRSCAEKRRIDWDQLLAGVGGRTINWFSRWKEGKEGVLFSCKGYPNIPLIGTRGCINYNPALAIRQLGYPMRGAPMEESKSPFLVRDFGAQNFKAIQKIHKAWETPLRKDQELRGIRNGIIGGYHEWLKVHIRGLDWLAKLKVVSEDSFEAPEEDEEVQALKNELGKAKLPQENATHIRKECAGLREENATTARALEQETKRARKEEYGRNKFCGALWGSNNELKLRREERDQSRSSVG

SEQ ID NO: 128636 - protein, 293 aa, Glycine max
  Coding DNA Sequence Number=SeqID_36951
  Gene Ontology: Mol. function=RNA-directed DNA polymerase activity; Biological process=regulation of transcription, DNA-dependent
  Homolog annotation: Hit_ID=A7NWH9; Match level="QueryCoverage=93%, HitCoverage=23%, E-value=6e-48, Identity=38%"; Hit description =Chromosome chr5 scaffold_2, whole genome shotgun sequence
MEPEFWDKNPFKATAKAFPPGFHYKPTTILKTRTFYELILVDSNSVSIKHFKDPKDQTLNTHSTIQILKVLQPRHFGSDLNKGKRFSVPFDPVGYTYWDYVDAWTKVFWHQNTRFKHSWLIYFKTNTIYNFPNWFLQWWDFFGPIPEIFPETVQQGFSQFKKQYNSQESRIPADLKYFSSFALSWIFSWQYRYSKTEKTNQYPSLQRHAFVKWWTQFDSSKADPEQVKLWFQSHPEFLKAADPETSVFLNQKSHLAAFLAGSTSKEVLAKNLKEVLQMLQQEEEASSSKKEET

SEQ ID NO: 128637 - protein, 148 aa, Glycine max
  Coding DNA Sequence Number=SeqID_36952
RRHPVENKPWKEKLHHQESALDKKLREEPSMEEENERESISRIFPLDLMMKSIQFQVKKRLSHEVLKVIVELSSSIGLSVYPPLSAASVLIARQKNLAEHQCQARLNARLVLSSNPLTRAKREGGAKAHHNAYFGKRALEAARGAAFA

SEQ ID NO: 128638 - protein, 215 aa, Glycine max
  Coding DNA Sequence Number=SeqID_36953
  Homolog annotation: Hit_ID=A5AZ88; Match level="QueryCoverage=77%, HitCoverage=15%, E-value=7e-14, Identity=31%"; Hit description =Putative uncharacterized protein
MNEHDLEEEDEEKVQQREQCLQTHTQQEDNFQVNTCSHQLTIKEERHEDHEGSIILRQLYLPFASCVSTWDQKIAFDLIESIKHPDDGEDWFEAKISEHEMELTASAMILQTPGEKEFEYVTKCLVNEEGGRMLACIESLGDPDDESISHVMFEELENNRPKEKPKVELKTLPAHLKYVFLEDNETKPVIISISLQKKEEDQLVQILKSHKAAIG

SEQ ID NO: 128639 - protein, 53 aa, Glycine max
  Coding DNA Sequence Number=SeqID_36954
MVFQHQACRELKNQDSHEGNHSSKGYLKHGIDSQDVKPKAIRASNPMGQNNTE

SEQ ID NO: 128640 - protein, 46 aa, Glycine max
  Coding DNA Sequence Number=SeqID_36955
MTKARQKGVRKGKRGRWLPPISPRRAGLLPPKGTAFCWKTWRPKWV

SEQ ID NO: 128641 - protein, 61 aa, Glycine max
  Coding DNA Sequence Number=SeqID_36956
MDTSEPYTGAIRGTMHEPQANLGADQKFSPGVERNSKVEMNKSKALKVLTQYNPQTLFEPL

SEQ ID NO: 128642 - protein, 140 aa, Glycine max
  Coding DNA Sequence Number=SeqID_36957
  Homolog annotation: Hit_ID=A5ANT6; Match level="QueryCoverage=61%, HitCoverage=20%, E-value=4e-07, Identity=30%"; Hit description =Putative uncharacterized protein
  Pfam annotation: Domain name=zf-CCHC; Domain location=52-69; Score =10.7; E_value=0.037; Accession=PF00098.14; Description=Zinc knuckle
MDSLITRLLRVPYALKEENSADVMKTSAMVAPHGRGGGRNNRADRSGRGGRPQCTYCKRMDHTQENCYSLHGFPDKVTQVAQTEKSESKFSDKENQEYLKLKSEKSNSQASSSSVPCYSTACISQSIDGLSPWILDSVSL

SEQ ID NO: 128643 - protein, 102 aa, Glycine max
  Coding DNA Sequence Number=SeqID_36958
YEEKSQSFKTSGLRSILFKGEGMMQSYPARALDRKLQVDWARDAREGPRVLMSLREYINMKITEKGVPMNPKRIKVIPEWLAPPSVRKIWGFQDLTNFYKRC

SEQ ID NO: 128644 - protein, 213 aa, Glycine max
  Coding DNA Sequence Number=SeqID_36959
  Subcellular localization annotation: CTP_CleavageSite=16; ConfidenceScore=5.03e-01
MPISPCGRIAPTRHPVDSEVSNRARGFPALVTSLCHSYRVPVPPPPNKDRARKTPSGPGEVQQGHGVSSSDYGPLSVLRGARRRQQGVGRDTTTAWRWPAAGNRCTATTSKAPQLIYKGWSVAYDSWSTSRRPSPKSKVAKIPFAIMTREFGGMRRHPTVTRTHPLPSSDPRVRKHAGVPYGYPHLWSSRDGESDDMRGVPYGYPDISVNPDP

SEQ ID NO: 128645 - protein, 112 aa, Glycine max
  Coding DNA Sequence Number=SeqID_36960
QGKGQPLVVKEKCKETLANIATPLGLEFILQVKKLLDEGVPMNPKRIKVILEWSTPPTPLIELVRNHVPSWEDAQEMGVEGRSPDYEEPQDLRSNRFQGGGNDAILARKGIG

SEQ ID NO: 128646 - protein, 209 aa, Glycine max
  Coding DNA Sequence Number=SeqID_36961
  Homolog annotation: Hit_ID=Q9ZUQ3; Match level="QueryCoverage=88%, HitCoverage=25%, E-value=2e-07, Identity=25%"; Hit description =En/Spm-like transposon protein
  Subcellular localization annotation: CTP_CleavageSite=49; ConfidenceScore=5.67e-01
MATPPSSPPAPPLTNSTSHSPSTMKRTRKVTRLRSLATRPVGAEKPLVQVDPATGKANGPHRKKLRTYLGIVTRDKVDVTYENWKQAGFDIPEASDLRMKNKILQTMGKQWRQFKTDSTLKWKQVDRGEEKKQLEEATKSGSTDTIIDPPSPIRRHVKWKMARTKKPGQMTSEAAKKIADKIEPVSRPNNTLDRLQGPPTHLCPWLLKT

SEQ ID NO: 128647 - protein, 80 aa, Glycine max
  Coding DNA Sequence Number=SeqID_36962
MMVDTLSVFYYEKLVGYMPSSIADLVFAGERIEVGLKRGKFQGYVSSTSTNARRIGATGAKRKEGDTHAVTSAPTWVKPP

SEQ ID NO: 128648 - protein, 177 aa, Glycine max
  Coding DNA Sequence Number=SeqID_36963
MTPSTEDVKKAMQGLFAVLQLSMWGWFHTFFSKKVGPSIRYKEGRIRILSSCEGCPMRGVPSDESITPFIARGFSDHNARDRELRGSSNGIIGGYHKWLRVRTQGLDWLPNLKTVRDDEVKASEESDEVQALKAELERARVVEEKFKAAIVSSSSEEVKGIITGQRHDLEGRAKGLP

SEQ ID NO: 128649 - protein, 170 aa, Glycine max
  Coding DNA Sequence Number=SeqID_36964
MGPCSPIRTVWMTLSDVQRKAQAIQKQNTVPHVFSCGGYEYLEQKLLAEKTKKKLEEAAQSGSVDGVINPPSPVRRHDSFEEQATQGSFIPYGRQDVLTVAIGCPEHPGRVRAAGAGVTIKQYFESAPRTSHSSSSLPPEELQQLTQQIRDQLKESIIEKMTRQLMASFS

SEQ ID NO: 128650 - protein, 60 aa, Glycine max
  Coding DNA Sequence Number=SeqID_36965
MGANDIIVNKQLHWKLVGLGSSSSMDSFSSWKMNGSGMEKEEREETPLKGEDESRRSSPP

SEQ ID NO: 128651 - protein, 88 aa, Glycine max
  Coding DNA Sequence Number=SeqID_36966
MEKSKVDTLIAISPNTWHASKQQTKATFLPKKSEYAIYGDNKQRPLDQQPQQLEVGSSYWKLKVKNGSWKLEVEVTGSWKLEMKVIGS

SEQ ID NO: 128652 - protein, 172 aa, Glycine max
  Coding DNA Sequence Number=SeqID_36967
MVQPQKSAAGLREIPITTHICTSQIPKQKFTNPCANVIKAFHRALGGSMFRHENQGNGGNMACPIISEHNLGLRPSPTTPQFNKNKQQFKDRSLTFLSKYMQLRAPKYINGKLKFPRMRYLLIGVSRSIKNESKMQQKVAWGRKNGKSRSFSVFESGGGGVLGEENVPLPLF

SEQ ID NO: 128653 - protein, 56 aa, Glycine max
  Coding DNA Sequence Number=SeqID_36968
MKNIPDSGVVFTFEEGRQKRGPLLLRTLYIRGNQTYVVLSKGKIKAILFTWEGGPF

SEQ ID NO: 128654 - protein, 162 aa, Glycine max
  Coding DNA Sequence Number=SeqID_36969
MNQKSTPVARVCGLCSSADHHSDLCPSLQQSGVNEQPEAYAANIYNRPPQQQNQQQQNNYDLSSNRYNPGWRNHPNLRWASPPQQQQFIPPFQNDAGPSKPYVPPPMQQQQQPQKQQTVEAPPQPSLEELVRQMTIQNMQFQQETRASIQILTNQMGQLATQ

SEQ ID NO: 128655 - protein, 245 aa, Glycine max
  Coding DNA Sequence Number=SeqID_36970
FAQKQANGKYQQYLPIIEKGTLTQKDSLTNVLMSELKTYKSEDEYRTTINILRSLGKEEQQSSVEALAKKKYPKGSLTRDAFITDVFYNASTPVQKENAYNELIKKWPVKNFSEEPLTYDYVLANLAQSFANDGNAPKAIHYLGEMKERFWRGNGYIPVGQILLSAGDTITAAPLLKTAMDDSYYYLTLPENQKDNKARFAAMGYASSMSAYVNILVAQKKYAEALGYIENALKAAPEQADGLAN

SEQ ID NO: 128656 - protein, 61 aa, Glycine max
  Coding DNA Sequence Number=SeqID_36971
MGHLSDQGVPMNPKRIKVILEWPTPPSVDEKSPEFQEPRDLRSNPFQGGGNDAILPRKGIG

SEQ ID NO: 128657 - protein, 107 aa, Glycine max
  Coding DNA Sequence Number=SeqID_36972
MMIGCGITWMLWKLGRIDGDPVLRGTRIRATWEYVSSVGDWYLEICRGGQETLGTSGGVLLPQNPSLTNPDPNPGIVRRAPSSQPIKRTKPTKQGGLYGGWPAVNLE

SEQ ID NO: 128658 - protein, 135 aa, Glycine max
  Coding DNA Sequence Number=SeqID_36973
SGYGPLSILQGARTPRQGHVIIGIAPARHPMDPKKSNRVLELSSSNYGPPTNRAFIKKYCVSRQMQGETPHSLGMAGSGTIDAPPPPLEFTSAHPQKRLPSPKAKDKQKVLGPCDQQVIRRPAQDVKESATRRQP

SEQ ID NO: 128659 - protein, 96 aa, Glycine max
  Coding DNA Sequence Number=SeqID_36974
MQSSKCDVYLGAYLNGALKGLDDAPQPKSKASARWIVVKCNRQKGSTKCGYYVMHWMSTIILGSFRNNWEATIGAREIKALRIQWAQYYLRVRDQT

SEQ ID NO: 128660 - protein, 266 aa, Glycine max
  Coding DNA Sequence Number=SeqID_36975
MGEVDEVQEWTKVDIEALKEKMAIMMEAVMSMKKMMEVNATVVAVTSAVAEVDPTPPSGLNQISHPTSDMVGQGGKELGSTSGPHFVQVQNNHAFPPYGLPPNYTPPNMVHTLNENVNNSNPILIESQQPQSDHAHVSQPMREAHEIPHHNLADFETCLGYAIEGQAVGGVPLPNTLEGPQFHPQPQPLHLAAGRVPPAMAEKGKLDQIEERLRAVERGGDNAFADMEDFCLVPDMGTTCPKNHLKVYCRKMGAYTKDEKLLMHFF

SEQ ID NO: 128661 - protein, 37 aa, Glycine max
  Coding DNA Sequence Number=SeqID_36976
MAAEWRRRKGDWRCHYKERMSQEQAHHLRKPWIRALK

SEQ ID NO: 128662 - protein, 109 aa, Glycine max
  Coding DNA Sequence Number=SeqID_36977
MVDGWGDSRTALGNQFVGLQTQWWRMHERQSIHGAPNKMVENARTALGNQFVGFRTQWWRIHERQSIHGALNKMVEDARTALGNQFVGLQTQWLRMHERHLIHGVPNKI

SEQ ID NO: 128663 - protein, 86 aa, Glycine max
  Coding DNA Sequence Number=SeqID_36978
MGAKYLEVVKRGSHPNNGWSPDEIRAQNDHNLSLRVIGRDRAWVARRRMTIICLCVPPDTIASGWRKGVRNDHNLSPPTSRLTVPE

SEQ ID NO: 128664 - protein, 46 aa, Glycine max
  Coding DNA Sequence Number=SeqID_36979
MMLKTFRTRNVRRYMEKNEETTMEEKLACGASMEAGSLSFNEVLQW

SEQ ID NO: 128665 - protein, 83 aa, Glycine max
  Coding DNA Sequence Number=SeqID_36980
MVEQEEREVKPHQEETEVVNLGVGEERKEGKVGTDTNGTGGYGKDNLHHPMGNFMLQGDVLWAQEHWGNLPTDYGGAIPRHDA

SEQ ID NO: 128666 - protein, 66 aa, Glycine max
  Coding DNA Sequence Number=SeqID_36981
MPKHAPTKCSVKCPNDIRIWFGTALGIRNGCPNAIPSLGTQALNFNARNYDLCLKNLNFGFKSGKA

SEQ ID NO: 128667 - protein, 106 aa, Glycine max
  Coding DNA Sequence Number=SeqID_36982
  Gene Ontology: Mol. function=oxidoreductase activity, acting on NADH or NADPH; Cellular component=chloroplast; Biological process =electron transport
  Homolog annotation: Hit_ID=Q2PMN8; Match level="QueryCoverage=87%, HitCoverage=23%, E-value=6e-45, Identity=94%"; Hit description =NAD(P)H-quinone oxidoreductase chain H, chloroplast (EC 1.6.5.-) (NAD(P)H dehydrogenase, chain H)
MTISTTRKDFMIVNMGPPHPSMHGVLRLIVTLDGEDVIDCEPILGYLPRGMEKIAETRTIIQYLPYVTRWDYLATMFTEAITVNGPDQLGNIQDQAYRYRRPRGGA

SEQ ID NO: 128668 - protein, 156 aa, Glycine max
  Coding DNA Sequence Number=SeqID_36983
  Pfam annotation: Domain name=Transposase_23; Domain location=51-121; Score=3.3; E_value=0.00051; Accession=PF03017.5; Description =TNP1ENSPM transposase
  Subcellular localization annotation: CTP_CleavageSite=34; ConfidenceScore=5.28e-01
MASFSHMQSQLQSQMQSQGLAVPPEPLVGPSGSRVSIKGSCVDPSGNDPETSDSDRCGLYIEADPARLVAMGRVYEGSTIVHNTPLLPGQVKVSVEEVTHADAPVPVPPDEVSLVGQALLTFLAWPTHLVKSLSQQLCLRQNNLRSPIRRSMIRFI

SEQ ID NO: 128669 - protein, 123 aa, Glycine max
  Coding DNA Sequence Number=SeqID_36984
MSFTEGKIGINEMAPKKFSTKRSIRDATGEGSNVALEFDSHRFRSAEHQQRFEAIRGWSFHKERRVQLREDEYTNFQEEIARRRWTPLVTPMAKFDPEIVLEFYANAWPTEEGVQDMRSWVRG

SEQ ID NO: 128670 - protein, 94 aa, Glycine max
  Coding DNA Sequence Number=SeqID_36985
MSKSYGSHSYPKKDQGQGILGVTPSKPKDDQGKTIEKQAPKARHITSQYPTTKTMIMRGQDIYSSQDKATTSPSSSESEEAKVKKSTPKKKDNH

SEQ ID NO: 128671 - protein, 140 aa, Glycine max
  Coding DNA Sequence Number=SeqID_36986
  Subcellular localization annotation: CTP_CleavageSite=31; ConfidenceScore=5.10e-01
MAEPSKKRKGSSSWSQWHSETQETLIPSSISSSSLFSSKEQRIQYTNLFSSRSIIDPKFIDMDFFSNESFACIQAFENSNLIPFMSLKLPVYSDLVKAFYSNLEIQEGTLISEVYGIKMVIDQFLFYDLTQLSSEGVPFE

SEQ ID NO: 128672 - protein, 57 aa, Glycine max
  Coding DNA Sequence Number=SeqID_36987
  Subcellular localization annotation: CTP_CleavageSite=37; ConfidenceScore=5.53e-01
MWKFFIVLRRSSPFFIRSSFVLRSSTGLISSSQLRIRRSKSPAFVDHPKRSLMVQMP

SEQ ID NO: 128673 - protein, 115 aa, Glycine max
  Coding DNA Sequence Number=SeqID_36988
MSVEKFLQKVAWPGVHPSPLGGGEASAAQEPQQDQEDDILEALEPTPPKPFIFETGPVAATPQVTLEPSTIVLDMSSSQPEPSAPVLDLPLPQDSSAGTTALDLNEQAMDSAQDH

SEQ ID NO: 128674 - protein, 152 aa, Glycine max
  Coding DNA Sequence Number=SeqID_36989
MYPSLELIHKRCTLSLFSVKTQVDVPSTCTTKDVSSNVLRQRSQAVKPLILCEWGYKRILRRVSPFEHFCIREREESKEFLDCVILNSLTREKGDTRIQAREKRMKKMNSTSFQGLENQKTLGKLFGTKKKKKVQRDSRLVKDCMDKCFKIE

SEQ ID NO: 128675 - protein, 64 aa, Glycine max
  Coding DNA Sequence Number=SeqID_36990
MTTDSPPLPYVPMDPGESPTIATLPFGGEGRRETHGCVFPRKGKMHGVRHPTFGELYFTHGGRY

SEQ ID NO: 128676 - protein, 171 aa, Glycine max
  Coding DNA Sequence Number=SeqID_36991
MGDFISRLSFPACLHFSEENTETFSSLTSYPELRRSEFLIGGYVGARASLLSTTPPFVIQNYVELRRSEFLIGGYVGARASLLSTIPPFAAMTQELVARGDALRLSAPRHSATPSVIDEQRPIWSSAPFPEMSAFSDGDFSSPTNYLELRRSEFLIGGYVGARALPLSAAP

SEQ ID NO: 128677 - protein, 44 aa, Glycine max
  Coding DNA Sequence Number=SeqID_36992
MEEHKKEAERIHESESTTFRVTGNTNSSLHSLWIIVLIRGTAYT

SEQ ID NO: 128678 - protein, 81 aa, Glycine max
  Coding DNA Sequence Number=SeqID_36993
  Homolog annotation: Hit_ID=B0HC01; Match level="QueryCoverage=38%, HitCoverage=65%, E-value=1e-09, Identity=100%"; Hit description =Putative uncharacterized protein
MFFLRYPLILWITVLPPLSELIPLAAAERPSAARNSYDHDYEFELGTGVAAATCLTCVSSASSPISNGSGMVASNDSSSTC

SEQ ID NO: 128679 - protein, 58 aa, Glycine max
  Coding DNA Sequence Number=SeqID_36994
LVTLAQPEGEDSALSELAFAQHLYTAHPSPRIVHELSHQMGRLADDALSQKMSGLASS

SEQ ID NO: 128680 - protein, 139 aa, Glycine max
  Coding DNA Sequence Number=SeqID_36995
MEAVLPFEVEVPSQRIIVETKNTNQEMNFAARKPVEFTPIPVSYADLLPYLLDNSMVAITPTKVHQPPFLREYDSNATCACHGEAPGRSIEHCRALKRKVQVQAIGLFAQATCALEFGLPRPFNQRLLVLHVGGGAVKQ

SEQ ID NO: 128681 - protein, 80 aa, Glycine max
  Coding DNA Sequence Number=SeqID_36996
  Subcellular localization annotation: CTP_CleavageSite=27; ConfidenceScore=5.22e-01
MSLMKTLKHGFKALRVLSRWTWRRWCRSSRSGRSWWSRRRKNINWSIPCLPCPSEVNCQVNGRAQALISQTIRGNSSSST

SEQ ID NO: 128682 - protein, 65 aa, Glycine max
  Coding DNA Sequence Number=SeqID_36997
FVIIKKGEIVEASFMMMNQEILMIPKAQVIDSRLQDQASRIQSKNPIQDSRFKRRNQEVTSQDFI

SEQ ID NO: 128683 - protein, 50 aa, Glycine max
  Coding DNA Sequence Number=SeqID_36998
MVLSIQYFKQLLRISYSGSMSYKVVVECATVMNEMVSDDEGEMMGAGVTN

SEQ ID NO: 128684 - protein, 265 aa, Glycine max
  Coding DNA Sequence Number=SeqID_36999
MAKFDPEVVLEFYANAWPTEEGVRDMRSWVRGQWIPFDADAIGQLLRYPLVLEEGQECEYGQRRNRSDGFDEEAIAQLLCIPGQDFARTAAGRRVRIMRTNMTTLTQIWMTLLLSNILPSDHNSDLPLPKCQLVYAILTRMSIHVAQLIADAIYIFAGMTPTRHPLDPDKSNRALGFPALITGLCQSFGVPVAPTKMSLSMQSQGFASFSCPTPDQFRAEVAWPGDWPEAQAGEAPPEAPGDGEEAHEDEEMADLLDFLGGSGDT

SEQ ID NO: 128685 - protein, 73 aa, Glycine max
  Coding DNA Sequence Number=SeqID_37000
MFAHSIKGCRPLGRTCGVNEHITQVPNDEVETKANTEVEDTQFELTTEFAEVMDHIPLTQQSQPFSTRLEYLP

SEQ ID NO: 128686 - protein, 22 aa, Glycine max
  Coding DNA Sequence Number=SeqID_37001
MATINILGICSQMCNGIITIYI

SEQ ID NO: 128687 - protein, 129 aa, Glycine max
  Coding DNA Sequence Number=SeqID_37002
AKFDIPEGLTAKKKVMSTVGTRWRQFKSSLTTKYVYAENDDEQNKDPYAKYGIDRNTWEEFAKTRQTPTLEGYDVLEKKLMAEKTKSRLNEGDNSQNADMVVDPPSLIARHEKWKKARTNKFGQMTSAA

SEQ ID NO: 128688 - protein, 191 aa, Glycine max
  Coding DNA Sequence Number=SeqID_37003
  Subcellular localization annotation: CTP_CleavageSite=37; ConfidenceScore=5.01e-01
MAEPSKKRKGYSSRSQWHSEAQDTPILSFISSSSFFSSEEQRTRYTNLFSSRSIIDPKFIDMDFFSDESFECIQAFHNSNLIPFMSLKLPVYSELVKVFYSNLEIQESALDDDWKFNFSVHDARRVVCTNQADMTGRLLASSLALESRILHYLIARILLRRSSNLAQVSEEDLIVMWAFHTSRQIDWAHLV

SEQ ID NO: 128689 - protein, 178 aa, Glycine max
  Coding DNA Sequence Number=SeqID_37004
MTQELVARGDTLRLSAPRHSVTPSVIDEQRPVWSFAPFPGMSTSSGGDFFKSHKLSRTTGGGPDDTWRYLTVIRTLLSSRGGGPDDTRRYLTVIRTLLSSRGGGPDDTRRYLTVIRTLLRSCDMHPFAIQTQSCPMARRDKIWSFCTLVSSRGGGPDDTQRQNLVILHPCVIQRRRAR

SEQ ID NO: 128690 - protein, 70 aa, Glycine max
  Coding DNA Sequence Number=SeqID_37005
MARNVFAPCPYLRDLYGRELTRLLVIIPKVVISLLKVSRGIIPFEEQIAAVGTTSNDIFSKRKTLDEGSL

SEQ ID NO: 128691 - protein, 121 aa, Glycine max
  Coding DNA Sequence Number=SeqID_37006
MNMKGQDIYSSQDEATTSPSFSESEEAKGEESSEEIYPQEEGQPLMVKEECKEVSVSSKRLAKKESHFAIKTNIKETSHLRQPPHLLLCKMTLVSTATPLGLEIIPQVLREEAQSFKNLWI

SEQ ID NO: 128692 - protein, 107 aa, Glycine max
  Coding DNA Sequence Number=SeqID_37007
  Subcellular localization annotation: CTP_CleavageSite=50; ConfidenceScore=5.51e-01
MHTRSFTNPQFLKTGLTHKKIPSGVANCRNVPFTGERGRGSRVRFPKEERCAESPPPFICGKRRKNRRKPVKMKVLSSGVIFTLEEGRQKRGFCSYVPSFGEEIRPT

SEQ ID NO: 128693 - protein, 89 aa, Glycine max
  Coding DNA Sequence Number=SeqID_37008
MRGYVMVTRTFRQPGENEPLDARRRTSFSAPFVILTRQVSQPGANEPVDVRRLTSSSAPFVVLTHEVRGHTGLPYCYPHRSSTMGKRAK

SEQ ID NO: 128694 - protein, 75 aa, Glycine max
  Coding DNA Sequence Number=SeqID_37009
MIVLPDEPQLQEPEFTSFSCPTPDQFRAEVAWPGDWPEARAGEDASRGSPTRQMRPARTRKMTDLLDFLGGSGAT

SEQ ID NO: 128695 - protein, 261 aa, Glycine max
  Coding DNA Sequence Number=SeqID_37010
  Gene Ontology: Mol. function=L-lactate dehydrogenase (cytochrome) activity; Biological process=electron transport
  Homolog annotation: Hit_ID=A9HVG8; Match level="QueryCoverage=16%, HitCoverage=11%, E-value=1e-15, Identity=90%"; Hit description=L -lactate dehydrogenase
MSICSLEDVAAATGKPFWFQLYVMRDREFVGDLIDRAKAAGCSATGADAGPADPGAAPQGHQERAVDAAQADDPQPDQPGDQAALVPGHAGHQAPHFRQHRRPRQGRERPVVAVVVDGRAVRSAVELGRCGMDQAALGRQADHQGHPGCRGCAAGGQQRRGCADRQQPRRAPARWRDVLDRGAAVDRGCGGVEDRSVDGWGRALGAGHPQGGGAGRARRDDRAGVPLRPGRIWAGGRQARAGDPVQGNGYDDGALRAAQYR

SEQ ID NO: 128696 - protein, 338 aa, Glycine max
  Coding DNA Sequence Number=SeqID_37011
DFKTELERCNFHKRLTNLVDGSIDLALVKEFYANLYSSEGRSPKQARVRGHLVKIDVDSLNTFLETPMVLAEDYREIEVALCIPGRGFILNADGHPGRILKKDLTNLAQMTSIAQSRTSRLEFPALITTLCRARGVVSNSLTFECLSPVINLAYIRKNCWNPEDLTVSIRGTRRARARPTELPSTSTTPTPASTSAAPSVPAQTDSQRFKAMLQRIHQGQIILLQSLLVVVPPGSIPSDESSKATIPEPIVIGEEVGETQVRQVAAATPERSLEATSEPLAPVEDLPSPQHATDPSTPILEITEDPTTPVLTLDTFPPATPVLHLTDEEDVQTQDTQD

SEQ ID NO: 128697 - protein, 123 aa, Glycine max
  Coding DNA Sequence Number=SeqID_37012
MGETYSSSPVDALFFTQKAYAALISWNICLFAKACLHFSGENTKTFSSLTSYPELRRSEFLIGGYVGARASLLSTTPPFVAMTQELVTRGDKIWSFRTLLSSRGGGPDDMRRQNLVIQHPCAV

SEQ ID NO: 128698 - protein, 145 aa, Glycine max
  Coding DNA Sequence Number=SeqID_37013
  Subcellular localization annotation: CTP_CleavageSite=52; ConfidenceScore=5.27e-01
MRTLRPSSAALAQSSWSLLLMALVTGPFLGRIASGQQAKEVPSCHISRSFVSAGLRREGQVVAICDEDSLRRSNLVQPCPPSFQLGNWRVEERPEVYTTSIISDDESRKGTNTGDLAVNFEQEASRTEDEEDEDVGLPPDVGRRK

SEQ ID NO: 128699 - protein, 85 aa, Glycine max
  Coding DNA Sequence Number=SeqID_37014
MAWKKKHRRVMDNLTLFGKMSRIATANNCCMSTVSLWNLHPTKTLTKTDAILPRKGPVTRAMSKRLQEDWARAAEEGPRVLMNLR

SEQ ID NO: 128700 - protein, 176 aa, Glycine max
  Coding DNA Sequence Number=SeqID_37015
  Homolog annotation: Hit_ID=A5BUU3; Match level="QueryCoverage=35%, HitCoverage=7%, E-value=4e-07, Identity=39%"; Hit description =Putative uncharacterized protein
MRWEVAPMASLQPQDADIESQSNLSLPPSLPVRVLYKTSFPLVTCELIMASPPASPPPPPPSDASASSFAVKRTRKASLVHVDPTTGKADDPHKKKLRTYLGTVARDKVDVTYENWKEVPIAQKDKIWEDIQDVRKKAQAIQKQNIAPHILSRGGYEYLEHKLLAEKIKKKLEEAS

SEQ ID NO: 128701 - protein, 90 aa, Glycine max
  Coding DNA Sequence Number=SeqID_37016
MAVTNPSDDDGVEETTMIGLHGEGERDNAGTNKAASISTSLNTKSLDDDTNSLAQLAEAETGVAEHATQVQKVERPKRAITKPSYLKDFV

SEQ ID NO: 128702 - protein, 101 aa, Glycine max
  Coding DNA Sequence Number=SeqID_37017
MYPLLFSVTTTQVDVPSTCTIKDVPSNVLRQSSQAVNPLKLCEGEKKISQAGEGRHKRIQAVSSLFFWKREKTDTKRIQAVSPWRILFGKGRRETQKNLGG

SEQ ID NO: 128703 - protein, 45 aa, Glycine max
  Coding DNA Sequence Number=SeqID_37018
MYDSTGFPFECKNGPEEACLKRSRKDKAVEGTSSAPEYDSHCLEC

SEQ ID NO: 128704 - protein, 93 aa, Glycine max
  Coding DNA Sequence Number=SeqID_37019
MAPRKFASKRSRKDKAAEGTSSAPEAPAVGITGYSHGQWIPFDADAIGPASGISVGVGRGPGMKASANHAHQHDHPDPDMDDVAPQQHPAQRS

SEQ ID NO: 128705 - protein, 97 aa, Glycine max
  Coding DNA Sequence Number=SeqID_37020
  Subcellular localization annotation: CTP_CleavageSite=80; ConfidenceScore=5.39e-01
MTQELVARGDTLRLSAPRHSVTPRAKALLLSTTPLFVTMTQELVARGDTLRLSTPRHSVTPSVIDEQRPMWSSAPFPEMSASSGGDFFKSHKLSRTT

SEQ ID NO: 128706 - protein, 137 aa, Glycine max
  Coding DNA Sequence Number=SeqID_37021
AMAGQSLEHLVEASSPRGAQPRGDDADVRDVVVDREFGLDNQDPLYTMNEIPMRESRAKEDLRLDGKGKPRTDTKACKEPAELKGQYIGPALPLQHKITTERKGLLVELLANRYDGKTFDNRSFCGYESGYGSDSLF

SEQ ID NO: 128707 - protein, 58 aa, Glycine max
  Coding DNA Sequence Number=SeqID_37022
MAIHIMELKVATAERRLMWVPKHKNEVKEFLVKLSPAPLDYVTFGDGSKGEDSLQWES

SEQ ID NO: 128708 - protein, 159 aa, Glycine max
  Coding DNA Sequence Number=SeqID_37023
  Homolog annotation: Hit_ID=A1JR88; Match level="QueryCoverage=99%, HitCoverage=98%, E-value=3e-50, Identity=63%"; Hit description =Putative exported protein precursor
MKCSISLLAGALLAVSFSASAMALDSQEVGYNIEARGARPVVAQLGKAGQFNAVENSIRLGDDNWIALAPKLAGGGNAGFTAGIKSALSAALIYNPAAVLQALNKGNDLPLNDICTAPPEVQGDTAVTSFRQRATRALSTVRVGDLSAPRDACIAALKG

SEQ ID NO: 128709 - protein, 84 aa, Glycine max
  Coding DNA Sequence Number=SeqID_37024
MAISTCFQQVSSQITIMKQKTSKTTHHISQNPIPTKIKGERSPPKPEISKSHTNGHQRLKLCWATMVDEEEGEKQREGEGERAV

SEQ ID NO: 128710 - protein, 118 aa, Glycine max
  Coding DNA Sequence Number=SeqID_37025
MKRWWAAHPQSFADLVFASERIDVGLKKGKFDHPTRTTEKTGANKEGEDEGETHAVTAIPVRPSFPPTQQYLYSANNKPSPYPPPSHNPSQGSSTSTFLRIRLERNVCLSWRSPGAFH

SEQ ID NO: 128711 - protein, 97 aa, Glycine max
  Coding DNA Sequence Number=SeqID_37026
MSHHSSSVNSEDTSHKDPLSRILDELSSLKLWKEKLERKEKGKERVETSQDEWEQIWEKEKRKILKELRKEKHASYNSHDSYKSLSEELSDYYGGRH

SEQ ID NO: 128712 - protein, 82 aa, Glycine max
  Coding DNA Sequence Number=SeqID_37027
CEASGDWEARYSVVFQIGSFAKYEKEELEMGVIITERAGRTKSVSYLCFPLISDESPETSQKSKGSRLARSVKFRNVAEVEK

SEQ ID NO: 128713 - protein, 60 aa, Glycine max
  Coding DNA Sequence Number=SeqID_37028
  Subcellular localization annotation: CTP_CleavageSite=21; ConfidenceScore=5.26e-01
MVLVVAIATTLTSIISFMLIMASIIVAICSFKASVSAFTCSCTSSTSPITLALARVRTWG

SEQ ID NO: 128714 - protein, 44 aa, Glycine max
  Coding DNA Sequence Number=SeqID_37029
MGVQTVESNLARLGEARWATTPPSFCLKEWDFRGLPGTPGIAFP

SEQ ID NO: 128715 - protein, 90 aa, Glycine max
  Coding DNA Sequence Number=SeqID_37030
MARNRLRVVKNLGRKIWIEVKKIENGNSRKSQGGIWEEKDEGVGRSSCPLFQIWDGLVDLAAIDALPLLVTHSKESPVIAVLANAYDTFD

SEQ ID NO: 128716 - protein, 28 aa, Glycine max
  Coding DNA Sequence Number=SeqID_37031
PVFRGFWSQTQVPGIAPYRVVLEYIKDK

SEQ ID NO: 128717 - protein, 150 aa, Glycine max
  Coding DNA Sequence Number=SeqID_37032
  Gene Ontology: Cellular component=integral to membrane
  Homolog annotation: Hit_ID=Q2PMP0; Match level="QueryCoverage=43%, HitCoverage=3%, E-value=1e-24, Identity=87%"; Hit description =Putative membrane protein ycf1
MENSGKWKVEKSLYNNPKIAIEKESRNCNRKEKERFEMIFQSFILDNLVFLCMKIINSIVVVGLYYGFLTTFSIGPSYLFLLRARLVEEGTRRKFSNNWGLLRTAHNVHDRWLLCALPRTVEQRSIPNLHRGIDGDSQISQNRTEWDTMR

SEQ ID NO: 128718 - protein, 151 aa, Glycine max
  Coding DNA Sequence Number=SeqID_37033
VAVVRPPLKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 128719 - protein, 82 aa, Glycine max
  Coding DNA Sequence Number=SeqID_37034
ARLTGALSKGGKMREVATNVYLWKKSGKPKETGQNENSKFGSCIYVDKSGAFAPTYPPSKRKSDLRSSSLCMNQVIDFLLEG

SEQ ID NO: 128720 - protein, 122 aa, Glycine max
  Coding DNA Sequence Number=SeqID_37035
MSIHVAQVFRPPITQAFIEKYCTPRQAQGNAPKAADIPPPPHQVDPTGSLGMECYLQHLVRQQAVIHQGQPQSAGAGFGAEVAWPEAQAGEAPARSPGDAEEARMDEEMTDLLGFLGGSGAT

SEQ ID NO: 128721 - protein, 164 aa, Glycine max
  Coding DNA Sequence Number=SeqID_37036
  Gene Ontology: Cellular component=integral to membrane
  Homolog annotation: Hit_ID=A0PTZ7; Match level="QueryCoverage=89%, HitCoverage=15%, E-value=2e-25, Identity=40%"; Hit description =Conserved transmembrane transport protein MmpL4_1
MTSGQQPPLPGDDADTGPVPVPTQRAMRHETHKHPAAARWLRVLAIPVVLFWVIAAAVLNIFVPSLEETTAANAKAMIPRDAPSSAAAITQGQDFQESAYTSAAVIVLETQGRTLGEQDRQYYNKLVRGLLDDKEHVQSLMDLWGDPVTRSGQQSADARAATLT

SEQ ID NO: 128722 - protein, 38 aa, Glycine max
  Coding DNA Sequence Number=SeqID_37037
MWTTTGEVVAAQLAQASSARPGEPGYFLQKQQPSGGIF

SEQ ID NO: 128723 - protein, 131 aa, Glycine max
  Coding DNA Sequence Number=SeqID_37038
MWMDRFALTLNGSQELPRLLAKAKAMVDTYSTPEEIHGLLGYWKNTITKRATRHPYRTRSKSRTMGDQEETQEQMKADMSALKEQMASMMEAMLGMRQLMEKNVAIAAAVSSAAEADPTFLATAHHLPSNI

SEQ ID NO: 128724 - protein, 93 aa, Glycine max
  Coding DNA Sequence Number=SeqID_37039
MDFFSDESFKCIQAFHNSNLITFMSLKQPVYSELVKAFYSNLEIQESTLISEVYGIKMPVGLHQPSEYDQKAACRFIGVGSSGLRIIKKGGLN

SEQ ID NO: 128725 - protein, 146 aa, Glycine max
  Coding DNA Sequence Number=SeqID_37040
CAEKEARGRVIDALHQEATMWMDRFALTLNGSQDLPRLLAKAKAIAEGSGTGATARSNLGRDKNATGFNRRYSPQAYPYGLPPDFTPRTAPDDLSQALTFEGQLPPHAGYPLQEDDEGDAHLGPLLPLKEPAPNEMPQPNIVRHVP

SEQ ID NO: 128726 - protein, 252 aa, Glycine max
  Coding DNA Sequence Number=SeqID_37041
  Homolog annotation: Hit_ID=A5BKB8; Match level="QueryCoverage=39%, HitCoverage=29%, E-value=4e-33, Identity=73%"; Hit description =Putative uncharacterized protein
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYPRGKDEKDFEKRVKECLNCREGSGWGPAMCPGRMWNGESRVRRSTRDIDRRGLRWWPKPGLLICSWRRHHRDCGWQRAPLACLGTCALLASACGLPIRPVLKHGPRSLTCVRVNGRVNP

SEQ ID NO: 128727 - protein, 71 aa, Glycine max
  Coding DNA Sequence Number=SeqID_37042
MEWRRKRERRRHFKEMSLEEAHHHRRPWIRAWRKKEMNEGRGREEHEILCSKRALKSEPTNPRSIPRFFTK

SEQ ID NO: 128728 - protein, 45 aa, Glycine max
  Coding DNA Sequence Number=SeqID_37043
MVGSWYRTYATKNARKMQGSCMSKHENKKERYVHYDAMERCLCDA

SEQ ID NO: 128729 - protein, 182 aa, Glycine max
  Coding DNA Sequence Number=SeqID_37044
  Gene Ontology: Mol. function=nucleoside-triphosphatase activity; Cellular component=ATP-binding cassette (ABC) transporter complex; Biological process=sulfate transport
  Homolog annotation: Hit_ID=A6T7S6; Match level="QueryCoverage=97%, HitCoverage=84%, E-value=1e-63, Identity=67%"; Hit description =Putative ATP-binding component of a transport system
  Pfam annotation: Domain name=ABC_tran; Domain location=1-180; Score =102.2; E_value=1.6e-27; Accession=PF00005.18; Description=ABC transporter
MGPSGSGKSTLFAWMIGALADTFRAEGELWLNKRRCDGLATEARRIGILFQDALLFDHFSVGHNLQLALPAEIRGAARQSEVEQALARAGMPGFASRDPATLSGGQRARVSLLRALLARPQALLLDEPFNRLDAELRADFRQWVFAEIDRLAIPAVLVTHDSQDLPPGGRCINIAAWQANSA

SEQ ID NO: 128730 - protein, 57 aa, Glycine max
  Coding DNA Sequence Number=SeqID_37045
MPTPPERAQMTTLASARQSHLGSLNDELLGHCNKRWCGRQKRGSCSYVSSNEELRPT

SEQ ID NO: 128731 - protein, 161 aa, Glycine max
  Coding DNA Sequence Number=SeqID_37046
MVIQVEESRAYQKVEGFKQQLADQLALEPVDDLVELKEIVEEAEGDEEGETPIRDCQEKIKKKEEKEKEEETKEKEEKSFDDNKDDDKKAQKSRTFHDNKDDDLKKSKNEFKIESSTLQGSRGNLISRIKIQGTSFQESRFKVQASKNQDQDSRFKNQEKT

SEQ ID NO: 128732 - protein, 142 aa, Glycine max
  Coding DNA Sequence Number=SeqID_37047
  Homolog annotation: Hit_ID=Q9SJS1; Match level="QueryCoverage=53%, HitCoverage=10%, E-value=2e-07, Identity=44%"; Hit description =Putative Athila retroelement ORF1 protein
MDGEPARRVTLEDFSNTATPQFFTSIARLEVQAANISYPHSLIQLIQGNLFHGLPSEDPYAHLASYIEICNTIKIVGVPEDAKNTDTRLQRASIIEHIHRWLAASIETATRCIRRREDQTEDSRGSDGTHQEHGGQRSSNPS

SEQ ID NO: 128733 - protein, 119 aa, Glycine max
  Coding DNA Sequence Number=SeqID_37048
MSEIEEMQEQMKVDMKAMKEQMAIMMEAMMSMEKMMEVNAAIVVAASTATKVDPAHPSGLNQVQNKHSFPPYGLPPNYTPPNVAHTPNENVNNFAPIPIESQQPQSDHAHVSQPMGGDT

SEQ ID NO: 128734 - protein, 136 aa, Glycine max
  Coding DNA Sequence Number=SeqID_37049
MGKVEEAQEQIKADMEAMKEKMATMMEANMSMKKTMETHEMPHHNLADFESCLGYATEGQAVGGIPMPNTLKGPQFCPQPQPLHFAVGRAPPAMDEKGKLERLKDIEGGEDCAFANLEELFLVPKHVHSQVQGVGL

SEQ ID NO: 128735 - protein, 163 aa, Glycine max
  Coding DNA Sequence Number=SeqID_37050
MVKDECKQVSVSSKRLAKKESHFVMKTKIKETSSLRQPLHILLCKKTLVSIVTPLGLEVIPQVKKLLDEGLVRKSLNPCALLVPKIGIIRHQIPKISDMMNVLSVATLFCKITHAPNIFMIHAHRNSLGVKGRSLEYQEPQDLRSNPFQGGEDDAILPPKGNG

SEQ ID NO: 128736 - protein, 175 aa, Glycine max
  Coding DNA Sequence Number=SeqID_37051
  Subcellular localization annotation: CTP_CleavageSite=39; ConfidenceScore=5.07e-01
MASRKRARADDIPSPSTPAPPAATIGPDVQSSQTLVPMLQSLFQGFVIIMHSMRELAHQRPIITMEQFLEQVAWPGALPSMVRPNEASPPEPTPARVGPVPADPQSPMVNPPSPKLEAVPPSPPIIIISDSLFGEAAAPPDSPVGKAAILSDSQSGEAIALSAFPVFHLIDEEEA

SEQ ID NO: 128737 - protein, 234 aa, Glycine max
  Coding DNA Sequence Number=SeqID_37052
ESRWFKAICPKFGGVNQDVKWKTYGKIWDLATVEVSVEAIASLTQYYDLAMGCIHYNLVLSIRQLSYPMRRVPSEESITPFITRGFGDPNVKILQGVWKACGAMQRNDKELRESSNGITNGYHKWLRVQTKELDWLPKLKAAREEQAETPEKSKEVQTLKAELERAQVVKEKFKSTAINVRKDNNELKLRRAKRDQLWVEGMILKDELKACERLKRSLSEQLSKTEENMWAITD

SEQ ID NO: 128738 - protein, 314 aa, Glycine max
  Coding DNA Sequence Number=SeqID_37053
  Pfam annotation: Domain name=Transposase_23; Domain location=215-285; Score=5.5; E_value=0.0003; Accession=PF03017.5; Description=TNP1ENSPM transposase
DQDGVEDTVCDKYSISKEKWAQFFQTRRDLFWEDVRSKAQAIQKQNTAPHVLSRGGYDYLEQKLLVEKTKKKLQEAAQSGNVDGVIDPPSPVRRHVKWKMARTKKTEEMTTEATKEIAEKIGSFVPHGRQDVLAAAIGCPEHPGRVRAAGADNQGPTRGVHHRESDEAGHGILQLQMQSQGLAVPPEPLVGPGPSGPRVSTKGSCVDPSGNDPETGDSDRCGLYKEADPARLVAMGRVYEGSTVVHNTPLLPGQVKVSVEEVADADAPVPVPTDEVSLVGQTLHTFLAWLTHLVAVSPPKPPPKPDPEVNDPLI

SEQ ID NO: 128739 - protein, 74 aa, Glycine max
  Coding DNA Sequence Number=SeqID_37054
MVEEDALSLDNIECGVCAEYTDAGVYGRRNSGSNKEAFEMGERRLHLSWTHSERNYGTLLNPSIWQKMPQVTNS

SEQ ID NO: 128740 - protein, 172 aa, Glycine max
  Coding DNA Sequence Number=SeqID_37055
MMVDTLPVFYYEKLMGYMPSSFANLVFAGERIEVGLKRGKFDYVSSTSTNARRIRATRAKRKEGDNHAVTSAPAWIKPPQTSHGTHQYAQHHPNFLARAGDSSNSAPGGPPTRPADNAHFGAGFNAIRNFPPRPTPEFTPIPMTYEELLSSLIANQMTVISPRKIYQPPFPK

SEQ ID NO: 128741 - protein, 108 aa, Glycine max
  Coding DNA Sequence Number=SeqID_37056
MDILVSLILSRTPPPPIQLPPECEKKPMRSELSRIGCWANGLSYLNVATYPSAGGRRETRGMRVPRKEYARSRHQRLFEENVGKTGKDAIYELLSERSGSCIYARGRY

SEQ ID NO: 128742 - protein, 211 aa, Glycine max
  Coding DNA Sequence Number=SeqID_37057
  Homolog annotation: Hit_ID=Q6WAY4; Match level="QueryCoverage=88%, HitCoverage=33%, E-value=2e-19, Identity=34%"; Hit description =Putative uncharacterized protein
MTGTNQNGKRFYQVKIKGLDVTSLKELGWLMGALQRQAFHKMFGKILDLTTAEVFTEAVVSLAQYYDQPLRCFTFGDFQIVPTVEEFEEILGCPLGGRKSYLFSWFLPSLSKIVAMVGDSARELDCRKQTRNGVVGLRRKYLEGKARDMANQEEWVTFADILALLIFGVVLFPNVDGLVDLAAIDASLAYHHSKESPVVAILADLFDTFDR

SEQ ID NO: 128743 - protein, 112 aa, Glycine max
  Coding DNA Sequence Number=SeqID_37058
MEIDFDKIQSVPTRKEGQISSKTLTCLNLRRSEYRQLPQQLHSLKGLQHKVLALLSIPLSFVDSLASFPTGTTDYTLTKKRAAFPNLAGISPTRRKGKKDKRSDLSKKTSTG

SEQ ID NO: 128744 - protein, 69 aa, Glycine max
  Coding DNA Sequence Number=SeqID_37059
MAHHIVVGMHKFYKVVSGVRFSQVEGKILKMLPENNTLSKNHYENCVSAPHVGYDGTKSRMTTALMMQP

SEQ ID NO: 128745 - protein, 60 aa, Glycine max
  Coding DNA Sequence Number=SeqID_37060
MKLYMAYLARPKWRRKKAQMEKDEGRSGKGRSPKWRRMKAQVERGRRPKWRRTKDPSGEG

SEQ ID NO: 128746 - protein, 352 aa, Glycine max
  Coding DNA Sequence Number=SeqID_37061
  Gene Ontology: Mol. function=transporter activity; Biological process= transport
  Homolog annotation: Hit_ID=Q093I0; Match level="QueryCoverage=59%, HitCoverage=51%, E-value=1e-10, Identity=26%"; Hit description=Outer membrane efflux protein
  Pfam annotation: Domain name=OEP; Domain location=40-205; Score=0.4; E_value=0.0099; Accession=PF02321.9; Description=Outer membrane efflux protein
MPSNMINFTLFMNRIICTRIALSFFVALLTACQGPQSIKPKELVANIVSQDQSLQSKQHEQLNETDEFLSEYAAVILALRNNPTFQAQLTELEIAQADLQLATKCKLNQNRRNYKLMQTGFSLVRDARVAYAQAVISQEKVKRLEEALSINNTITRLAKTRENLGDTSAQDSLIAENEMLLVKRDLQSARIEARIANTQLMHMLNHANETRKLSLSDTLLPSCSAEDISQLKTAAISSRADVLAAEAAIMAVKEKRRLNGLNWLAPAAIADATSGQTNGHVLAPALRFNLPIFNQNQGQVERIDAELLKTMHEAEATKLKASLDIQVSQFKYQRDCQEWQQLQTALLPNSVQ

SEQ ID NO: 128747 - protein, 53 aa, Glycine max
  Coding DNA Sequence Number=SeqID_37062
MQDPSCKMSQRALLWASEGEAHGCAFQRRKDARSRHQRLFVENIGKTEGNWSK

SEQ ID NO: 128748 - protein, 175 aa, Glycine max
  Coding DNA Sequence Number=SeqID_37063
  Gene Ontology: Mol. function=binding; Cellular component=plasma membrane; Biological process=establishment of competence for transformation
  Homolog annotation: Hit_ID=A4TPR4; Match level="QueryCoverage=99%, HitCoverage=71%, E-value=6e-83, Identity=86%"; Hit description =Lipoprotein precursor
QVQLDLIYAYYKNADLPLAQAAISRFMRVNPTHPNIDYVIYMKGLTDMALDDSALQGFFGIDRSDRDPTHARDAFRDFSQLLRGYPNSQYAADAQKRLTFLKDRLAKYELSVAQFYTKRGAYVAVVNRVEGMMRDYPDTQATRDALPLMENAYRQLQLTTEADKVAKIIAANSAS

SEQ ID NO: 128749 - protein, 47 aa, Glycine max
  Coding DNA Sequence Number=SeqID_37064
MKILSSGVIFTLEEGEELATQLAQASKVASSRSNSLLEEGSGRPKWV

SEQ ID NO: 128750 - protein, 93 aa, Glycine max
  Coding DNA Sequence Number=SeqID_37065
  Pfam annotation: Domain name=G-patch; Domain location=1-42; Score =21.1; E_value=0.00054; Accession=PF01585.14; Description=G-patch domain
MVARVMLRNGFEPGMGLGKDCLGNADVVDIKGNPYKYGLGYELGMPGRRNVPSRFRADRFPQDPPSFVQPCHPDSQVGNWRVISQSEVYTADS

SEQ ID NO: 128751 - protein, 106 aa, Glycine max
  Coding DNA Sequence Number=SeqID_37066
MNEECRRTVETFAKFLTETKLGEKLATQLAQVSRVASSRSNSLLKESSGGPKWAWLLFAPPFLLSTPPAFFLHVLEFHKLPNDGCQAPHKDQTKVACHQAKVPGRN

SEQ ID NO: 128752 - protein, 255 aa, Glycine max
  Coding DNA Sequence Number=SeqID_37067
  Gene Ontology: Mol. function=nicotinate-nucleotide diphosphorylase (carboxylating) activity; Cellular component=chloroplast; Biological process=pyridine nucleotide biosynthetic process
  Homolog annotation: Hit_ID=A7P3K3; Match level="QueryCoverage=38%, HitCoverage=30%, E-value=2e-41, Identity=86%"; Hit description =Chromosome chr1 scaffold_5, whole genome shotgun sequence
  Pfam annotation: Domain name=QRPTase_C; Domain location=91-239; Score= 39.1; E_value=8.4e-10; Accession=PF01729.10; Description=Quinolinate phosphoribosyl transferase, C-t
MLGAQAIELVRKITSTARDDCEPKLNDPDLAPLSRAPAESLAEWAGLRGPLAEWPHILILREWRNLRHENFKCLDVLIDSGCLVEELKLRKRITHLVVAVTLEQHAFERGPIVAPGESEQHNKVSYISVHIAVTNWESSLTLVETRTLEEVEEVLHYSSQTKTSLTRIMLDNMVVPLPNGDVDISMLKEAVQLINGRYETEASGNVTLDTVHKIGQSGVTYISSGSLTHSVKALDVSLKIDTELALKVGRRTGRA

SEQ ID NO: 128753 - protein, 78 aa, Glycine max
  Coding DNA Sequence Number=SeqID_37068
MEVHRQHLACPLTFCVVLQPFHSEDLLQLGMSMGWGREYFSASYSYSQLVLVLVPGLCRGDFFFPFPSLRVPTVYVRP

SEQ ID NO: 128754 - protein, 365 aa, Glycine max
  Coding DNA Sequence Number=SeqID_37069
  Homolog annotation: Hit_ID=A7UQU7; Match level="QueryCoverage=86%, HitCoverage=72%, E-value=1e-16, Identity=33%"; Hit description=IMP dehydrogenase/GMP reductase, putative
  Pfam annotation: Domain name=DUF1723; Domain location=148-197; Score =57.4; E_value=4.9e-14; Accession=PF08330.1; Description=Protein of unknown function (DUF1723)
MVRTRGLGRAIGRVIGRDRQDEDDAVDVPQRRKPTASARRQQVQQMTEDVSHMTEDVPHMAEDAPEMTTDIQAIVAEDLGRDGAEGSHADDAEGFRGGPRDPSVLTSFVDHVANAIWSGQERPKLKLVSHGRKVMLIGSPLIGCSVVTGDPRLISAFVERWHRETSTFHLSVGELTITLDDVLSLLHLPISGAFHSFHALSVDEALDEASRTTTRQIEGYLTLLQCWIYEHFPSVHQCVTDDAYEETSPRASRWLTTKAHMKGITGASYQACCDALTVTDVCWLPYSEHRGVRGFELISSFQGQLRWDPMVVTVRPKRVLRQFGYIQSIPSPPVSALLSYDDIDDMWMHFADHVLAVGELCVVPG

SEQ ID NO: 128755 - protein, 41 aa, Glycine max
  Coding DNA Sequence Number=SeqID_37070
MDEDHWMYDYIMSEEVNMNEENGEKPNVNEENGEEVGVCYL

SEQ ID NO: 128756 - protein, 220 aa, Glycine max
  Coding DNA Sequence Number=SeqID_37071
  Gene Ontology: Mol. function=hydrolase activity, acting on glycosyl bonds; Cellular component=beta-galactosidase complex; Biological process=carbohydrate metabolic process
  Homolog annotation: Hit_ID=A7PDT0; Match level="QueryCoverage=93%, HitCoverage=30%, E-value=4e-45, Identity=39%"; Hit description=Beta -galactosidase
MYPLGYQYSQNRQYSFTYEAKIKLKKGTNEISLLSGTIGLPNYGAHFSNVSVGVYGPVQLVALKNNTEVVKDITNNTLNYKVGLHGEIVKLYNPENNKGWNTNGLPTYRVFVWYKALFKSPKGIDLVVVNLKGYHLPCSFIREDNQNTLVLFEEFEGHPNEVKFVTVTVDKICANSYEGNMLELSCYEEQVISKIKFASFAVPEDECGSPNALSIQSKFS

SEQ ID NO: 128757 - protein, 206 aa, Glycine max
  Coding DNA Sequence Number=SeqID_37072
MGRSFFLTIFMAFLCGGCRRGYIGAPSNIVGAPSNLLKGQFCPSFKNIKSFFPLRKHSVFSSAKKFFSSLLSSAKASFLGGLLLRLHLLCKASLFHLHSRVEDAEKNGGSLVTVNLPEDPLGVLPELPKEDLPEDFRKKGFSGSNEMTSGRTGLPESSRNISSGMFSEDVLLPETFRKSVLPDDLSVVPEALSGRPFFRNVSERID

SEQ ID NO: 128758 - protein, 135 aa, Glycine max
  Coding DNA Sequence Number=SeqID_37073
MLEFTSDCPPQISASLHQSDFAPYASRSYSAQWNVLELPNDKHMSHSSCILKEMKVMDRTKIGSVVILLGRILVHGVIKGYWKVWPRGNCNHNMRFSLLLPFVTPLRSPITRIYKSNIIKFPSPQSCFNSLARKH

SEQ ID NO: 128759 - protein, 77 aa, Glycine max
  Coding DNA Sequence Number=SeqID_37074
MKANMTAMKEQVTTMMEAMMSMRKMVEVNIVIVVATSTATKRDLIHSSRFNQESHPVLDVVGQGGEAMTNAYGLHYV

SEQ ID NO: 128760 - protein, 140 aa, Glycine max
  Coding DNA Sequence Number=SeqID_37075
  Homolog annotation: Hit_ID=Q8LGT5; Match level="QueryCoverage=90%, HitCoverage=61%, E-value=4e-50, Identity=83%"; Hit description =Putative uncharacterized protein
MPKRLYFLVELPKEVTVAPRRVRSGINMSAKERLESLVLARRSASDLTIMKPPSSQKEVMESGGGVRLKMRLPKAEVERLMRGCETEAEAAEKIMGLCMANNGGGVEARNGDGEVKGRVGESTKAREPVYDKLLRGLELS

SEQ ID NO: 128761 - protein, 544 aa, Glycine max
  Coding DNA Sequence Number=SeqID_37076
  Gene Ontology: Mol. function=acyltransferase activity; Biological process=metabolic process
  Homolog annotation: Hit_ID=A7P8K0; Match level="QueryCoverage=23%, HitCoverage=36%, E-value=5e-41, Identity=61%"; Hit description =Chromosome chr3 scaffold_8, whole genome shotgun sequence
  Pfam annotation: Domain name=Acyltransferase; Domain location=446 -544; Score=8.1; E_value=0.00017; Accession=PF01553.12; Description =Acyltransferase
MEGSGSECSEAEASSWTRKLELPTFDGIIEGETDSKGNSFECDDDPLQFLKLENTSKEGSVIKNHAPCCGEETKNEAKLARETANGKVMMEEEVDPLIKKEKHKENRVKNVDCEDHFLDNPIPKLIKKEVETGDAAKPHSFQDSDFHKKIVMMKHKSLLDPNSIMKVVGTSMVLESFNVNLLAEPLALNFVVPMDDRSTMEPRPKECTEAVMMVQVIRSPPSSPPPPKLPDLSLYEVASGFTKVLQIAAIVALSRYSIVGFKENAIAMVSHCGLHENRNRGRLTHHGISLCRGCCIVGFRKGQVQTADSGRVCTAIQSCFGLVDKRDTKEAHLVRVNDSVLKDEKEEGEFLEFYNPCVADDIIRAEMERDCSTTHGSPDYSEFASITTSTRATEHNPACRGSGSFLVKLQLQWVQLSSSNHRKLEEVSRSLVEMMCSFFVASWTGVVKYHGPRPSRRPKQVFVANHTSMIDFIILEQMTAFAVIMQKHPGWVEYHFGESRMHLVQPYRGKGSGNSSKEGADNNPLLIFPEGTCVNNHYTVMFKK

SEQ ID NO: 128762 - protein, 402 aa, Glycine max
  Coding DNA Sequence Number=SeqID_37077
  Pfam annotation: Domain name=Transposase_23; Domain location=133-192; Score=4.3; E_value=0.0004; Accession=PF03017.5; Description=TNP1ENSPM transposase
MSVKHPGRVRVGGHGVTITSYFGHASCGSHSSSPAITAERLVEIIQTIKQEVKKEVEDENKDRMDKMKMELDAIKSELSQIHTQQSAPPRPSNPDIFVAHVSTKESCAEAANNVVGNERSTFDTCSMGFYIVCGDSTQLVAGGKVFGVGGTIHTVAYGDDVVRVCVDTVYDAEAIVPLPTSEIQYVRDAVNSFIGWPRHLVKPLSYDSDLNVWKPVEHSSDAKLAVEVPWEAHQFGLPEIGAKFYITHADLAKIISGDKCLNIAILQLWTIFMNECGRSKADQSLYGLLEPQSIQNAKERRQQYIETWVKESQSAMKTITSSFEGMSNQGAPRWVEPKTNVQSGGFECGYYVMHWMWCIVTAGLKDDWHKWFSDGSSLDVEAITTVRQKWATYFLSFRKSSC

SEQ ID NO: 128763 - protein, 44 aa, Glycine max
  Coding DNA Sequence Number=SeqID_37078
MEDCLEGPHLGNHETQLQTRKWRTHERKRNSWAPKEGAGPNGPP

SEQ ID NO: 128764 - protein, 173 aa, Glycine max
  Coding DNA Sequence Number=SeqID_37079
  Gene Ontology: Mol. function=protein kinase activity; Biological process=protein amino acid phosphorylation
  Homolog annotation: Hit_ID=A7QMC2; Match level="QueryCoverage=53%, HitCoverage=6%, E-value=8e-11, Identity=37%"; Hit description =Chromosome undetermined scaffold_125, whole genome shotgun sequence
MEVNEKCDVYSFGVLAIQTPFGEYHEDFITSLLTSSSNFIDSTLDIPSLMGKLDQRLPYPPNPIAKEIVLTVRIANACLIENPILALPWSKLPKNLQYVATCPSRASEGEAHGCAFPKEERCAESPPTFICGKRRKNRRKSVKMKILSSGVVFTFEEGISTSHVCLKGQQPIF

SEQ ID NO: 128765 - protein, 108 aa, Glycine max
  Coding DNA Sequence Number=SeqID_37080
MGLRKLMTTDENRDQTPEIGRKRAARHVIATLWRAINYSGSEHRFYREKLSVMEKQTELDYFDEKKLMIAKLLRRKSTETLTKVRLAAKKAELPNLDGTDQVGIVGVC

SEQ ID NO: 128766 - protein, 420 aa, Glycine max
  Coding DNA Sequence Number=SeqID_37081
MLTENTPQIDDSSTSPIERHVKWKLARTKRYGQMTSKAAQEISDKIKNKQHRVPLFSKVVRHTEHCHWVIESWRSCSCNGICLKEEWRNEIIVNLKEEMRNEIEEENKRTLEKMKQELKETIKIDTKGSNAKNVVNPLGEEHEANAIPTIGLHVQGDTCTRLVALGNIYDAGSTIHIVAYAGDVALHIFIAWPANLVKVVSHEDSHVTPKKAAKHVQRSNDVGIEDPLRQLIRTLYDIYDSFVELLWDGSKFGIPNADASFFLTYSDDVVLWLCSLRKKLDIHIKVPVNNSVMKTLKSSLDGHIDKVAMQWIEIKSHVQTGGYGCGYYVMYWMWNIVGGELKNDWSMGTSFVVQVEGTSTWVVVTDNKRGYISCGSVQVEGTSTWLFKENKGGYIPCGSLLVKAFTKLKRNLKDHRSLGD

SEQ ID NO: 128767 - protein, 159 aa, Glycine max
  Coding DNA Sequence Number=SeqID_37082
MAYVRARPPWPRTAREWAKGKDWGPDFTGAGDLGWTSETVPPLEPAVAYLQLVIGPPLAAMAPDPVLVWDAVFLDEGPINMRPDDLAGGDGHSVGLVETRDQSGKRHPYMCKGGHAGAHDSHPSPCGGPGEVLPRHVSSSGCTRTFGPLPRSVGAPGTG

SEQ ID NO: 128768 - protein, 171 aa, Glycine max
  Coding DNA Sequence Number=SeqID_37083
  Pfam annotation: Domain name=G-patch; Domain location=103-147; Score =21.8; E_value=0.00044; Accession=PF01585.14; Description=G-patch domain
MYPKAHENPKAFSCISSPILLESSIQCLCGLSFGPTLDSLGWGGPFNAPPKIEVRGGRAFGHCVGGGGYSTAEESLETAFQSFKVVSNAFVESLPTQPRIFDAAMMVARVMLGHGYEPEIGLGKNNDGVASFVEFKENRKGFGLGYRSTRADVRRSTLEKRSRGMSQQPRP

SEQ ID NO: 128769 - protein, 85 aa, Glycine max
  Coding DNA Sequence Number=SeqID_37084
  Subcellular localization annotation: CTP_CleavageSite=78; ConfidenceScore=5.57e-01
MRLKKGTSKGFRGNLRQSVHGGAAKSATKKKPTPSSGAAAKVAVKKTIAPRTTNSGIQKVVLVSFELRDFLDAPQVSRFEAVKKV

SEQ ID NO: 128770 - protein, 146 aa, Glycine max
  Coding DNA Sequence Number=SeqID_37085
MIMRGQDIYSSQDEGIYPQEEGQPLMVKEECKEVSVSSKRNNQHENTEKLSSNFSRKLLKEVQQAKRSRNKEKEEENQKKPKSSKALSAGCAQRARRQGAKRTTRAEREASRSASLRRPKPKFAPINKRVSLGKRTHFLRAQFSNF

SEQ ID NO: 128771 - protein, 134 aa, Glycine max
  Coding DNA Sequence Number=SeqID_37086
MVSEGVDSVTRRLGQPYLGFGILTRSSLSCIATATPKERTLDLIEENGECGEGTGVREQMNGGLQNFLSCSQVLTASWLQERNYPSMHSSGEWHGGTNVGNFVAAIKVEEPQNVKEEPKAIVISFDDELEALKG

SEQ ID NO: 128772 - protein, 168 aa, Glycine max
  Coding DNA Sequence Number=SeqID_37087
  Homolog annotation: Hit_ID=A5B8E7; Match level="QueryCoverage=91%, HitCoverage=25%, E-value=4e-07, Identity=24%"; Hit description =Putative uncharacterized protein
MGFCLEKKLSDWEVNLVSDFLAELNNYSIRPSEQDRWMWVAGSENIYTVRGAYAWFCERVREIWLECYSWIGFSSGVQVVPREHFLQHWYCESGRIDGQRQMVLWAAVTWCIWRHRNKYIFNNQEFRGETVLDDAMFFIWSWLNALEKGFNVPFQVWSSNIRMNFVRG

SEQ ID NO: 128773 - protein, 115 aa, Glycine max
  Coding DNA Sequence Number=SeqID_37088
MAQRQLMGSFPKEESSGLSRKIVRMILMRACVMFPHGSFTIKDLLIVDLVSHPFVHSFSLRFRLMVTALTLDLYQGIDVLPNLAWERQSIIRCNDAIIRHWMTQTSLKVLMKSKT

SEQ ID NO: 128774 - protein, 234 aa, Glycine max
  Coding DNA Sequence Number=SeqID_37089
  Homolog annotation: Hit_ID=A9PCD9; Match level="QueryCoverage=53%, HitCoverage=46%, E-value=1e-31, Identity=51%"; Hit description =Putative uncharacterized protein
MATSPPTKMTPVIIISGRKVGKTLQDMGTGQDLVVQRRESMALNFEGLVLVCTWIDDLEFVVQSTPPSRWPGLNDANQVMAYFAVTKLGEAPIDGTTDTFPKGLTSVYGKWVSDVAKRLVLLGTSMVDGLVVNGSTLEMDEDQWMYDSIMSEEVDMNERNEDDAGVNEEHVDYSDVFNTSRVFATRDDVLHWARSVAYEIGFAVVIMRSDTNTGNMGVPLSFMGNQWLEAKHGW

SEQ ID NO: 128775 - protein, 68 aa, Glycine max
  Coding DNA Sequence Number=SeqID_37090
MAIPVMNHGSDEDTEHGFSKDDVDLLYDGDFDESGWALDRRLQVDWARDAREGPRVLMSLRVDFGLMN

SEQ ID NO: 128776 - protein, 47 aa, Glycine max
  Coding DNA Sequence Number=SeqID_37091
MEREEDKGGWRLREVEWRRKKDDWRCHFKEKMSQEEVHHHRKLWIRA

SEQ ID NO: 128777 - protein, 90 aa, Glycine max
  Coding DNA Sequence Number=SeqID_37092
MKNGEKREVVAAQLPQASWVDSTRRHRLLLEPPGRPKLRNDTHFLSGMLRNFTDYAKMPFLTSECFRTLQGLRNNASFRLLECCGTSRIT

SEQ ID NO: 128778 - protein, 100 aa, Glycine max
  Coding DNA Sequence Number=SeqID_37093
  Homolog annotation: Hit_ID=A5BKX1; Match level="QueryCoverage=96%, HitCoverage=32%, E-value=1e-11, Identity=37%"; Hit description =Putative uncharacterized protein
MSCDKGRKPNIYHLHVFGCKCFVLNNEKDNLAKFDVKSDEDSLENMHIHEEGHKGKGDENDEDSQIDKTKTNTDIPKEWRTSRYHPLDNIISDISKGVTT

SEQ ID NO: 128779 - protein, 141 aa, Glycine max
  Coding DNA Sequence Number=SeqID_37094
MDNNEKGFRHGEDIDGFVLGASHGRGGAEEDEGDRRVALRTPPMLSLELPLREKKGYVEEESKVDRLVVMQKKPFSVKNVDNLVDEVHEKPHHPDTNHVGTDIESFPSGLEDTSVLTDYGYHVAARVWEYTELSLTSHGRK

SEQ ID NO: 128780 - protein, 211 aa, Glycine max
  Coding DNA Sequence Number=SeqID_37095
MASSKHQRQSLCFYTLFLDLHGNWAKWPPEKEERPPPDLRSPTIPLEFHQELERRRWHRALTRQSDNHIDVALFKEFYANLYDPKDKSPRQCRLRGKLIKFDAATLNEFWRPLWFWSQGSSTPHTLGSPREAPEEGSHDTGSDLKCLILLQPHPLFSHVRSKYGQGEVGIWIGDEDGHGRGLHHFWSDITDGPIQLLSAWIPCAHHGFMYR

SEQ ID NO: 128781 - protein, 115 aa, Glycine max
  Coding DNA Sequence Number=SeqID_37096
MTKGNPGDLQPFDPEKDRTFHRLVKHSVHPDHSVHFEHSEYFVAGDSKHSDFEHSTTNFHTENMAQPLPRERTLREMVAPDFTYESLCIQYPDEDVSYVLKTGLIHLLPKFHGLT

SEQ ID NO: 128782 - protein, 82 aa, Glycine max
  Coding DNA Sequence Number=SeqID_37097
MNKSLKLGKDEMRERERRSTEFGASNELWFSPLIQDQVQDSPMRLDAILPNRGPITRAMARRLQEHWLRDAGEGPRVLMSLR

SEQ ID NO: 128783 - protein, 440 aa, Glycine max
  Coding DNA Sequence Number=SeqID_37098
  Gene Ontology: Mol. function=phosphatidylinositol binding; Cellular component=Golgi apparatus; Biological process=clathrin cage assembly
  Homolog annotation: Hit_ID=A7P3R3; Match level="QueryCoverage=91%, HitCoverage=73%, E-value=1e-146, Identity=64%"; Hit description =Chromosome chr1 scaffold_5, whole genome shotgun sequence
  Pfam annotation: Domain name=ANTH; Domain location=3-196; Score =107.5; E_value=3.9e-29; Accession=PF07651.7; Description=ANTH domain
MPHHSNRKVNFISLNFWESWSLTSSLLLSLEISNERLECFQVLNYDIEAERLAKPVAGEDKGYSRTRDLNSEKLLEQLPALQQLLYRLVGCRPEGAAISNYVIQYALALVLKESFKIYCAINDGIINLVDKFFEMPRHEAIKAFDVYKRAGQQAESLSDFYEICKRLELARNFQFPVLREPPQSFLVTMEEFIKEAPRVVIVPNEPLLLLTYRPEGVPTIEDNKSSEEQEPSVPVDDIVSNSEPAPPQSRNNFETGDLLGLNDSTPDASLIEERNALALAIVSTETGSTALDSSGAQARDFDPTEWEIALVSTPSTNISSVNERQLAGGLNSLTLSSLYDEGAYRSAQQPVYVVPAPNPFEVQDPFALSSSIPPTSTVQMAAIAQQHINPFLHYQPYQPLQQHMLMNPANPFGDAGYGAFPVNPVSHPHNKNPFGSTGLM

SEQ ID NO: 128784 - protein, 201 aa, Glycine max
  Coding DNA Sequence Number=SeqID_37099
  Gene Ontology: Mol. function=phosphoprotein phosphatase activity
  Homolog annotation: Hit_ID=A7UQU7; Match level="QueryCoverage=82%, HitCoverage=27%, E-value=4e-20, Identity=37%"; Hit description=IMP dehydrogenase/GMP reductase, putative
  Pfam annotation: Domain name=DUF1723; Domain location=141-190; Score =59.8; E_value=9.4e-15; Accession=PF08330.1; Description=Protein of unknown function (DUF1723)
MARTRGLGRVIGRVIGRDRQDDHDDVPERCRSTASARRQQDALDMAEEAPEMTADVQGADGAEGSHADDAEGFPGGPRDLSVLTSFADHVAHAVWSEQERPDLKLVSHGRKVTLIGRPVPEIEGMVGATGLSPLIDCSVVTGDPGLVSAFVERWHSETSTFHLPVGELTITLDDVSSLLHLPFTGALHNFHALSTEEAIYC

SEQ ID NO: 128785 - protein, 70 aa, Glycine max
  Coding DNA Sequence Number=SeqID_37100
MANYFDGMVEKMDGKVDDENIQEVLREAALIPDFNRQQWAKAIKWLLSTRNREELRSYKARKKVDSSNIV

SEQ ID NO: 128786 - protein, 193 aa, Glycine max
  Coding DNA Sequence Number=SeqID_37101
MDDDILDKLGKDKPFKVEANIACDRVTINFESILQDLLVKWHQKWMLAAGVSLSEACALSESHALSEALSPLSELGESGGEFEKHLRAQCIINSLCETFVSFCAKRKNGTKQAFEDRKSFLRLKLEKSSIEHGLEHREHNRGKKQSKEAKNLSFQEDLSWKVLPYDGRLSISVGKFCWNMMLSSTRHPRTRFN

SEQ ID NO: 128787 - protein, 76 aa, Glycine max
  Coding DNA Sequence Number=SeqID_37102
MGNEYCNQIIFSLNTTTLHYIIPYAIGASASGEIFTLGLDGPYCSFDDYDFLNKMPNSTRVAVSKPHCALQKWNFA

SEQ ID NO: 128788 - protein, 93 aa, Glycine max
  Coding DNA Sequence Number=SeqID_37103
MEKGRPVSTRIPNEMDEEEKRECELKRNDPLQSSFSLDQDPIDLLHILATLIGVEVNQIRWSKFKSTGHLGWRYCNGGDGGVIGLPTPSSSLW

SEQ ID NO: 128789 - protein, 111 aa, Glycine max
  Coding DNA Sequence Number=SeqID_37104
MVEEFVKDSVHQDSVAVITLDHPKAWYLIFFNKFQTSFSLRAFSTMAEEFVKGSVHQNNVAVITLDPPPPKTALRAPDDGIMTAELLERVYLEIMNKDTDSATDMKSPTAL

SEQ ID NO: 128790 - protein, 285 aa, Glycine max
  Coding DNA Sequence Number=SeqID_37105
  Gene Ontology: Mol. function=nucleotide binding; Cellular component =microtubule organizing center; Biological process=microtubule cytoskeleton organization and biogenesis
  Homolog annotation: Hit_ID=Q9SC88; Match level="QueryCoverage=46%, HitCoverage=17%, E-value=5e-49, Identity=73%"; Hit description=Gamma- tubulin complex component 4 homolog
MGKKQNEIQKTGLGRALLSRFYRKKFLESFTEVSDIDAVVEQSLEPLPKLAAAASTTLISLELIERIIVFGFYYREMERFSGKCRDLSWIRSANANPLEKKEKGSVYRRALANGIVEILSVYRSAVLHIEQKLLSENMPILATVTQGLNKFLCLLPPLYELILEIERDDIRGGQLLNLLHKRCHCGVPELQTCMQRYAVLFTCSILGNVKMQEKQVDLLSKLKKNVSTPEGVPRLFDLVKVQDERMKLAFFAALRNTVVAKDLDQVSCTFVAGCFILMINIKDPS

SEQ ID NO: 128791 - protein, 217 aa, Glycine max
  Coding DNA Sequence Number=SeqID_37106
MVSPQGRNTMLVDDLVPYVEKLAILGEEQERITKPVSHGPASEREFPAQEFHILQSSVETRGIGRRREPVEAEQYSQQMMERGHGMYYTLATFSQYPSQMYQYPFEGHHTDTSTSEHSYGGVAKTQPHFSWPTMTPSHQHDAPIATPNAPFAPQWNVPEAIPDMGDLLGVDLRQEFSAEAEQAEAGRQHGRRNPDRQARRWDRPCGTSSRHHGHHND

SEQ ID NO: 128792 - protein, 217 aa, Glycine max
  Coding DNA Sequence Number=SeqID_37107
MNSVITVLYFNGRVYEDNDDVIFEGSKKAIQIKHGISFNALKKKIGDKKNILPCKFVMTKTLKRCWKVLNNKTKCQFWNCTYKRMWLVVQCFILQIRLHHVEIIYLMLRQPPTNMSNLHIDKDDDDDDYVVSNSYVEESLDEDDSVDGISDTDDDVTDMIQPVHNELKIHFGMMLYIITISTGVILMRRTFVVWRCHRPLMLAKNYMLAWNLIVKMR

SEQ ID NO: 128793 - protein, 67 aa, Glycine max
  Coding DNA Sequence Number=SeqID_37108
MGRIPLAGNNELLADWAAEYVRWGKSLRHVVDPRQKSLQEEEIEEWSEVIRNCVQPDPERRQASPLW

SEQ ID NO: 128794 - protein, 271 aa, Glycine max
  Coding DNA Sequence Number=SeqID_37109
MAQALRVGEHLCRVIGSDDCSLDWQVQFYVSPSCPHLIDTPRAQTIFLEEDDHRCEARIASSRTGFRKLSVRVNLGCGVPVVFLRWKDEKRLKPKLGDLVILPFLGPNHDLPIGARTEKVAKFIRNLVGTYAKWDGGGEICFGRRMCIKVSIDVRKPPRKDHVIRECDEHNREETIEGDEGKAYGTWLQSSSSNKTMITRIKKERNLGRKGVNENPVSIDEVDTSSQTKHQMLFSKSPCASSLTATESRDPICPCCGEEEETVGHLFLEEQ

SEQ ID NO: 128795 - protein, 99 aa, Glycine max
  Coding DNA Sequence Number=SeqID_37110
  Subcellular localization annotation: CTP_CleavageSite=68; ConfidenceScore=5.04e-01
MNNNLDFNLSFRYNKSFNLSQMESSSPPMQDIKIHTDRSSFRNPGFMELCGFTTNMETRLFGIFNGLKVAKAAGFHIVNCESNSQITLKMIFQGVALQN

SEQ ID NO: 128796 - protein, 433 aa, Glycine max
  Coding DNA Sequence Number=SeqID_37111
  Gene Ontology: Mol. function=microtubule motor activity; Cellular component=microtubule associated complex; Biological process =microtubule-based movement
  Homolog annotation: Hit_ID=A5AQK6; Match level="QueryCoverage=93%, HitCoverage=47%, E-value=1e-89, Identity=46%"; Hit description =Putative uncharacterized protein
  Pfam annotation: Domain name=Kinesin; Domain location=3-148; Score= -115.0; E_value=1.2e-07; Accession=PF00225.14; Description=Kinesin motor domain
MTRVLDLTKLSDWCTIESSAREFMGKSSSTTLAASVNFVDLAGSERASQALSAESRLKEGCHINRSLLTLGTVIRKLRLSPSFLAYGVYLLYSASNIVSKPTSGLFNSTPSLGGNSRTSIICTLSPARSHVEQTRNTLLFACCAKQVTTKAQVNVVMSDKVLVKQLQKEVARLESELRTPCPPSTNCDCAAMLRKKNLQIQKMEREIRELIEQRHLAQSQIEDLMCMVGNGQKSRKEDDDSISESSSTYPFDLRIREFNNPHYNNENSESSPDSKFFLFFPLPVNTRCCKEIQSVELEESSRDDLEYADPSVSNNGVLALTLYGEENVISQEIPTPVNEDREEKQNQLTYGVLEQRLDDSQLSNDSPMTMSETVPNCRNLKLLRSWSCREYYTSSSPEKAGVMERTPASSFEKCFPGRLCLSSCDLYYPKKAA

SEQ ID NO: 128797 - protein, 146 aa, Glycine max
  Coding DNA Sequence Number=SeqID_37112
MSHHSSSVNGEGTSHKDPLSRILDELSSLKLCKEKIERKGKGKGKERTSLPEEKKKERKPQEANINLSYFHGKDNVEAYLDWEIRVEQQLKRKFTSKSYGSHSYPKKDQGQGILGATPSKPKDDKGKTIEKQPPKASMQEKTNSIK

SEQ ID NO: 128798 - protein, 214 aa, Glycine max
  Coding DNA Sequence Number=SeqID_37113
MVPSIRFWVHAEGSYFCTTRRGVHKRLSNLKFDSTEYYFLYGFGYDPSTDDYLIVLVGFLDEFDEEPYGVPNVHIFSFKTNSWEEDSVRVPNEIFHGKFRSGSLLNETLHCVCCSVIIDCAKTEIWVMKEYKVQSSWTRIIDIPAYGISLICTTKDGGMYVSQNRPLRKINRNGEPPECLAFDGDRGLFCANLPSGMIVQTLDPGELCRGLVGI

SEQ ID NO: 128799 - protein, 61 aa, Glycine max
  Coding DNA Sequence Number=SeqID_37114
MGTCSRQGQCVDTVCEKYDISNEKWAQFCQTRRDPLWEDVWKKAQAIQKQNTAPRVVSWGL

SEQ ID NO: 128800 - protein, 59 aa, Glycine max
  Coding DNA Sequence Number=SeqID_37115
MAPSQAPPPLHLQSPLRQRVKGRRMEGGRGEGGGKGGGFEVAARKTVLEIAPLCPAPPR

SEQ ID NO: 128801 - protein, 213 aa, Glycine max
  Coding DNA Sequence Number=SeqID_37116
  Gene Ontology: Mol. function=helicase activity; Biological process =protein amino acid phosphorylation
  Homolog annotation: Hit_ID=A3C5F8; Match level="QueryCoverage=95%, HitCoverage=43%, E-value=6e-19, Identity=30%"; Hit description =Putative uncharacterized protein
  Pfam annotation: Domain name=DUF889; Domain location=68-213; Score= -30.0; E_value=1.9e-09; Accession=PF05970.5; Description=Eukaryotic protein of unknown function (DUF889)
MLLSNNIERPNHVWSKTWECLIDGILHQQRRIRNIPNLQLEIKELQTLALLEIKDILQCNKKSLKDYPAMPFARHVRHWWNVFPVWVWRYWEDLYVEDISFCITFKSYTDPIEAIINHTCPDIQKKYKDKEFLKSKVILAATNEVVDQINDHILNIIPSEEKEYFSHDSIDKTNVATTESFEAITPEFLHSLKTSGIPNHKIRMKAGTPVMLI

SEQ ID NO: 128802 - protein, 232 aa, Glycine max
  Coding DNA Sequence Number=SeqID_37117
  Gene Ontology: Mol. function=nucleic acid binding
  Homolog annotation: Hit_ID=Q2HTA0; Match level="QueryCoverage=65%, HitCoverage=27%, E-value=1e-15, Identity=31%"; Hit description=IMP dehydrogenase/GMP reductase, related
  Pfam annotation: Domain name=DUF1723; Domain location=31-80; Score =13.2; E_value=0.014; Accession=PF08330.1; Description=Protein of unknown function (DUF1723)
ERPELKLSSHGRKMAKFGRPATEIEGLVATNGLSPLIACSLDMGDRGLISFHLPVGEVTITLDDVASLLHVPIVGVFHNFEQLHVNDVVDMLVELLKVSVAEARAETIQCHGSYVRLSWLRDVYHMKIEACHRIVAVQAYLLHLFGCTLFAKKSVTHMQVVFLDALRDLTQSGTYAWAAAAIYEHFKSVGSALATEDYDERRPCACRWTFGKALPVSTYRRRLDRLTLDVVC

SEQ ID NO: 128803 - protein, 192 aa, Glycine max
  Coding DNA Sequence Number=SeqID_37118
MDRFALTLNGSQELPRLLARAKAMADVYSAPEEADMKAMKDQMTSMMEAMLSMRRMMEDNEAAVASTSAAIEADPIHPSGINQTSHPAPDMVGQGREVLGSMGGPHMVQNKNSFPSYDFPPNYTPPNAVHVPNENAYHSVLVLLEGQQPQLGHAPFAQPVGEAREEPRDHTLGEFEPYPTYAAEGPAFSGMP

SEQ ID NO: 128804 - protein, 81 aa, Glycine max
  Coding DNA Sequence Number=SeqID_37119
MFLPAGNRRKIKPPWPGGDGHGGHIGGQRPGEGERPLSGLTRRGTSQLSDYGVIRRRPLRNVSANAAFQGKDGLQIGNVRV

SEQ ID NO: 128805 - protein, 33 aa, Glycine max
  Coding DNA Sequence Number=SeqID_37120
MGGQARCSFTNSVAIHVVGYHLLLLIGVAVEAL

SEQ ID NO: 128806 - protein, 44 aa, Glycine max
  Coding DNA Sequence Number=SeqID_37121
MDEFGILDSLILSQAHHCLFNFHREWTTLPLCSRIPYNNRPTIS

SEQ ID NO: 128807 - protein, 69 aa, Glycine max
  Coding DNA Sequence Number=SeqID_37122
RCHPPGEDLEEDLEELPPEPAMDALDLPKDDEDPFPNVDSPEDVMSVSEADSTEESGPGGTTISDDSSS

SEQ ID NO: 128808 - protein, 129 aa, Glycine max
  Coding DNA Sequence Number=SeqID_37123
STLEDPTVPGGTKGAEDDRDSKVSMADLVSAEDDVNLRVSMGLLAAIDEGRRMTIICLCVPSDMTVSEWPKGAQNDHNLSLRAIGHIVSEWQKGCGMTIICLRMSHASGSMTEIVGADKSKALAPTYPQ

SEQ ID NO: 128809 - protein, 63 aa, Glycine max
  Coding DNA Sequence Number=SeqID_37124
  Subcellular localization annotation: CTP_CleavageSite=50; ConfidenceScore=5.21e-01
VPSGVANCRNMPFCGRAKARLTGALSKGGKMRGVTTNVDKSGALAPTYPPSKRKSDLRSSFLK

SEQ ID NO: 128810 - protein, 116 aa, Glycine max
  Coding DNA Sequence Number=SeqID_37125
  Subcellular localization annotation: CTP_CleavageSite=48; ConfidenceScore=5.11e-01
MGVQIEIFKFSNLGLFRTFWKLGFLRRKQPSSGKLGGNLLPPFPINKRREAVPNISNPLGYAFQLFWVKKFVSMNGAGDNGGVYHQLDGSQLLLLDAMTTQMQHLLNRNKEELYSE

SEQ ID NO: 128811 - protein, 47 aa, Glycine max
  Coding DNA Sequence Number=SeqID_37126
KEQNRLRPWSEVKTSQWQKSTKDRVTTDQSSPLPGSGPAENVAARQP

SEQ ID NO: 128812 - protein, 94 aa, Glycine max
  Coding DNA Sequence Number=SeqID_37127
MRLNLEVLKVVVALSSPFGLSAHPLLSVASLSLAHQWAKRASIAKHSYSATEESGRASISRPCTKHEINALSAIVVFSQAQRTTGAKLKSTYSH

SEQ ID NO: 128813 - protein, 74 aa, Glycine max
  Coding DNA Sequence Number=SeqID_37128
  Subcellular localization annotation: CTP_CleavageSite=54; ConfidenceScore=5.18e-01
MYISMAQKYIMKHSQQNMLSNKTPHTYSQNNSKAPKFLKVKEASTRIKPRLWCKQSMGQNTPNDYEDGWLNSHK

SEQ ID NO: 128814 - protein, 124 aa, Glycine max
  Coding DNA Sequence Number=SeqID_37129
MTDLVSAEDDVNLRVSKGLSDAIDEGRRRRNLVSAEDDVNLRVSTGLSDAIDEGQKTTLVSCVLSGFSSYRQQKVYTDNHSGISARQRDSKVSMTDLVSAEDDVNLRVSTGLSDAIDEGRRRRH

SEQ ID NO: 128815 - protein, 117 aa, Glycine max
  Coding DNA Sequence Number=SeqID_37130
STLEDPTHHSHPTHHQEASNRDKLQAHKLQVHPRKASTLHSHRSGCRCRGIHRRKRQWCTVSGLSQQRRWKGRLDEEEVIVGVLDLEGERKRGRRTTCHRGCHGGERRRDKGNKASE

SEQ ID NO: 128816 - protein, 107 aa, Glycine max
  Coding DNA Sequence Number=SeqID_37131
MIGERGHTTLGKEVGRSFPGDITTIWLVMRDDKRSSYVIGDRGEFWNWPRGKSSLSRWNRRPKWALPAGQVVVGAGAWGASLWMGAGALGCTGAELEEFPTRAEKLG

SEQ ID NO: 128817 - protein, 79 aa, Glycine max
  Coding DNA Sequence Number=SeqID_37132
MNPKRIKVIPEWPTPPSVEGRSPEYEEPRDLRSNPFQCGTDAILPARALDTRLQVDWARDPREGPRVLMSLRVDFGLMG

SEQ ID NO: 128818 - protein, 93 aa, Glycine max
  Coding DNA Sequence Number=SeqID_37133
MAFVDNWAVGKEEVCYWLSNDIVGRPSRMIKFASFRTHIDPFTGKDQIRKALRLHPIPNHIKIVLILPNKGTISPSQNGLGKFQVSVPVTATP

SEQ ID NO: 128819 - protein, 159 aa, Glycine max
  Coding DNA Sequence Number=SeqID_37134
  Subcellular localization annotation: CTP_CleavageSite=40; ConfidenceScore=5.26e-01
MFAHSIKGCRPLGRTYGMTSKKRKAPSTPSQVRFDRSWFTSQEAWVRYTDIVVPRKLLPERNAVVYYTEFDEFKEELKRRHWDEDELTPLEPFYFDANVHMAQEEETSTYQIPEPLPKPIPEETQPFAPVMELEQPIQDSSAALALDLNEDQPQDEQDV

SEQ ID NO: 128820 - protein, 161 aa, Glycine max
  Coding DNA Sequence Number=SeqID_37135
  Gene Ontology: Mol. function=aspartic-type endopeptidase activity; Biological process=RNA-dependent DNA replication
  Homolog annotation: Hit_ID=Q69F85; Match level="QueryCoverage=90%, HitCoverage=8%, E-value=2e-20, Identity=33%"; Hit description=Gag -pol polyprotein
MDRFNRIVVQIRNLNPKVALHPMLLALRLDKSADSLCKKSPSNMNELRERAKRTDTHKSDKRHKPDKHQPIPIRPKYERYTPLITNQATILEEVFNVEIPIQLPPIPPPRPGLDKTKNYRYHHNYGHNTEDCWALKDKMEKLIQVGRKHQPQQEQEGQPAR

SEQ ID NO: 128821 - protein, 118 aa, Glycine max
  Coding DNA Sequence Number=SeqID_37136
  Homolog annotation: Hit_ID=Q84VH5; Match level="QueryCoverage=55%, HitCoverage=9%, E-value=2e-17, Identity=73%"; Hit description =Envelope-like protein
VDSRGSHLFEGTHVPDIVSTSGKAAASGAVSKDALIAELKDTCKVLEATIKANTEKKMELERLIKRLSESGIDDGEAAEEEEAAEQEEEEAEEEEEEADEEDAAEDTESDDDDSEATP

SEQ ID NO: 128822 - protein, 113 aa, Glycine max
  Coding DNA Sequence Number=SeqID_37137
  Pfam annotation: Domain name=G-patch; Domain location=1-42; Score =21.3; E_value=0.00051; Accession=PF01585.14; Description=G-patch domain
  Subcellular localization annotation: CTP_CleavageSite=45; ConfidenceScore=5.05e-01
MVARVMLGNGYEPGMGIGKNNSGRTSLVSTRGNCGKFGLGYKPMQANIRKSVAERKSRGQSSQLGRQVKGALPCHISRTFISAGLRHEGQVLARCEDDPPRGSVLVRPCPPGF

SEQ ID NO: 128823 - protein, 134 aa, Glycine max
  Coding DNA Sequence Number=SeqID_37138
MKQFLHKETEEDLVTTPKNVLTQWLRVEAMSSKVILMMPKNQELSKVSSKDSRIRFQVSRFKKNQDQDSRLKIQESREDSIKGVHLLGDCYTENKRGYISCGSVQVEGTSTWVFKENKGRDIPCGSLACKGFYK

SEQ ID NO: 128824 - protein, 84 aa, Glycine max
  Coding DNA Sequence Number=SeqID_37139
GSLLSLEEAVGAMALEEGKIEDLSISAPKKLYQPLSVLDSPVDSWIMDSDGKVYLTLSEEVISTSRPPVDPYGHLHNVNDIFLP

SEQ ID NO: 128825 - protein, 70 aa, Glycine max
  Coding DNA Sequence Number=SeqID_37140
MRAGLAYDTGIWGEFYRLFAAKFPFGCDASSIGACRPRIFFINGFLCFLEDEWQRNGEGRERGDATSRRR

SEQ ID NO: 128826 - protein, 321 aa, Glycine max
  Coding DNA Sequence Number=SeqID_37141
  Pfam annotation: Domain name=zf-CCHC; Domain location=194-211; Score =22.3; E_value=0.00064; Accession=PF00098.14; Description=Zinc knuckle
ELNCHHQKGEDCRSKDFDFDVLKMPYDHDVLMPYENALLKFNSRQKSKNTRYNIKNISSDLEREFQIETAKGLAKKFKLKCLFQEIYSLVLRDRGSLVVKKFEHKGRVVLVWFKTCKEIFQDSETLKRGAWGLDVGTREGIGHILDLTPIGEKMKKNQGLDILGAAPSKPKDDKGKIIEKQPPKASMQEKTSSIKCFKCLGKGHITSQCPTKKIMIMRSQDIYSSQDEATTSHSSSESEVAKGEESSEEIYPQEEGQSLMFKEECKEVSVSSKSLAKKKRHFEIKKNTKKVSPLRQPPHFLLCKKTLVSIATPLGLEFIPQ

SEQ ID NO: 128827 - protein, 169 aa, Glycine max
  Coding DNA Sequence Number=SeqID_37142
MIRGDTLRLSAPFCHPEAAGPMTSRDKIWSFCTLVSSRGGGPDDTRRYLTVIRTLLSSRGGGPDDTRRYLTVICTLVSSRGGGPDDTRRYLTAAGPMTSRDKIWSFCTLVSSRGGGPDDTRRYLTVIRTLVSSRGGGPDDTRKYPSGYPYKHSFAICKTERFDSMQRLT

SEQ ID NO: 128828 - protein, 54 aa, Glycine max
  Coding DNA Sequence Number=SeqID_37143
MKKSGKPSRNRPRKRLGSGKKRVVVVAQLAQASWVASTRRHRLLLEDPGRPKWA

SEQ ID NO: 128829 - protein, 114 aa, Glycine max
  Coding DNA Sequence Number=SeqID_37144
MDGEELPSPVNSDVVKRYYALESGAIKDVTACSLSLRVFWISPRDSPSTISLVTIFQRNERGFEALVLTLGQDHLELPSGVGIKHEQRKPTKVLGNGCKWGWGHDRLIVAPSLR

SEQ ID NO: 128830 - protein, 55 aa, Glycine max
  Coding DNA Sequence Number=SeqID_37145
MGDQEEKMASMMDAMLGMRQLMESNAATATAVSSAAEANPTLPTTAHHPIPNVVG

SEQ ID NO: 128831 - protein, 100 aa, Glycine max
  Coding DNA Sequence Number=SeqID_37146
MQNLKNVSAITLRSSNQIPVPPPVAAPAPEPVKLHSTPEKEDEIVAQKRKLPNKNFHQPPIALPFPPRAIPNKKMEEAEKEILETFRKVEVNIPLLDAIK

SEQ ID NO: 128832 - protein, 274 aa, Glycine max
  Coding DNA Sequence Number=SeqID_37147
YQGSVWRKGQKPWKIKANGLSFIDILELLIFGVVLFPNMEGLVDLAVIDAFLAFHHGEESPIVAILAMYDTPVYPLQGHRSCVEKGKANWDQLLASMDGRLGCINYNPVLAIRQLGYPMRGVPSDKSITPFIARGFSDHNARVLQGVRKAWDAAYHKWLRVRTQGLDWLPNLKTVRDDEVKASEESDEVQALKAELERAWVVEEKFNAAIVSSSSEEVKGIITGQRHDLEGRAKGNMWAIIDKCKEKLNLAATHEQRLEDEYAKISAEREARER

SEQ ID NO: 128833 - protein, 121 aa, Glycine max
  Coding DNA Sequence Number=SeqID_37148
  Homolog annotation: Hit_ID=Q11X98; Match level="QueryCoverage=92%, HitCoverage=68%, E-value=3e-13, Identity=35%"; Hit description =Putative uncharacterized protein
MDTLAQLKSELDSEYQTTRKFFDLYPDDKNEYAPHEKSMKMKSLANHLADVFEWPNTMLKTSELDFGTAQHPTTSATKEDLLKKLDENYKSGIDALENAKEDDLNSTWALKHNGHELAKWT

SEQ ID NO: 128834 - protein, 57 aa, Glycine max
  Coding DNA Sequence Number=SeqID_37149
SMTSSSLCLSSIQTRSGPIDGDVLWMQPKHVSEHVWNGEPDRKLHIKRAVPTYQGEE

SEQ ID NO: 128835 - protein, 224 aa, Glycine max
  Coding DNA Sequence Number=SeqID_37150
MASYGEAKESIDEEDPRPTSSNGACINHEWLKVRIRGLDWLAKLKVVSEENFEAPEEDEEVQALKSELGKAKLAKEKFKLAATHVRKECAGLREENAITARALEQETKRARKEEYGRNKFHGALWGSNNELKLRREERDQSRAHSMVLKEELIACSRSKRSLSQRLCETETNMLAIIAKYQEELGLATAHEHRIADEYAQVYAEKEARGRVIDSLHQEATMWMD

SEQ ID NO: 128836 - protein, 33 aa, Glycine max
  Coding DNA Sequence Number=SeqID_37151
MRLIDRYWKDFLNYYRIKNVLTGKLSMYLAGSK

SEQ ID NO: 128837 - protein, 109 aa, Glycine max
  Coding DNA Sequence Number=SeqID_37152
MCTSYQLDKAPLKYVCHQSKQWFLYQYPFGLSRWLPYPLVDLVPINSTGLIRYRWCHPFFGKIIVHVMNMIIYSSCCRCERLEILEGLLELLQNKECAHWKAKYVSGWI

SEQ ID NO: 128838 - protein, 41 aa, Glycine max
  Coding DNA Sequence Number=SeqID_37153
MHLRDQGTYKENPTEDLAFHTRKPSLQQREEQDERLQKYKW

SEQ ID NO: 128839 - protein, 206 aa, Glycine max
  Coding DNA Sequence Number=SeqID_37154
MTLTIPELFLRPYQVTWDATVFGVFNPDFPLYIKHEDLSKIAHDGQCLSISVLQLWILNLIETSMRAGNSDIYGFLEPQSIQRSGQVQFETGSYIKSWMRSKSNVYLGAYLNGGHWHMVVIVPKEHLVVGFCSLHNRPDNYLKGIINSLNQRLLLGGLSSRQKGSTECGYYVMHWMSTIILGSFRNNWEAYFNDARPLEPERLKAL

SEQ ID NO: 128840 - protein, 104 aa, Glycine max
  Coding DNA Sequence Number=SeqID_37155
  Gene Ontology: Mol. function=protein binding
  Homolog annotation: Hit_ID=A2YII9; Match level="QueryCoverage=98%, HitCoverage=23%, E-value=1e-35, Identity=67%"; Hit description =Putative uncharacterized protein
MVNRRVLGSQTSSKSVTETMSGSHEFVIKGYSLTKGMGIGKYIASETFIVGGFQWAIYFFPDGRDPKDNAAYVSVFVTLHSESTNVRVLFDLTLLDLCKKGEHK

SEQ ID NO: 128841 - protein, 116 aa, Glycine max
  Coding DNA Sequence Number=SeqID_37156
MAEKTKKKLEEVVQSRSTEVVIDPPSPIRRHDSLEKQASQGSFVPHGRQDILTAAIGRPEHPGRVRAAGADAVPIFSHKYNHRDLHCLRSPEVGPSAARVSTKENCVDPSGNDPRH

SEQ ID NO: 128842 - protein, 251 aa, Glycine max
  Coding DNA Sequence Number=SeqID_37157
MTHQMKLTTWAVIIIKDSIKEDHQDSIIAIIFCKTTIEDIIQNPIQGPSHQEKPPISIKEMLLSFIQETRANTQETKAFIQETRSHQKSTDATIRNLEIQIGQLAESIAEKPTETFAVNAEMKPKKDCKVIFTEREEEEKKTEEDVCDEEGEKKKETKRNEEKAQQWEKYSQVEIQQESILQVNTPPHQLIVKEERHGKHEKALSVILSLIATTSLAIMWKVLPEYTSFMASLTKRRKCKEDVFYVTFMPP

SEQ ID NO: 128843 - protein, 139 aa, Glycine max
  Coding DNA Sequence Number=SeqID_37158
  Homolog annotation: Hit_ID=Q84VH5; Match level="QueryCoverage=66%, HitCoverage=13%, E-value=3e-32, Identity=78%"; Hit description =Envelope-like protein
MLSQHPNMLNYTDSVIKRESPLSLHYKLFEGTHVPDIVSTSGKAAASGAVSKDALIAELKDTCKVLEATIKANTEKKMELERLITRLSESGIDDEEAAEEEEEAAEEDKEAAEEEEEAAEEEEDAAEETESDDDSEATP

SEQ ID NO: 128844 - protein, 197 aa, Glycine max
  Coding DNA Sequence Number=SeqID_37159
LVGYQPNLVSRQFGLSQIRPKSLFEDPRDVIRGANLSEKTFKKFLKISLDENYNLHPFEFNHSHFCTIGFVTWWEKYYSGRSVGDTTIMISRLESGFTQPTVENIRSNLQARGKTIMTKKIAETSRADVRPKKPTGVKIQEWKQEEKSQKKDDSTDTTTTSKRSKRVVIELDEEKDAIYILTFLYHHNTGKKRKDLS

SEQ ID NO: 128845 - protein, 105 aa, Glycine max
  Coding DNA Sequence Number=SeqID_37160
  Homolog annotation: Hit_ID=A2I5F1; Match level="QueryCoverage=75%, HitCoverage=5%, E-value=5e-07, Identity=40%"; Hit description =Transposon-like protein
MTSRLMGRCQVGQLLADLVVPYVWNDQRHSQLKIFTREKCVYFNIVMDINGKSKDRHNARIDLEEICNWKELELVDVGHGKFSKPKAAYAMTKSERLVVLNGLKN

SEQ ID NO: 128846 - protein, 56 aa, Glycine max
  Coding DNA Sequence Number=SeqID_37161
  Homolog annotation: Hit_ID=A5BKB8; Match level="QueryCoverage=58%, HitCoverage=9%, E-value=1e-10, Identity=93%"; Hit description =Putative uncharacterized protein
MGGGAWPFLVGGAICLVNSVNERDLSLLNSYVEEFLVSASHQLALTTSLPFVRGIL

SEQ ID NO: 128847 - protein, 81 aa, Glycine max
  Coding DNA Sequence Number=SeqID_37162
MSFFLKNGRYCPIVATYPSAGGRRVTRGMRVPPKEYTRSRHQRLFEENVGKTGKDVIYELLSERFESCIYARGRVFPFAPT

SEQ ID NO: 128848 - protein, 225 aa, Glycine max
  Coding DNA Sequence Number=SeqID_37163
  Gene Ontology: Mol. function=oxidoreductase activity, acting on single donors with incorporation of molecular oxygen, incorporation of two atoms of oxygen; Biological process=coenzyme M biosynthetic process
  Homolog annotation: Hit_ID=A7MRH5; Match level="QueryCoverage=41%, HitCoverage=71%, E-value=1e-28, Identity=63%"; Hit description =Putative uncharacterized protein
MFTHMRIARPVTQLERSMLMFSQGLDLQKIAEFHDHDGFNGVMLGRKDLDWHLEFTCCPGHPVIPSPTEDDLLVLYYPDENAWKLACETMIEAGRGDNGESLVQWFSQEKFAVRLEWGLPAVEHLAGEVDCVVIVDVMSFSTCVSMAVNNGACVYPYPWKDASAIEYGLKMGASTASPDRRFSGEGYSLSPASLRNISEGEKLVLPSPNGSAVSSPTKGCRNSSF

SEQ ID NO: 128849 - protein, 207 aa, Glycine max
  Coding DNA Sequence Number=SeqID_37164
MNVLLAMKAGDLNFGFHPEYLPKQRLGQDILRRAGCDNLTVLHHDQRITEHRCVVEIVNGDNADGWSVRPAEFRSAFAPVRGQCAHADVRHRRDSAIPAHFSPACPRAAERPSRSRHRARSSWKTGNDAECAPVSPHRAHACWRQSCRAARRMPPGGQAVCGRCGRYFARPASHSRHPGAAAGKDAQEGRFTTAVWTNQPYRFTTGN

SEQ ID NO: 128850 - protein, 337 aa, Glycine max
  Coding DNA Sequence Number=SeqID_37165
  Gene Ontology: Mol. function=glycerol-3-phosphate transmembrane transporter activity; Cellular component=integral to membrane; Biological process=glycerol-3-phosphate transport
  Homolog annotation: Hit_ID=A8G869; Match level="QueryCoverage=100%, HitCoverage=74%, E-value=1e-158, Identity=78%"; Hit description =Glycerol-3-phosphate transporter
  Pfam annotation: Domain name=MFS_1; Domain location=1-291; Score =31.6; E_value=2.9e-06; Accession=PF07690.7; Description=Major Facilitator Superfamily
MGFVPWATSSIMVMFVLLFLCGWFQGMGWPPCGRTMVHWWSQKERGGIVSVWNCAHNVGGGIPPLLFLLGMAWFNDWKAALYMPAFGAILVAIIAFALMRDTPQSCGLPPIEAWKNDYPPDYSENHEQELTAKQIFMQYVLPNKLLWYIALANVFVYLLRYGILDWSPTYLKEVKHFTLDKSSWAYFLYEYAGIPGTLLCGWMSDKVFRGNRGATGVFFMTLVTIATIIYWLNPPGNPGIDMICMIVIGFLIYGPVMLIGLHALELAPKKAAGTAAGFTGLFGYLGGSVAASAIVGYTVDFFGWDGGFLVMIVGSVLAVVLLLLTMVSEHRHKQQQA

SEQ ID NO: 128851 - protein, 310 aa, Glycine max
  Coding DNA Sequence Number=SeqID_37166
  Gene Ontology: Mol. function=transcription factor activity; Cellular component=cytoplasm; Biological process=regulation of transcription, DNA-dependent
  Homolog annotation: Hit_ID=A8G8B1; Match level="QueryCoverage=100%, HitCoverage=99%, E-value=1e-132, Identity=75%"; Hit description =Transcriptional regulator, LysR family
  Pfam annotation: Domain name=HTH_1; Domain location=4-63; Score=66.6; E_value=8.5e-17; Accession=PF00126.18; Description=Bacterial regulatory helix-turn-helix protein, lysR family
  Pfam annotation: Domain name=LysR_substrate; Domain location=84-290; Score=168.1; E_value=2.4e-47; Accession=PF03466.11; Description=LysR substrate binding domain
  Pfam module annotation: Pfam domain module=HTH_1::LysR_substrate; Domain location=4-63::84-290
MIELKHLRTLQALRHTGSLAAAAAQLHQTQSALSHQFSDLEQRLGFRLFVRKSQPLRFTPQGEILLQLAEQILPQIQQALQACHEPHQTTLRIAIECHSCIQWLTPALNNFRQSWPQVVMDFKSGVTFDPQPALQQGELDVVLTSDILPRSGLFYAPMFDFEVRLVLAPDHRLAQLAHITPEDLADEVLMIYPVQRQRLDVWRNFLQPAGVSPALKSVDNTLLLIQMVSAGMGIAALPHWVVESFEHQGLVVTRTLGDGLWSRLYAAMRDGEQRQPVLEAFVRFARQHACEHLPYVRDASRPGSLQPVSS

SEQ ID NO: 128852 - protein, 266 aa, Glycine max
  Coding DNA Sequence Number=SeqID_37167
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q6DAS2; Match level="QueryCoverage=98%, HitCoverage=34%, E-value=1e-139, Identity=90%"; Hit description=5 -methyltetrahydropteroyltriglutamate--homocysteine methyltransferase
  Pfam annotation: Domain name=Meth_synt_1; Domain location=14-227; Score=-180.3; E_value=0.072; Accession=PF08267.3; Description =Cobalamin-independent synthase, N-termina
  Pfam annotation: Domain name=Meth_synt_2; Domain location=1-260; Score=532.5; E_value=4.7e-157; Accession=PF01717.9; Description =Cobalamin-independent synthase, Catalytic
  Pfam module annotation: Pfam domain module=Meth_synt_1::Meth_synt_2; Domain location=14-227::1-260
MVEYFGENLDGFVFTQNGWVQSYGSRCVKPPVIIGDVSRPQPITVEWAKYAQSLTDKPVKGMLTGPVTILCWSFPREDVTRETIAKQIALALRDEVQDLEKAGIGIIQIDEPALREGLPLHQSDWAAYLRWAVDAFRLNAAVAQDETQIHTHMCYCEFNDIMDSIAALDADVITIETSRSDMDLLDAFKAFEYPNEIGPGVYDIHSPNVPSVEWMEDLLRKAAQSIPQQRLWVNPDCGLKTRGWSETRQALANMVKAAQKLRAETV

SEQ ID NO: 128853 - protein, 333 aa, Glycine max
  Coding DNA Sequence Number=SeqID_37168
  Gene Ontology: Mol. function=binding
  Homolog annotation: Hit_ID=Q6FF52; Match level="QueryCoverage=76%, HitCoverage=58%, E-value=4e-53, Identity=44%"; Hit description =Putative uncharacterized protein
MAASDYPLARQCCEEVLRVMPNQMQVLSDYALTLMRVGEHKKSYKIYQKIYQAPAAQRAQASETWLDGLTEVCGWLDKTDEVARYGLESLTQSDMRFSQGAKATFPAPAPAPINRSNPAENIISFSLYGGQPRYCETLIKNVEVARELYPDWMCRIYLDDSVPQHVWQRLTQPNTQLVDMSQEKTIFPTLWRFLVMDDASVKRYIVRDADSLLSEREVAAVDAWLASPFWFHHMRDYYSHTELLLAGMWGGCHGVMTAASALPTSTSSRWRCGPRYATASSITTISFTSTTRSRGRRMRRFAGRPTASTSAATPVSPAWPAKCQRRKCQQQWS

SEQ ID NO: 128854 - protein, 923 aa, Glycine max
  Coding DNA Sequence Number=SeqID_37169
  Gene Ontology: Mol. function=kinase activity; Cellular component =integral to membrane; Biological process=ubiquinone biosynthetic process
  Homolog annotation: Hit_ID=A7ZU42; Match level="QueryCoverage=57%, HitCoverage=97%, E-value=0.0, Identity=80%"; Hit description =Probable ubiquinone biosynthesis protein ubiB
  Pfam annotation: Domain name=ABC1; Domain location=305-425; Score =192.2; E_value=1.3e-54; Accession=PF03109.7; Description=ABC1 family
  Pfam annotation: Domain name=MttA_Hcf106; Domain location=725-777; Score=53.6; E_value=7e-13; Accession=PF02416.7; Description =mttAHcf106 family
  Pfam annotation: Domain name=SCP2; Domain location=12-113; Score =88.4; E_value=2.2e-23; Accession=PF02036.8; Description=SCP-2 sterol transfer family
  Pfam module annotation: Pfam domain module=ABC1::MttA_Hcf106::SCP2; Domain location=305-425::725-777::12-113
MTFTPLITGGLETALNRVLYRDRSLKTARQRLAGKVLLLRLQELDFPLVLVFSENQLDVLSDWQDRSDCSVSLRFSTLPKLRDRQQLTSLIRSGELDVEGDLQVVQQFSALMDLAELDPAEYLAPWVGDIAAQGISQAAQRALAQLKQQVTRRQDYLGQVLTEEWRVAPGALEQAWFCEEVEAMERAFGTAGGEMTLGEIRRLYFIIKVFLTYGLDELIPHMRITLPLRLWRRCVFWIPNRHKEAEMGIRLRLAMEQLGPVWIKFGQMLSTRRDLFPPKIADELAILQDRVAPFDGVKAKAQIERSIGGPVETWFDDFDIKPLASASIAQVHTATLKSNGREVVIKVIRPDILPVIKADMKLIYRLARWVPRLLPDGRRLRPMEVVRDYEKTLIDELNLLREAANAIQLRRNFDQSRMLYVPEVFSDYCSETMLVMERIYGIPISDVATLEQHGVNMKLLAERGVQVFFTQVFRDSFFHADMHPGNIFVSYEHPEDPQYIGIDCGIVGSLNKEDKRYLAENFIAFFNRDYRKVAELHVDSGWVPPDTNVEDFEFAIRTVCEPIFEKPLAEISFGHVLLNLFNTARRFNMEVQPQLVLLQKTLLYIEGIGRQLYPQLDLWKTAKPFLEDWIKDQIGIPAILRAVKEKAPFWAEKLPELPELFYDSMRQHKLLQHSVDKLVTDLNAQRTRHHQARYLFGVGATLLLSGTAVLLSRPDWDFFPALLKSGIWQLLIIAVIVVLLFGTNKLRNLGSDLGSSIRGFKKAMSDEDEKKDQPKEQDADFNAKLADKQHTPASKDDARDNELVLVFVIGLIVLGPQRLPVAVKTVVGWIRAIRSLAANVQNELAQELKLQELQDSLKKVEEAGRGTLSPELKQSMEELRKTADSMKRSVQQSIDIEKAEDEANTIHQPPAAAPQPAARTAAR

SEQ ID NO: 128855 - protein, 253 aa, Glycine max
  Coding DNA Sequence Number=SeqID_37170
  Gene Ontology: Mol. function=P-P-bond-hydrolysis-driven protein transmembrane transporter activity; Cellular component=integral to membrane; Biological process=intracellular protein transport across a membrane
  Homolog annotation: Hit_ID=A7MQN2; Match level="QueryCoverage=99%, HitCoverage=99%, E-value=1e-117, Identity=81%"; Hit description =Putative uncharacterized protein
  Pfam annotation: Domain name=TatC; Domain location=18-221; Score =319.2; E_value=7.7e-93; Accession=PF00902.9; Description=Sec -independent protein translocase protein (TatC)
MAVEDTQPLISHLIELRKRLLNCIIAVFVIFLCLVYFANDIYHAVAAPLISQMPAGASMIATDVASPFFTPIKLTIIVSVFLAVPVILYQVWAFVAPALYRHERRLVMPLLFSSTLLFYVGVAFAYFIVFPLAFGFFAKTAPQGVTIATDITNYLDFVMTLFMAFGVAFEVPIAIVLLCWTGITSPDDLKKKRPYILVGAFVVGMLLTPPDVFSQTLLAIPMYCLFEVGVFFSRYYVGKGRQAADDEEQNPDA

SEQ ID NO: 128856 - protein, 201 aa, Glycine max
  Coding DNA Sequence Number=SeqID_37171
  Gene Ontology: Mol. function=P-P-bond-hydrolysis-driven protein transmembrane transporter activity; Cellular component=integral to membrane; Biological process=intracellular protein transport across a membrane
  Homolog annotation: Hit_ID=A8G8C3; Match level="QueryCoverage=99%, HitCoverage=78%, E-value=1e-92, Identity=81%"; Hit description=Sec -independent protein translocase, TatC subunit
  Pfam annotation: Domain name=TatC; Domain location=1-169; Score =235.8; E_value=9.7e-68; Accession=PF00902.9; Description=Sec -independent protein translocase protein (TatC)
MPAGASMIATDVASPFFTPIKLTIIVSVFLAVPVILYQVWAFVAPALYRHERRLVMPLLFSSTLLFYVGVAFAYFIVFPLAFGFFAKTAPQGVTIATDITNYLDFVMTLFMAFGVAFEVPIAIVLLCWTGITSPDDLKKKRPYILVGAFVVGMLLTPPDVFSQTLLAIPMYCLFEVGVFFSRYYVGKGRQAADDEEQNPDA

SEQ ID NO: 128857 - protein, 528 aa, Glycine max
  Coding DNA Sequence Number=SeqID_37172
  Gene Ontology: Mol. function=3-hydroxyacyl-CoA dehydrogenase activity; Cellular component=fatty acid beta-oxidation multienzyme complex; Biological process=fatty acid catabolic process
  Homolog annotation: Hit_ID=A7MQP0; Match level="QueryCoverage=100%, HitCoverage=72%, E-value=0.0, Identity=72%"; Hit description=Fatty acid oxidation complex subunit alpha [Includes: Enoyl-CoA ...
  Homolog annotation: Hit description=hydratase/Delta(3)-cis-Delta(2) -trans-enoyl-CoA isomerase/3- hydroxybutyryl-CoA epimerase (EC 4.2.1.17) (EC 5.3.3.8) (EC 5.1.2.3); 3-hydroxyacyl-CoA dehydrogenase (EC 1.1.1.35)]
  Pfam annotation: Domain name=3HCDH; Domain location=296-392; Score =137.8; E_value=3.1e-38; Accession=PF00725.13; Description=3 -hydroxyacyl-CoA dehydrogenase, C-terminal domain
  Pfam annotation: Domain name=3HCDH_N; Domain location=115-294; Score =291.1; E_value=2.2e-84; Accession=PF02737.9; Description=3 -hydroxyacyl-CoA dehydrogenase, NAD binding domain
  Pfam module annotation: Pfam domain module=3HCDH::3HCDH_N; Domain location=296-392::115-294
MLQDAIAQGSWQARRAPKLAPLKLSPIEAAMSFTLAKSMVQQTAGKHYPAPIAAVRTIEAAAGLGRDDALKLETAAFVPLAQSDVARALVGIFLNDQYVKGLAKKHSSAAGTPEQAAVLGAGIMGGGIAWQSAWKGVPVKMKDINPQALTLGMNEASKLLNKQLERGKIDGTRLASVLASIQPTLDYSGFDRADVVVEAVVENPQIKAKVLAETEQQLRDDAVLASNTSTIPISQLAQALQRPQNFCGMHFFNPVPRMPLVEVIRGAQTSEATISKVVAWASKMGKTPIVVNDCPGFFVNRVLFPYFAAFSLLLRDGADFRQIDKVMEKQFGWPMGPAWLLDVVGIDTAHHAQQVMAQGFPSRMQKDYRDAIDVLFEAKRYGQKNGQGFYRWEQDKKGKAQKRADVEVDALLEPVCEPKRVFSDEEIANRMMLPMLNEVVRCLEENIIASPAEADMALVYGLGFPPFRGGAFRYMDTLGISNVVDQAKRYLALGPLYALPELLVQKAHQHQSWYPVAQPIDAAALQTA

SEQ ID NO: 128858 - protein, 86 aa, Glycine max
  Coding DNA Sequence Number=SeqID_37173
MRKGKVNKEAQITSSGKHFFFIVEGNCSACDPEDLFHAQHKDPWECNDCPPLFIGEVIVMGELEISLNDLLVPSAIPYGHNWRSMK

SEQ ID NO: 128859 - protein, 24 aa, Glycine max
  Coding DNA Sequence Number=SeqID_37174
MEVGFVVDLGMAFVDKWAVGKEKG

SEQ ID NO: 128860 - protein, 71 aa, Glycine max
  Coding DNA Sequence Number=SeqID_37175
MDCFFHSSSLRGCEDKTTIGTSKPYTGAIKGTMQKPQASLGPYTGAMRGIVHEPQVNIGADQNSSPVDVFK

SEQ ID NO: 128861 - protein, 33 aa, Glycine max
  Coding DNA Sequence Number=SeqID_37176
VSRERAQSMKNHLRSNPFQGGGDDAILPPKGIG

SEQ ID NO: 128862 - protein, 42 aa, Glycine max
  Coding DNA Sequence Number=SeqID_37177
MGRIALSNHYAWLQTSKGGGPHEPKTQFHVGFSKKGLRMENC

SEQ ID NO: 128863 - protein, 70 aa, Glycine max
  Coding DNA Sequence Number=SeqID_37178
  Subcellular localization annotation: CTP_CleavageSite=24; ConfidenceScore=5.15e-01
MSMSSTFFIAVATYPSAGGRRVTRGMRVPRKEYARSRHQRLFEKNVGKTGKDAIYELLSERFGSCIYARG

SEQ ID NO: 128864 - protein, 89 aa, Glycine max
  Coding DNA Sequence Number=SeqID_37179
MLWKLGGIDGDPVLRGIRIRATWDYVSSVEGGQLGMVDLCVICGCGESTCTIARSPPSTTYDGVVLGDMSRGSGDLGDVRWGAIAQNQA

SEQ ID NO: 128865 - protein, 159 aa, Glycine max
  Coding DNA Sequence Number=SeqID_37180
MRASGNRLPRGCNRLPGLEMKRNGSLVIDYQIVMAAQLIHDRVEDGVPRGSLGDPRRQPRDEPARTLQRTVEWILPTPTPYRLVEPVQVIEVTSSEEDPEEDLEELPPEPAVDALDFLEGDEDPLLEVDSPEEVVSASEADSTEDSGPREMAISGGSSS

SEQ ID NO: 128866 - protein, 77 aa, Glycine max
  Coding DNA Sequence Number=SeqID_37181
MVAITPARVPQPPFLQGYDSNATCACHGEALGHSIEHCMTSKRKDFQVYAIIVNHNYNAKMDEFDIPVSLILSQTHL

SEQ ID NO: 128867 - protein, 62 aa, Glycine max
  Coding DNA Sequence Number=SeqID_37182
MRLPRKESLLMKSPITLTEILDVSISFLNEHLEETLGPTKIEENHSKCINLAQCGAKKSLAH

SEQ ID NO: 128868 - protein, 123 aa, Glycine max
  Coding DNA Sequence Number=SeqID_37183
IAPTETPSGPEKSNRALGFPALVTGLYQSYRDRACKTPSGPEEVQQGLGVASSKYGSLSVLGSACGPQQGHQGETPQQPGDGQQRATDAPPSPLEFTSAHPQKGLSIAYTTWPTNRRPSPKPK

SEQ ID NO: 128869 - protein, 84 aa, Glycine max
  Coding DNA Sequence Number=SeqID_37184
ESPARTTRASFPACGSSVITYSDLRELADRSLSEDAPSSMSEPFRNWLGMGVTIPALIQPEEEIAMHLAQLARRILEWESSVGK

SEQ ID NO: 128870 - protein, 121 aa, Glycine max
  Coding DNA Sequence Number=SeqID_37185
SDSSISSGSLRFLQFFPLIAPIELSNVRETEKGLKPPLILSWCDSFFSLREYYHANPNGEDHFEFLRERKRLRCERYFSHLKHYIKIPNGENARNWVANIVLKFYDDPMVNRSKIVFFLIQ

SEQ ID NO: 128871 - protein, 66 aa, Glycine max
  Coding DNA Sequence Number=SeqID_37186
MALGEKGCSTCWFDGLQTFVGERFDTLELQVDMSFNEMESRITKVKEDVSYIRSSFDLPPPPSPSS

SEQ ID NO: 128872 - protein, 93 aa, Glycine max
  Coding DNA Sequence Number=SeqID_37187
MNGAKRSAEAVGCKKRIGRGAFRLRGKDPREQCWTKRKRECRLEVPPQGSSTEGESGPKIRPKGVVDGQQVSRKMVIGSRTQGAPAFFKGNKG

SEQ ID NO: 128873 - protein, 86 aa, Glycine max
  Coding DNA Sequence Number=SeqID_37188
MVIIVNAEACGYVSLNYYQYIDVVYTNEHIVKAYSAQWWPLGNVAVIPPSNDAWTLIPDPTTIRAKGRPKSTRIRNEMDWVEPSEH

SEQ ID NO: 128874 - protein, 144 aa, Glycine max
  Coding DNA Sequence Number=SeqID_37189
MLEDDCRYLMVSKIPTVGISLKAQTEINGLLEGYLRHFSANQPEGLELLDVAQCCYKLTTKKLCVELQPLRVGHGATASDAPHHCGRRRLAHQPTFFAKTWQERNDLAQTYFKLKAWPGLKEEESRPCRERIGEVAYRLSDQLG

SEQ ID NO: 128875 - protein, 210 aa, Glycine max
  Coding DNA Sequence Number=SeqID_37190
  Homolog annotation: Hit_ID=Q2HW90; Match level="QueryCoverage=91%, HitCoverage=38%, E-value=3e-21, Identity=34%"; Hit description =Putative uncharacterized protein
MGTNQIGKRFYQVKIKGLDVTSLKELGRLMGPLQRQAFRKAYGKILDLTIAEVFTEAVVSLTKYYDQALRCFTFGDFQIVPTVEEFEEILGCPLGGRKPYPFSGFLPSLSKIEAVVGDLARELDRIKQTRNGVVGLSRKYLEGNARDMANQEEWVPFTDVLALLIFGVVLFPNVDGLVDLATIDAFLAYHHSKESPVIAILADLYDTFDR

SEQ ID NO: 128876 - protein, 64 aa, Glycine max
  Coding DNA Sequence Number=SeqID_37191
MFLLTSALKESNDHQGSKSKATAKWILVKYFIDPRPLELEKIKAIRIWRARCLRRVENEVLSSV

SEQ ID NO: 128877 - protein, 54 aa, Glycine max
  Coding DNA Sequence Number=SeqID_37192
  Homolog annotation: Hit_ID=A7NUD4; Match level="QueryCoverage=83%, HitCoverage=18%, E-value=3e-10, Identity=53%"; Hit description =Chromosome chr18 scaffold_1, whole genome shotgun sequence
MAITVKLIMRAIIELERDKYRRNYGRWKENGVGAHCQHFQRDDWYWKVEASFRE

SEQ ID NO: 128878 - protein, 115 aa, Glycine max
  Coding DNA Sequence Number=SeqID_37193
MVTVQHLVMDNKKRRPIINGTKLDLNKTFKEATKAIEVAQVLLTTLVEVFQIEDPRQQQAQPDRMSYMEDTLTHFMWWTGVGLKDNDEKKNKEGVEKKNKKNDEVVTSEKVEEKG

SEQ ID NO: 128879 - protein, 78 aa, Glycine max
  Coding DNA Sequence Number=SeqID_37194
  Gene Ontology: Mol. function=hydrogen ion transmembrane transporter activity; Cellular component=proton-transporting two-sector ATPase complex; Biological process=ATP synthesis coupled proton transport
  Homolog annotation: Hit_ID=A7M951; Match level="QueryCoverage=52%, HitCoverage=8%, E-value=1e-09, Identity=78%"; Hit description=ATP synthase subunit alpha
MTALPIVETQSGDVSAYIPTNVRKFLVELRAYLNTNKPQFKEIISSTKTFTGEAEVLLKEAIQEQMELFLLQEQVEKN

SEQ ID NO: 128880 - protein, 98 aa, Glycine max
  Coding DNA Sequence Number=SeqID_37195
MENHRFISKSDSAKARSNRKHIRQQKVHLNVQDSVHASVNPVSSHTEDDYNQPKTPPHSVHATVNRASHDAEDHFNICDSSKNESSGSTEGRITNLLH

SEQ ID NO: 128881 - protein, 87 aa, Glycine max
  Coding DNA Sequence Number=SeqID_37196
MASSSSCSSSIQTRSGPIDSDVLWMQPKHVSEHVWNGEPDRKLHIRRAVPTYQGEEQIPEEIVPLLRRCGFYWIMRMGYLKINAALI

SEQ ID NO: 128882 - protein, 51 aa, Glycine max
  Coding DNA Sequence Number=SeqID_37197
MGQNTPNDYDDGWLKFSQRALGRRLQVDWARDPREGPKVLMSLRVDFEPMG

SEQ ID NO: 128883 - protein, 42 aa, Glycine max
  Coding DNA Sequence Number=SeqID_37198
MNCVFVHVSSANEFGAMLHDCLVGSSESTCRHKSLEPCFMID

SEQ ID NO: 128884 - protein, 264 aa, Glycine max
  Coding DNA Sequence Number=SeqID_37199
  Gene Ontology: Mol. function=transferase activity, transferring phosphorus-containing groups; Cellular component=membrane; Biological process=two-component signal transduction system (phosphorelay)
  Homolog annotation: Hit_ID=Q7WRD5; Match level="QueryCoverage=86%, HitCoverage=29%, E-value=4e-56, Identity=50%"; Hit description =Sensor protein
  Pfam annotation: Domain name=CHASE2; Domain location=30-264; Score =85.0; E_value=2.5e-22; Accession=PF05226.2; Description=CHASE2 domain
MADATDPIDRASRSGLWLTVALALLAALLGWFNGLGRVDQILYDRAVALTGRDISPDIVIVAIDDSSIDALGRWPWRRAVHAALLDRLQGARAVGLDLIFAEPDTTYPGDDVILADSIRRNGHTVLPVVLDRLIYPTSISAPIPALAQAAAGSGFINANLDADGVLRSAVLTARFAGQRWQHFALTMLDVGGQADLAQRLLRRARADGSILIPYAGPAAHTRAVSYLSVLRGDVPAEQLRGKYVLVGAWATGLGDAYTTPVSHE

SEQ ID NO: 128885 - protein, 269 aa, Glycine max
  Coding DNA Sequence Number=SeqID_37200
  Gene Ontology: Mol. function=signal transducer activity; Cellular component=membrane; Biological process=signal transduction
  Homolog annotation: Hit_ID=A7MQ09; Match level="QueryCoverage=94%, HitCoverage=20%, E-value=1e-83, Identity=62%"; Hit description =Putative uncharacterized protein
MELHDRLGIRFPVYVLVTKTDLLKGFRSYFAALDKTQREQIWGFTFPWAQASTAEFELNSQFQQEYSLLQQRLDAGLADTLLAESDAQARAESYLFPQEFAALRPLLADALDTLFARSDFETQFAPRGIYFASGTQEGLPFDRVMGELSRALHLPGQRSGESGSWDQVDKESPIPPNKGQSFFLKGVLENVVFQESGLAGSNRWWELRNRAGLWSGYLALLVLVLIAGALWLTSYSKNKAYLQEMAGKTPQVEQLGHSWSARAMAICLR

SEQ ID NO: 128886 - protein, 50 aa, Glycine max
  Coding DNA Sequence Number=SeqID_37201
MAGLCGLDKKIKDLEMDLMESAMKSETLIWVDFVECPKVQDEKMEDLDMT

SEQ ID NO: 128887 - protein, 160 aa, Glycine max
  Coding DNA Sequence Number=SeqID_37202
  Subcellular localization annotation: CTP_CleavageSite=17; ConfidenceScore=5.13e-01
MVEPSKKRKGSSSTAAAAAHRRHGPSEAPTTPIHPSLSSPRSSTLFSSDDQRLCHQIDWAHLVRYRMHKALRANAPLPYPQLITLFLRHFQIPLDDEPFVQVKRSFAIGAGAVTSFGYRKDRNCQWLKKDALPPQDERTPSPPPQRDDSTLMNEVLTELR

SEQ ID NO: 128888 - protein, 48 aa, Glycine max
  Coding DNA Sequence Number=SeqID_37203
DCHHQKGEIVEAMPSKIILMMPKNQEASKFQESRFKNNQDQDSRSRFK

SEQ ID NO: 128889 - protein, 42 aa, Glycine max
  Coding DNA Sequence Number=SeqID_37204
MTEKEIITIIVDTLPVFYYEKMVGDHAYKILSGPEEVQQGPG

SEQ ID NO: 128890 - protein, 28 aa, Glycine max
  Coding DNA Sequence Number=SeqID_37205
MQGKEDEDVKKEKAQATSNTKSFVVGDV

SEQ ID NO: 128891 - protein, 188 aa, Glycine max
  Coding DNA Sequence Number=SeqID_37206
MNHHSSSVNGEATSHKDPLSRILDELSSLKLWKEKQERKEKGKKRVEEISQDERKKIREEERRKIMKEMKREKHASYSSHNSCKSLSEKLCDYYEGRHRPHLRPHSHRREKERKPQEANIKLSYFHGKDNVEANLDWEIRVEQQLKKKSTSKSYGSHSYSKKDQGQGILGVTPSKPKDDKGKTIGGIL

SEQ ID NO: 128892 - protein, 360 aa, Glycine max
  Coding DNA Sequence Number=SeqID_37207
  Gene Ontology: Mol. function=isoleucine-tRNA ligase activity; Cellular component=cytoplasm; Biological process=tRNA aminoacylation for protein translation
  Homolog annotation: Hit_ID=Q1GZ62; Match level="QueryCoverage=95%, HitCoverage=36%, E-value=1e-166, Identity=81%"; Hit description =Isoleucyl-tRNA synthetase
  Pfam annotation: Domain name=tRNA-synt_1; Domain location=2-360; Score=-8.0; E_value=8.6e-18; Accession=PF00133.13; Description=tRNA synthetases class I (I, L, M and V)
VTDNAALSKAFGTTVSGDAYAVIWTTTPWTLPANQAVSVNAELDYDLIQTSKGLLILVRDLAEKTLARYEEENASVIASCKGEALRGLLLQHPFDDRQVPVITGDHVTTDAGTGLVHTAAAHGNDDWLVMRANFPNEKPRVLIGGDGKFFTSELVELADIRGLSRQDANKIILAKLQENGVLFASARLNHSFPHCWRHKTPLMQLATHQWFIGMNSVGKDAKALRDLANMSVDATQFFPSWGRARLEAMIKNRPDWCVSRQRNWGVPMPFFVHKETGEPHPQTMQLLETVCKQVEQQGIEAWFSLDGAAFLAQHAPANAEQYKKVTDTLDVWVDSGATHYAVVRSAQHPKLVRCRECARS

SEQ ID NO: 128893 - protein, 222 aa, Glycine max
  Coding DNA Sequence Number=SeqID_37208
MGEVEEVQEQMKADMEAMKEQMATMMEAMMSMKKIMEANAVAVATTSAVAMVNPTPPSDLNQMNHPTLDMHAFPPYGLSPNYTPPNVAYTPNESQQPQSDHAHVFQPMGETHEIPHHNLADFEPCLGYATEGQAVGGIPLQNTLEGPQFRPQPQPFYGKIVGYTSSSFTNFFFAGERIKVGLERGKSDHPALMNVKTRANEEDENEAETLAMTTIPTGSNLP

SEQ ID NO: 128894 - protein, 98 aa, Glycine max
  Coding DNA Sequence Number=SeqID_37209
  Homolog annotation: Hit_ID=A5ADA3; Match level="QueryCoverage=44%, HitCoverage=3%, E-value=8e-10, Identity=59%"; Hit description =Putative uncharacterized protein
MDSKTLYTTLASPMFDGDNYHIWAARIEAHLEANDLWEAVEEDYEQHEANAQVVEQEEEDYIFAATCYSMRSSSECCTNHMTYDKTLFKDLKPTNVSK

SEQ ID NO: 128895 - protein, 95 aa, Glycine max
  Coding DNA Sequence Number=SeqID_37210
MKAHGISWFSSLRSPFLHGFDSILRYYSSPTGDGLRPRVCYEIMGHATLPPFPCYSCLNMRPPSAPQNASMTFGHGFANFGLWGCFVCIGTACRG

SEQ ID NO: 128896 - protein, 43 aa, Glycine max
  Coding DNA Sequence Number=SeqID_37211
MEQNRLRPRSEVKTSQWQKSTKVLRDGGKWRIGSWPTVVPSRR

SEQ ID NO: 128897 - protein, 93 aa, Glycine max
  Coding DNA Sequence Number=SeqID_37212
GFDDAKVESNKVASTNIQRLNIASRLIQGQVNKIKQQNIRAQTISLVDQAFSSKHIVSNIQGSETGCLLDCENCNQETGCLLENLEHKGEGSQ

SEQ ID NO: 128898 - protein, 159 aa, Glycine max
  Coding DNA Sequence Number=SeqID_37213
  Homolog annotation: Hit_ID=A5C4L9; Match level="QueryCoverage=89%, HitCoverage=11%, E-value=9e-18, Identity=33%"; Hit description =Putative uncharacterized protein
MIAHVGKARAAVEELRKFLLADSLEEVNRKLDKFYMVLILRNLHSDFDHVHDQVLAGDKIPSMDSLITRLLRVPHLLKDENPTDGVETSAMVASRGRGSSRNNRGGRSGRGERPHCTYCKRMGHTQENFYSLHGFPDKVAHVSRSEVGSSRVDLQACKL

SEQ ID NO: 128899 - protein, 53 aa, Glycine max
  Coding DNA Sequence Number=SeqID_37214
MASGNRLPRECNRLPGLKNEIRKLRGLLRNRPLVIDYQLCVIDYTVHFTGFMS

SEQ ID NO: 128900 - protein, 112 aa, Glycine max
  Coding DNA Sequence Number=SeqID_37215
  Subcellular localization annotation: CTP_CleavageSite=30; ConfidenceScore=5.19e-01
GRAHKTPSGPKEVQQGSGVSSSSYGPLSVLQGARSPQQGIAPTRHPVDPEKSNRVLGFPALITSLCQFYGVPITPNKVIRPRINRVSSRSTAPPGRRRARHHNSIGMAGSGQ

SEQ ID NO: 128901 - protein, 221 aa, Glycine max
  Coding DNA Sequence Number=SeqID_37216
  Homolog annotation: Hit_ID=A7MLL4; Match level="QueryCoverage=100%, HitCoverage=67%, E-value=1e-71, Identity=62%"; Hit description =Putative uncharacterized protein
  Pfam annotation: Domain name=CobW_C; Domain location=136-219; Score= -6.4; E_value=0.067; Accession=PF07683.5; Description=Cobalamin synthesis protein cobW C-terminal
MLRAAVYQPWIRVDATLTLLDPRQLADTRVTENENFRDQLIAADIIIANKSDKWDAEDRQRLASWQQQHLGDRQLVEASWGNIDPALLSQPALADRAVPDAAHHHHSPRPQGLAALKLEGEARWRRALNEGQGYASCGWIFDGDTVFDTIPALEWARLAPVDRVKGVLRTADGLVSINRQGEDLFIETRPVTPPDSRIELIHHQAADWNALQTALLKIRLN

SEQ ID NO: 128902 - protein, 176 aa, Glycine max
  Coding DNA Sequence Number=SeqID_37217
  Homolog annotation: Hit_ID=A7R5Q5; Match level="QueryCoverage=57%, HitCoverage=22%, E-value=6e-09, Identity=33%"; Hit description =Chromosome undetermined scaffold_1022, whole genome shotgun sequence
MTRGNPGDLQPFDPEIDRTFHRLVRHSVHPGHSVHFKHFEHYVAGDSEYSDFEHSTTNFHTENMAQPPPRERTLREMAAPDFTYESLCFQYPDEGVPYVLKTGPIHLLPKFHGLAGEDPHKHLKEFHIVCSTMKPPDVQEDHIFLKAFPYFLKEFHIVRFLQFRFLLQIAISFYAD

SEQ ID NO: 128903 - protein, 107 aa, Glycine max
  Coding DNA Sequence Number=SeqID_37218
  Pfam annotation: Domain name=G-patch; Domain location=2-43; Score =29.0; E_value=1.7e-05; Accession=PF01585.14; Description=G-patch domain
MMVARVMLGNGYEPGMGLGRNNSGRTSLISARGNHGKFGLGYKPTQAEIRKSVAGRKSGSQGSQLGRKVEEVPPCHISRSFISAGLGHEGQVIVICEDDSPSGSDLV

SEQ ID NO: 128904 - protein, 105 aa, Glycine max
  Coding DNA Sequence Number=SeqID_37219
MIRGDTLWLFAPFCHPEAAGPMTSRDQVWSFCTLVSSRGGGPDDTRKYPSGYPYKHSFAISPRPIWALQKIPPEGGCFWRKQPCSPGRAELAWASWAATTSPILL

SEQ ID NO: 128905 - protein, 116 aa, Glycine max
  Coding DNA Sequence Number=SeqID_37220
REFAKRNLQWLSERKNPEEDELSSSLSAPLQKLSMHEGSRERKVQVPESSERFCCEGDILTTCVFAVFHHVLLFVVKEVSRLWKAKSSVGSSLGNWSDSKVLDSTVLSCCAITRNQ

SEQ ID NO: 128906 - protein, 124 aa, Glycine max
  Coding DNA Sequence Number=SeqID_37221
MGEVEEVQEQMKGDIEALKEQMATMIEAMMSIKEIIKVNAVKIAATSTIAETHEMPHHNLADFEPCLGYATEGQAVSDIPLQNTLEGPQLRVIEVCEDYAFANLEELLDFDKYKGTTCPKNHLK

SEQ ID NO: 128907 - protein, 235 aa, Glycine max
  Coding DNA Sequence Number=SeqID_37222
GAPTEESMSPFLVRDLGAQNSKTIQGIHKAWETPLRKDQELRGIRNGIIGGYHEWLKVRIRGLDWLAKLKVVSEENFEAPEEDEEVQALKSELGKAKLAKEKFKLAATHVRKECAGLREENAITARALERETKRARKEEYGRNKFRGALWGSNNELKLRREERDQSRAHSMVLKEELIACSKSKRSLSQRLCETETNMLAIIAKYQEELGLATAHEHRSRMSMPKYTRKKRLEEG

SEQ ID NO: 128908 - protein, 360 aa, Glycine max
  Coding DNA Sequence Number=SeqID_37223
AQVGLDLGAQPGALDLDHDFDVGSAGRRGAVAVAAVLLVLPVIPVIPDFSRRQPRAVHLGHGGRGQRHGIEMREHLLHGQAQRLLDQRLGRLPGQRGGVAVQLLQGGRPFGREQVRARGHDLAQLDEARPQVFEGHAQALGAAGIQRMLGMGLAAAWREAGQAQRVDQVGQPEAQQHADDFLQPGTVAHGDHGGLQHGHLLSVVAMRSIVPMRQTPLRRNRPSPGRGSGQPLHLYRAVVEAGRAAQVGQALVGELVDIGAVVAVLAPPDAQAVAPATARAAVEGGVAFVAAPVVEDAHPVALGHAARGGVVGVQLHQRAAFHGAQALDVDEAAVEKVACRRRDHGQRVARIRFGGFVVGQ

SEQ ID NO: 128909 - protein, 165 aa, Glycine max
  Coding DNA Sequence Number=SeqID_37224
MGDQEETQEQMKADMSALKEQMASMMEAVLGMRQLMEKNVASAAAISSAAEADPTLLVTAHHPPPNTLGRGRNTLGHNNNPHLGYNRAAYPYGLPPNYTPPVMQDDAGHISSPILEREPPRQPDEVHEDHQEYAQGDVEFYPSIPVEGPAPNTLPQPNLTAQPMI

SEQ ID NO: 128910 - protein, 244 aa, Glycine max
  Coding DNA Sequence Number=SeqID_37225
MASDTHARAYHFGESSTCHPQQVTCAHEHPDKPPHPTKPLVRATHVPLIHITMPLVLATLKEARIQEHNTHAAHKTCQTQAPPLLIFTGLQNLRPILGKPRHSFVGFTKPRTNTSLVQCSTNPRSTLGEALSITRFHLHGNSRLIKNPRYALGNHISKTQGWPLIPKPKVRPWYTCLQNPRSTLGTYFYKTQDALLVRSHAAAMTTTIKGLSSTKQTITPLFGKTFNQLEAHTHSSQPSKEYFG

SEQ ID NO: 128911 - protein, 179 aa, Glycine max
  Coding DNA Sequence Number=SeqID_37226
MGTNQTGKRFYQVKIKGLDITSIKDLGLLMGPLQMQAFRKTCFTFGDFQLVLTVEEFEEILGCPLGGRKPYVFSGFLPSLSKIAAMVRDSVRGLDRYQEELSLATAHEHRVADEYAQVYAEKEARGRVIDSLHQEATMWMDRFALTLNGSQELPRLLAKAKAMADTYSAPKEIHGLLDY

SEQ ID NO: 128912 - protein, 185 aa, Glycine max
  Coding DNA Sequence Number=SeqID_37227
MSRHSSSVNDERTTHKDPLSRILDELISFKLLKEKLERKEKGKEMVEMNQDKREQIRKDERRKIMKEMKREKHASYSSHDSCKSLSEELSDYYRGSHSSHTKHHSQRREKDRRPQEVNISLPYFHGKDNVEAYLDWEMKVEQLFASHHISEERTFHWLPLAFKGMPSIGGYYLVMERRIHGDPPV

SEQ ID NO: 128913 - protein, 27 aa, Glycine max
  Coding DNA Sequence Number=SeqID_37228
MTSLMKKIQGLQAPHGATSCGSIIFQP

SEQ ID NO: 128914 - protein, 63 aa, Glycine max
  Coding DNA Sequence Number=SeqID_37229
MAYTHIPDSQAILLKFQLAHINLDFAPYASGSYNAQWNAPGLLHDKHTLCSSRTLGKMEVEET

SEQ ID NO: 128915 - protein, 224 aa, Glycine max
  Coding DNA Sequence Number=SeqID_37230
  Homolog annotation: Hit_ID=A4TNK0; Match level="QueryCoverage=11%, HitCoverage=8%, E-value=3e-07, Identity=100%"; Hit description =Membrane protein
MVATVPLFTLCFSLLWGMRNTKLEWAGIALGLVGIVLLNTGNNLLGLRVGTGIAHLAAGRADGRRGGNVGRRRGVIGSQSAERRASDSDAEHRRLSGAGLSDRLRLDAGDQRLYVLVEERARGGRHQLRLRQPGGGGAARHRLCRRIAGAARVAGAGDHRGGGGAGDAGKIPVRPPGPRAGHRQRTVAIAKGGLRAAVKNDSCFTRRRGYNSRCSKQPAKLFLC

SEQ ID NO: 128916 - protein, 147 aa, Glycine max
  Coding DNA Sequence Number=SeqID_37231
  Gene Ontology: Mol. function=2-dehydro-3-deoxy-phosphogluconate aldolase activity; Cellular component=cytoplasm; Biological process =metabolic process
  Homolog annotation: Hit_ID=P0A957; Match level="QueryCoverage=100%, HitCoverage=68%, E-value=2e-68, Identity=90%"; Hit description =KHG/KDPG aldolase [Includes: 4-hydroxy-2-oxoglutarate aldolase (EC 4.1.3.16) ...
  Homolog annotation: Hit description=(2-keto-4-hydroxyglutarate aldolase) (KHG-aldolase); 2- dehydro-3-deoxy-phosphogluconate aldolase (EC 4.1.2.14) (Phospho-2- dehydro-3-deoxygluconate aldolase) ...
  Homolog annotation: Hit description=(Phospho-2-keto-3-deoxygluconate aldolase) (2-keto-3-deoxy-6-phosphogluconate aldolase) (KDPG- aldolase)]
  Pfam annotation: Domain name=Aldolase; Domain location=1-138; Score =222.0; E_value=1.4e-63; Accession=PF01081.10; Description=KDPG and KHG aldolase
AIVGAGTVTNVEQLKAVTEAGAQFAISPGLTESLLKAATGEGTIPLIPGISTVSELMLGMQYGLKEFKFFPAEANGGVKGLQAIAGPFGHIRFCPTGGISPANYRDYLALNSVLCIGGSWLVPADALENGDYDRITKLAREAVEGAK

SEQ ID NO: 128917 - protein, 78 aa, Glycine max
  Coding DNA Sequence Number=SeqID_37232
MCTCAIFGTPNAVSMHEMAPRKLASKRSRKDKAGEGTSSAPDYDSHALGALYTSSASRASRGCRFSGSDASSSRRRYN

SEQ ID NO: 128918 - protein, 74 aa, Glycine max
  Coding DNA Sequence Number=SeqID_37233
PAVDALDFLEGDEDPLLEVDSPEEVMSASEADSMEDSGSGEMAINGGSSSYALKGLDDAPQPKSKAPGRWIFVK

SEQ ID NO: 128919 - protein, 118 aa, Glycine max
  Coding DNA Sequence Number=SeqID_37234
  Subcellular localization annotation: CTP_CleavageSite=42; ConfidenceScore=5.72e-01
MGSPPVSTPPPPPPSNASASPSAVKWTRKASRLRSLSTRPPSAERPVVHVDPATGKADGPHRKKLRTYLRIVARDKVDITYENWKEVPTTQKDLIWEDIQAEFDILEASNSRTKRKLL

SEQ ID NO: 128920 - protein, 73 aa, Glycine max
  Coding DNA Sequence Number=SeqID_37235
MTLIIKRHFTSLTKGFFQDYHDISSPLRLRATSNRCENRLSEWRFRGESNDLGLLHETKKFLSRNFEVKDMGE

SEQ ID NO: 128921 - protein, 99 aa, Glycine max
  Coding DNA Sequence Number=SeqID_37236
GLLVFFPPQQRIKATRAESKRIVAARPLCHLQYPVAYLSRLQRILPAARWELRFKASRRANPPHEGHQRHVPLGGRGPLLPPSANGRRAHASLLARILT

SEQ ID NO: 128922 - protein, 30 aa, Glycine max
  Coding DNA Sequence Number=SeqID_37237
MGHATLLPFSCNSCPNMRSPSARYSIGDSK

SEQ ID NO: 128923 - protein, 143 aa, Glycine max
  Coding DNA Sequence Number=SeqID_37238
MMIWKQGAKLVMATARWALKHPFYGIVVLRLGIYTNRPNVSKLCSFISSMNPSILISVIQENKLLVSVPCFQKICLLSTNDLCFLIITCRPSSISFLNDHIEETLGPTKIGENHSKCINLTQCVARKSLAHRILSAIKGRGPL

SEQ ID NO: 128924 - protein, 68 aa, Glycine max
  Coding DNA Sequence Number=SeqID_37239
  Subcellular localization annotation: CTP_CleavageSite=9; ConfidenceScore=5.20e-01
MLATHSGYRATARKPASNCFFTSSFIFKDVSGFILLSFCFTGEHSGFRGEVPHPRSLHLPFDSFLARS

SEQ ID NO: 128925 - protein, 59 aa, Glycine max
  Coding DNA Sequence Number=SeqID_37240
MIQREWREELGFPVTWNVVDSDSKCISASSMVQGRVVIDYTNMVIDYQKATKPEITACN

SEQ ID NO: 128926 - protein, 61 aa, Glycine max
  Coding DNA Sequence Number=SeqID_37241
MHETQCGPPRQNRGDACRPARPGELSSPREAGLLPPEATAFWRNLLEGPNGPGCYLHPHFY

SEQ ID NO: 128927 - protein, 63 aa, Glycine max
  Coding DNA Sequence Number=SeqID_37242
LERIDGDPVLRETRIWATWEYVSSDGEWYLEICRGGQETLGTSGGVLLPKTKLDQSRPNPGIV

SEQ ID NO: 128928 - protein, 105 aa, Glycine max
  Coding DNA Sequence Number=SeqID_37243
MELPVALPENNNWLTTTALGCGNGQCSFPVVIQDQRHSAFKIWFKPAYIGEWLPACKITNLNLNQWAHSNLDVTISAAVSPEEVHVYQLGAPPYFESKILCDLVA

SEQ ID NO: 128929 - protein, 173 aa, Glycine max
  Coding DNA Sequence Number=SeqID_37244
MEGRKRRSPFLNVEDTPNIPLAWETPLRKDQELRGIRNGIIGGYHEWLKVRIRGLDWLAKLKVVSEENFEAPEEDKEVQALKSELGKAKLAKEKFKLAATHVRKECAGLREENAITARALEQETKRARKEEYGRNKFRGALWGSNSELKLRREERDQSRAHGMVLKEELVACS

SEQ ID NO: 128930 - protein, 56 aa, Glycine max
  Coding DNA Sequence Number=SeqID_37245
  Subcellular localization annotation: CTP_CleavageSite=33; ConfidenceScore=5.25e-01
MAFAHDFVKKSSSWAKLNNWAKRISTTKRSFSVLSAKENLAEHQHQSCALSERSVR

SEQ ID NO: 128931 - protein, 140 aa, Glycine max
  Coding DNA Sequence Number=SeqID_37246
MSHHSSNVNGVGTIHKDPLSRIIDELSSLKLWKEKLERKEKGKERVKINQDEREQIRKEERMKILKELRKEKHASYSSHNSCKSLSEELRDYYEGRHRSYLRPHSHRRKKERKAQEANINLPYFHGKDNVETYLDWEISV

SEQ ID NO: 128932 - protein, 163 aa, Glycine max
  Coding DNA Sequence Number=SeqID_37247
MLYLECDPIPKVVENEDDLDDVPVVDHEEDVGVLVSMLVLESREMLVSGGMLMLQRDGSEQRDADAGEQRDGGEHRDTDAGEQRDGSEQRDADAGEQRDAGGEERDVADSEEEKEVDSDEWFINFSCMMNGVEAEVETDGYHSEELNIPISSDDEDEDVEVYP

SEQ ID NO: 128933 - protein, 227 aa, Glycine max
  Coding DNA Sequence Number=SeqID_37248
MALLSSQKRVAHDPIDTGLTEIISLTEVLCNAEIVVGKSEGCAALLLLLHAPKGREIRKRAKSTNVVECMSTKVVDFARQSRMLHTQSLIPQLMARLATGSLHREPMRTCNKHKLCREASHFPFLLFKGVLCDRSTGSAATFGLVTFLRFCQALLSAAARSRHLRPHRPSLLPTGGVRALSLPLALPLVLQYNKSVSQGCIRSKHRTGKAIFVLSLVVAWQTHSVQK

SEQ ID NO: 128934 - protein, 53 aa, Glycine max
  Coding DNA Sequence Number=SeqID_37249
MEEKVKQKINGACLWGFYGGWIFELQRGPLMVIFHHGDAAEDKGKEVRGGTIH

SEQ ID NO: 128935 - protein, 109 aa, Glycine max
  Coding DNA Sequence Number=SeqID_37250
MSSMVILMMPKNQELSKFQRFKNQVSRIKIQESRYILCGTSRGYIYLGIVILRTREGTSLVDQFKWRVHPLGLFKENKGGYIPCGSWACKGFYKVERNLKNRKLLGDWM

SEQ ID NO: 128936 - protein, 73 aa, Glycine max
  Coding DNA Sequence Number=SeqID_37251
MHGYIKETKHSVFVPCPYFRNLIGGTKGTTNDNVSSKRKTLDEVSLSSSESETQHDHRSTSTSYVPMDPGIGP

SEQ ID NO: 128937 - protein, 75 aa, Glycine max
  Coding DNA Sequence Number=SeqID_37252
MTDVIKDALYLTMFLCSMMSPGLLNPDVSCMFSLILAKRHPQIPLVGLNLIRTALRHTYQQLGYRTPIPHDNSIN

SEQ ID NO: 128938 - protein, 95 aa, Glycine max
  Coding DNA Sequence Number=SeqID_37253
MGPNQAYAFKKRFSSSQECALRCPYQMCARARVMSEIEEVQEHMKADMEAMKEQMTTIMEVMMSMRKMMEVNTATVIAASTATEVDPTHPSGLNQ

SEQ ID NO: 128939 - protein, 47 aa, Glycine max
  Coding DNA Sequence Number=SeqID_37254
MFKGNLIRQKAHRIVKYLKLKWMNPSIELRELVLDKPKVLDHDPSLG

SEQ ID NO: 128940 - protein, 79 aa, Glycine max
  Coding DNA Sequence Number=SeqID_37255
MRLVDLPGRYHSHQVGDEGRQKVFVRHWDRGEFWNWPQGKVPHHIGTGAKVGIAGQASRGWSRSLGASLWMGASAIGCT

SEQ ID NO: 128941 - protein, 195 aa, Glycine max
  Coding DNA Sequence Number=SeqID_37256
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
LGHHFKNSVAPPTYLALLILLPVAAASGDKSCLTGVGTGERTRELPGGNAWYLYSPVGFATSDLSVDFCDARQGGGAYGKTPATRPFYADTARRSRTTERSESVSEEAEERPIRKPPLPARNSYDHDYEFELGTPFGRIVREGMQAWHWPSFYNVVTGKTLALPNLIALQHIPLSPAGVIAKRPAPIALPNSCAA

SEQ ID NO: 128942 - protein, 198 aa, Glycine max
  Coding DNA Sequence Number=SeqID_37257
ALAARLSTKGSNVETADVDPSGNKNVSLKPTMGLYVQRQHTTVLVALGKICEGGSAIHNVTYVDDVVREFDTSPRKLPETNERGTNDFDHDPLRQLIKSLYFMYDTPVELKWDGSKFGLSNVDASFFLTFSYVNEIVAGYKCLNISILQLWMLFLDEWSSTLGHASVYGFLEPQSIHNAKDRRAECEHYLQAWLKESQ

SEQ ID NO: 128943 - protein, 76 aa, Glycine max
  Coding DNA Sequence Number=SeqID_37258
MMHLCITTGTGKYHDKCGSNAFQGYFDDARESRDKQILKIQESSFKNQDSRIIKIKIQESREELIKISTKKSFSKH

SEQ ID NO: 128944 - protein, 72 aa, Glycine max
  Coding DNA Sequence Number=SeqID_37259
MTSPERVQMTNILSLRAINHTVSEWTGADNRKVSPRVTSLEPWQQKCGVVDKSEALAPTYPPMRNSDLRSSG

SEQ ID NO: 128945 - protein, 48 aa, Glycine max
  Coding DNA Sequence Number=SeqID_37260
MLQPYGINIGLKEHSNPVTPKAYTPKSPSGPLPLDSGTYTFSLTLVPK

SEQ ID NO: 128946 - protein, 116 aa, Glycine max
  Coding DNA Sequence Number=SeqID_37261
MIMRGQDIYSSQDEATTSPSSSESEKAKGEESSEEIYPQEEGQPLVLRIGGMMNVLSGATLFCKITHAPNIFMICEHGDPLGVEGRSLEHEEPRDLRSNPFQGGGNDAILPRKGIG

SEQ ID NO: 128947 - protein, 115 aa, Glycine max
  Coding DNA Sequence Number=SeqID_37262
MAAQLIRDRVEMECLEGAWETLEGNTRCRFRGTIQFTATSLPVQVIEVTSSEEDPEEDLEELPPEPAVDALDFLEGDEDPLLEVDSPEEVMSASEADSTEDSGPGEMAISGGSSS

SEQ ID NO: 128948 - protein, 108 aa, Glycine max
  Coding DNA Sequence Number=SeqID_37263
MKNVEDGSNLCEIPHGKRYGNVSEAPRLRFSSGKQFFQAISKEREVPKGLGKIGEMLAAQLAQASSARPGELSSPRRAGLLPPEATAFWRNLLEGPNGPGCYLHPHFY

SEQ ID NO: 128949 - protein, 56 aa, Glycine max
  Coding DNA Sequence Number=SeqID_37264
MRKKKKDSKALSSKAKGKETSLSTAIPLELEVIPQVKELLDEGLVRKSFNPCALLE

SEQ ID NO: 128950 - protein, 188 aa, Glycine max
  Coding DNA Sequence Number=SeqID_37265
  Homolog annotation: Hit_ID=UPI00006A2D9E; Match level="QueryCoverage =93%, HitCoverage=100%, E-value=4e-15, Identity=19%"; Hit description= UPI00006A2D9E related cluster
RTTRPRLEDYTSSPSEGYTPSPSEDYTSSPSGLHVLTFRGLHVLAFRGLHVLAFRRLHAPAFTGLHILTFRGLHALTFRGLHVLAFRGLHTLTFRGLHVLTFRGLHALAFRGLHVLAFRRLHVLAFRGLHALTFRGQHVLALRTTRPHLQKTTRPHLQRTTCPHLEDYTSLPSEDYTPSPSEDYISSP

SEQ ID NO: 128951 - protein, 135 aa, Glycine max
  Coding DNA Sequence Number=SeqID_37266
MSHGRLYQQRMKSAFDKKVRLRKFHEGDLVLKKIGLFPEEPWCLPTWMAKSYLHPDFLSVVSLVTIFQRNERGFEACSPHGQDHLGLPSGVETKHERQKPIKVLKDGCKWGWGHDRPIVAPSLCETSRECRCKAA

SEQ ID NO: 128952 - protein, 164 aa, Glycine max
  Coding DNA Sequence Number=SeqID_37267
  Subcellular localization annotation: CTP_CleavageSite=43; ConfidenceScore=5.30e-01
MCPSPFVFGAMRIECLVQFSILSIFRSPMNCVFVHVSSTFEFRAMRSDCLVQFSIFTLFRSPMNCVFVHVSSTFEFGAMRSDCLVQFSILTLFRSPMNCVFVHVFSTFEFGAMRSDCLVQFSILTLLRSPMNCVFVHVSSTFEFAAMRSDCLVQFSILNLFGAP

SEQ ID NO: 128953 - protein, 178 aa, Glycine max
  Coding DNA Sequence Number=SeqID_37268
MGHLNKCGLYVDDSPPRLVSLGRLYEGLKIVHNVPLGNNQVKDKQVAEGSMKPIDMSDPNVDPLYLMTLTIPQLFLKPLQVLWDASVFGGFVKALDLEIISGYKACKRNDVGNNPRSSPLKPSPCMAIYQKSHLVQGKLVLTSQLLRLKGITSPKRVGCLRLKPSHGPGKPDAGLGKF

SEQ ID NO: 128954 - protein, 216 aa, Glycine max
  Coding DNA Sequence Number=SeqID_37269
GLHVLAIRGQHVLAFRGLHILTFIGLHVLTFRELLVLTFRGLRALTFKGLHVLALRGLHAFTFKGRYVLDFRGLHAFAFRRLCVLTFNGLHIRTLREFKGQDFTCAAAKRRVRIMRTKMTTLTQIWMTLLLSNIPSSDHNADLPLRKYQLGSHPQRHLVDPEKSNRALGFPTLVTGLWIAPARHPADPKKSNRVLELPALITGLYQFYGVHCRPQQ

SEQ ID NO: 128955 - protein, 126 aa, Glycine max
  Coding DNA Sequence Number=SeqID_37270
AGESGGATTSLSESSRMSIEGGAGGAGGGGIISTSGEAGGSTTGGRDSAGAGSILVGMGLGGTTSEDLPNANCCWLWTIISCPRNRLYNIGTIGCACRPFGSMVAVGGGGLDDVEAKLHGESKVIQ

SEQ ID NO: 128956 - protein, 158 aa, Glycine max
  Coding DNA Sequence Number=SeqID_37271
MTKKRSHLSHTRGAERHPPISKSAEGAGECGLFLILRSNSNLHITRKTIKETVVGFTCQAFKHLVNEWQGKMVLFGNLVQPPIVNEWQGKSSILEDAQKSKAKLNYRLVSTTNSIPSLVEEIQLGFSRRAKWEMDKGKHAKVAADIEDRFFKLKGLTF

SEQ ID NO: 128957 - protein, 204 aa, Glycine max
  Coding DNA Sequence Number=SeqID_37272
MARDNVEANLDWEIRVEQQLKEKSTPKSYGFHSYLKKDQGQGILGVTPSKPKDDKGKAIEKQAPKASMQEKTSFGPDIYSSQDEATTSPSSSESEEAKGEESSEEIYPQEDGQPLVVKEKCKEVSVSSNRLAKKETHFTTKTNIKETFPLRQPPHFLFCKKTFASIATPLGLEFIPQVKKLLDKGLVRKSLNPCAFVGAQNRYY

SEQ ID NO: 128958 - protein, 104 aa, Glycine max
  Coding DNA Sequence Number=SeqID_37273
VPLQRTLADGGHPAQGTPSCLGLDDAPQPKSKASARWIVVKCNRQKGSTECGYYVMQWMSTIILGTFRNNWEAYFNDPRTLETERLKALRIQWAQFYLRVRDQA

SEQ ID NO: 128959 - protein, 112 aa, Glycine max
  Coding DNA Sequence Number=SeqID_37274
MSVASSFLSLGGAYLYGTAWLFRYGNGTSLTTEGYRGVWGAASLVKYTTKGLGLPKLLSSADCMHICCSSLPSSPTSSRPRSIICCNSSLGCIKQESSSCPPWGITPPFCRA

SEQ ID NO: 128960 - protein, 426 aa, Glycine max
  Coding DNA Sequence Number=SeqID_37275
  Gene Ontology: Mol. function=ATP binding; Cellular component =intracellular; Biological process=transport
  Homolog annotation: Hit_ID=Q1H1M8; Match level="QueryCoverage=72%, HitCoverage=53%, E-value=5e-93, Identity=56%"; Hit description=Type II secretion system protein E
  Pfam annotation: Domain name=GSPII_E; Domain location=258-426; Score=- 30.9; E_value=5.2e-08; Accession=PF00437.11; Description=Type IIIV secretion system protein
  Pfam annotation: Domain name=GSPII_F; Domain location=1-106; Score =18.8; E_value=0.021; Accession=PF00482.14; Description=Bacterial type II secretion system protein F domain
  Pfam module annotation: Pfam domain module=GSPII_E::GSPII_F; Domain location=258-426::1-106
  Subcellular localization annotation: CTP_CleavageSite=60; ConfidenceScore=5.09e-01
MTALGSLGGLLDSSLARSLQQAQIMISQGQPLSQAFQTVGMTTPIGERMLLVGERGGNVAQMMDRIASFYDEELARWIDWFTKLFEPLLMLFIGLLLPILSADVLAQAQTQATQQQRRVIEVLEELAPIDNETMVSQLAHVLHYPVATMREMREWQVAFDIVSYNDAQQKECLAFYDAEQHLILVFADPFNRQLSLWAQHAVQVPFEWRLAHRLEISAYLAGEEETMRAMDGVGLSTEQAQEGDEEVVMQLSLKSIHEDANPIVKLINSTLYDALKTGASDIHLETHPGGLAVKYRIDGVMASIANSPGLDSAEQAISRIKVMAQLDIAERRIPQDGRFKVHAMGRLIDFRVSIMPSAFGEDAVLRVLDRKALTEQAQGLSLKALGFDADVIARFRKLASEPYGMVLVTGPTGSGKTTSLYAAISE

SEQ ID NO: 128961 - protein, 293 aa, Glycine max
  Coding DNA Sequence Number=SeqID_37276
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=A1FSF2; Match level="QueryCoverage=100%, HitCoverage=65%, E-value=1e-151, Identity=93%"; Hit description=UDP -glucose 6-dehydrogenase
  Pfam annotation: Domain name=3HCDH_N; Domain location=2-121; Score= -91.5; E_value=0.014; Accession=PF02737.9; Description=3-hydroxyacyl -CoA dehydrogenase, NAD binding domain
  Pfam annotation: Domain name=ApbA; Domain location=3-178; Score= -22.5; E_value=0.017; Accession=PF02558.7; Description=Ketopantoate reductase PanEApbA
  Pfam annotation: Domain name=DAO; Domain location=2-264; Score=-54.5; E_value=0.04; Accession=PF01266.15; Description=FAD dependent oxidoreductase
  Pfam annotation: Domain name=NAD_Gly3P_dh_N; Domain location=1-157; Score=-58.8; E_value=0.093; Accession=PF01210.14; Description=NAD -dependent glycerol-3-phosphate de
  Pfam annotation: Domain name=UDPG_MGDP_dh; Domain location=203-293; Score=165.1; E_value=1.8e-46; Accession=PF00984.10; Description=UDP -glucoseGDP-mannose dehydrogenase family, central domain
  Pfam annotation: Domain name=UDPG_MGDP_dh_N; Domain location=1-193; Score=351.7; E_value=1.3e-102; Accession=PF03721.5; Description=UDP -glucoseGDP-mannose dehydrogenase family, NAD binding domain
  Pfam module annotation: Pfam domain module=3HCDH_N::ApbA::DAO::NAD _Gly3P_dh_N::UDPG_MGDP_dh::UDPG_MGDP_dh_N; Domain location=2-121::3 -178::2-264::1-157::203-293::1-193
MRVAIFGTGYVGLVTGTCLADAGHQVVCVDIDQAKVDGLNQGIIPIYEPGLEPMVKANHAASRLAFTTDAAAAIEHGQVVFIAVGTPPDEDGSADLQYVLAVARTIGRHMSVPTVVVNKSTVPVGTADKVRAAIAEELAARGADIAFDVVSNPEFLKEGDAVADCMRPDRIIIGATSAESVAVMRRLYAPFNRNHDRVVEMDVRSAELTKYAANAMLATKISFMNEIANIAERVGADVEQVRQGIGSDPRIGWHFIYPGAGYGGSCFPKDVQALARTAQQAGLEPKLLNAVEA

SEQ ID NO: 128962 - protein, 128 aa, Glycine max
  Coding DNA Sequence Number=SeqID_37277
  Gene Ontology: Mol. function=hydrolase activity
  Homolog annotation: Hit_ID=Q1GWY0; Match level="QueryCoverage=98%, HitCoverage=37%, E-value=7e-28, Identity=46%"; Hit description=Beta -lactamase-like protein precursor
MQPYVALGRVQPLSGAQKILGDFNAYPTPGHTPGHYYYRLESQGQSITFIGDSVHVEAVQFPHPDITITYDVDQASAAKQRQAQFAQLAKSGAMIAAPHLPYPGIGYINTQKEGFAFIRAEFHDRDGL

SEQ ID NO: 128963 - protein, 135 aa, Glycine max
  Coding DNA Sequence Number=SeqID_37278
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=42%, HitCoverage=56%, E-value=5e-23, Identity=87%"; Hit description=LacZ protein
MKLLRWLAPCFWTQILQGMAPILLPIPYMATHKQGNKETSNNLGSSRVDLQACKLGTGRRLQRRDWENPGVTQLNRLAAHPPCASWRNSEEARTDRPSQQLRSLNGEWRLMRYGAPYASVRYFTPHMVHSQYNLL

SEQ ID NO: 128964 - protein, 93 aa, Glycine max
  Coding DNA Sequence Number=SeqID_37279
  Homolog annotation: Hit_ID=A2Q274; Match level="QueryCoverage=67%, HitCoverage=32%, E-value=3e-07, Identity=48%"; Hit description =Ovarian tumour, otubain, putative
MDNPIQGKICYSLDEQDNSLGDLCSVWDAMNNMITLQHTQIKASFEISTHVVGHVFKKTLYKKLLGMVSRYTLNEIATEFERVHYAGNNPSSC

SEQ ID NO: 128965 - protein, 258 aa, Glycine max
  Coding DNA Sequence Number=SeqID_37280
AWESPLRKDKELRGIRNGIIGGYHEWLKVRTRGLDWLAKLKIINEENFEAPEEDEEVRALKTELGKARLAKEKFKLVATDVRKECVGLREENAATTKALEQETKRARKEEHGHDKFRGALWGSNSELKLRREERDQSRAHSMVLEEELAVCSRSKRNLSQRLCETETNMLVIITKYQEELSLATAHEHRVADEYAQVYGEKEARGRVIDLLHQEATMWMDQFALTFEQESRTSPIASQGQSNGGHLLCPRGDPRTSQL

SEQ ID NO: 128966 - protein, 69 aa, Glycine max
  Coding DNA Sequence Number=SeqID_37281
  Subcellular localization annotation: CTP_CleavageSite=33; ConfidenceScore=5.22e-01
AVHVSSTFEFGAEFHDCLSADPQGNPSYSTFVRSTMNIGSFANPETSQKSKGSRLARSVKFRNVAEVEK

SEQ ID NO: 128967 - protein, 353 aa, Glycine max
  Coding DNA Sequence Number=SeqID_37282
  Gene Ontology: Mol. function=transcription regulator activity; Cellular component=flagellum; Biological process=regulation of transcription, DNA-dependent
  Homolog annotation: Hit_ID=P0A2E4; Match level="QueryCoverage=93%, HitCoverage=53%, E-value=1e-136, Identity=77%"; Hit description=RNA polymerase sigma factor rpoD
  Pfam annotation: Domain name=Sigma70_ner; Domain location=139-350; Score=372.0; E_value=9.8e-109; Accession=PF04546.4; Description =Sigma-70, non-essential region
  Pfam annotation: Domain name=Sigma70_r1_1; Domain location=1-83; Score=157.8; E_value=2.9e-44; Accession=PF03979.5; Description=Sigma- 70 factor, region 1.1
  Pfam annotation: Domain name=Sigma70_r1_2; Domain location=97-133; Score=60.8; E_value=4.6e-15; Accession=PF00140.11; Description=Sigma- 70 factor, region 1.2
  Pfam module annotation: Pfam domain module=Sigma70_ner::Sigma70_r1 _1::Sigma70_r1_2; Domain location=139-350::1-83::97-133
MEQNPQSQLKLLVTRGKEQGYLTYAEVNDHLPEDIVDSDQIEDIIQMINDMGIQVVEEAPDADDLMLNENSTDTDEDAAEAAAQVLSSVESEIGRTTDPVRMYMREMGTVELLTREGEIDIAKRIEDGINQVQCSVAEYPEAITYLLDQYDRVEAGESRLSDLITGFVDPNAEEDLAPTATHVGSELSEEDRDDDEEEDEESDDDSSDDDNSIDPELAREKFNDLRTQYETTRNVIKAKGRSHADAVAEINNLSEVFKQFRLVPKQFDYLVNNMREMMERVRTQERLIMKLCVELCKMPKKNFITLFTGNETSESWFKAALAMNKPWSENCRKWKKTSCVRCRNCCRSKKRPA

SEQ ID NO: 128968 - protein, 38 aa, Glycine max
  Coding DNA Sequence Number=SeqID_37283
MSALMQHMERLMKQRDDALHERLDQMENRDHNEEGGIL

SEQ ID NO: 128969 - protein, 159 aa, Glycine max
  Coding DNA Sequence Number=SeqID_37284
  Subcellular localization annotation: CTP_CleavageSite=25; ConfidenceScore=5.10e-01
GPHPQRHPVDLKKSKRPWGFQLWLRVSVGPTGRPFPPASSCRRDIGKDCARKTPSGPEEGQQGLGGSTEYLSPPARASGPLLIELSSRSTASPGRRRAKHHSSLGWPIAGNRHTATTSRVHLSSSTKRLERCLQHMADQQATKSKAKGKQSTRSVTDKS

SEQ ID NO: 128970 - protein, 133 aa, Glycine max
  Coding DNA Sequence Number=SeqID_37285
  Gene Ontology: Mol. function=carbohydrate binding; Biological process= carbohydrate metabolic process
  Homolog annotation: Hit_ID=A7PP33; Match level="QueryCoverage=66%, HitCoverage=31%, E-value=9e-25, Identity=57%"; Hit description =Chromosome chr8 scaffold_23, whole genome shotgun sequence
MILYNSRGYDPLEALPMTWSEGHVWAVELDMPAGQTFQYKFILKGEGGDIIWQPGLDRLIHTWETKNRIVVLEDWENVELQKITEEDQLAEPNEEPQFWPLLLICIVLGVSWAIDSAFAVCHTIVIVIFTKAS

SEQ ID NO: 128971 - protein, 166 aa, Glycine max
  Coding DNA Sequence Number=SeqID_37286
  Gene Ontology: Mol. function=protein binding
  Homolog annotation: Hit_ID=Q2HVB4; Match level="QueryCoverage=88%, HitCoverage=34%, E-value=2e-57, Identity=71%"; Hit description =BTB/POZ; MATH
  Pfam annotation: Domain name=MATH; Domain location=37-166; Score=3.7; E_value=0.022; Accession=PF00917.17; Description=MATH domain
MSRATCNPAMVSRSVLGSQTSSKSVTETMSGSHEFVIKGYSLTKGMGIGKYIVSETFIVGGFQWAIYFFPDGRDPKDNAAYVSVFVALHSKSTNVRALFDLTLLDLCKKGEHKVHSHFSHSLTIGPYTLINHGSMWGYTRFFKRRHLETSNFLKDDCLKIIALLRF

SEQ ID NO: 128972 - protein, 106 aa, Glycine max
  Coding DNA Sequence Number=SeqID_37287
MCFPHGLRDMCMVRLRLLAFNEYGSGVIDILLGRQAIWREDWGIEFTLATALVAETSTVLASIIFFMLIMASIIVAICTFMASMSAFICSCTSSTSLITLALARVR

SEQ ID NO: 128973 - protein, 36 aa, Glycine max
  Coding DNA Sequence Number=SeqID_37288
MVRLTIERAIAGSYVIGAIEEGHASLAHSSTRGTSC

SEQ ID NO: 128974 - protein, 146 aa, Glycine max
  Coding DNA Sequence Number=SeqID_37289
MPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDLVICAPAAFLGCGSRFLRLPLRNRTLILRHPSPPW

SEQ ID NO: 128975 - protein, 24 aa, Glycine max
  Coding DNA Sequence Number=SeqID_37290
GSRKGLNRSSTFFIRSSSFFDLQR

SEQ ID NO: 128976 - protein, 123 aa, Glycine max
  Coding DNA Sequence Number=SeqID_37291
MLVLTVEEFEEILGCPLGGRKPYLFSGFYPSLARIAKVVKISAQELDEVKQIRNGVVGIPRKHLEEKAKSLADQGEWASFINVLALLVFGVVLFPNVDGLVDLAVIDAFLAYHHSKESPVGIL

SEQ ID NO: 128977 - protein, 92 aa, Glycine max
  Coding DNA Sequence Number=SeqID_37292
MNKYLPHAHILKCTKSIKELYTQEHKKNKRETNKGESHNKTLHKIKWPNSLNTVPSGVTNYRNLPFGGRATRDSWDASSKKGIRAESPPTFI

SEQ ID NO: 128978 - protein, 65 aa, Glycine max
  Coding DNA Sequence Number=SeqID_37293
MSILRLYSAQCCRNDDKKPKRMISRLSQEQFKNQVKFDFKIQESSFKFQESRIKNNQDQDSRLKI

SEQ ID NO: 128979 - protein, 90 aa, Glycine max
  Coding DNA Sequence Number=SeqID_37294
MELKVCGKVKNTIEQDAEVEDWKGLVINVKVEDRSLSEERMYELCAQERDNCQSIFKSIQKLYDNIVSTNKLVWIVCVGVPISAWGRNVF

SEQ ID NO: 128980 - protein, 119 aa, Glycine max
  Coding DNA Sequence Number=SeqID_37295
MKANLRKRVPFKNNLRDGVYFKRNNGGGMIFTCNPPLLLAASLYRYRQQRDTGGIAIGISDTLVSPLVAAEQKLSHSACRYSSWRYMLTKHVAIRTGGTCQRGQSRHWCLRDQASIVLH

SEQ ID NO: 128981 - protein, 92 aa, Glycine max
  Coding DNA Sequence Number=SeqID_37296
MAVLPAPWASPTWPIPPEGLAAPAGVCRHSHRRHSPLSSYVAYIATTSDDTLLSPALPPLAMAGSALPPVAMAVSPEKQTPSVISFEIDPRP

SEQ ID NO: 128982 - protein, 26 aa, Glycine max
  Coding DNA Sequence Number=SeqID_37297
MACRDQDEIGSEGGSREGEKVVTKNA

SEQ ID NO: 128983 - protein, 173 aa, Glycine max
  Coding DNA Sequence Number=SeqID_37298
QLDKPKVVVHVNPTTKRASGPHKEKFHNYLGMTARDKIDILYANWKAIPDALKNLIWEDIIGTFDIPEVSNTKKKGQHDRTPCNKYGLDPKNWEEFVASHKTPSWQDILTIVIGQPEHPSHVRAMGLGVTISQYFGHASHGSKSSTSIIPQHLTKMIQNLKEEWKIETKEENK

SEQ ID NO: 128984 - protein, 211 aa, Glycine max
  Coding DNA Sequence Number=SeqID_37299
KNTWTVNDLVPYMKKLAIISEEQERITEPVSHGPTSECEFPAQEFHILQSSVETRGIGRRREPIEAEQYSQQMMERGHGMYYTPATFSQYPSQMYQYPFEGHHIDTSASEHLFGGVAKTRPHFSWPIITPSQQHDAPMATPNAPFAPQWNVPGAIPDMGDLLGVDLHQEFFAEAEQVEVGRHRGRRNPDRQARRWDQPCGTSSRHHGHHNE

SEQ ID NO: 128985 - protein, 801 aa, Glycine max
  Coding DNA Sequence Number=SeqID_37300
  Gene Ontology: Mol. function=calcium ion binding; Cellular component =integral to membrane; Biological process=calcium-mediated signaling
  Homolog annotation: Hit_ID=A7QXA9; Match level="QueryCoverage=58%, HitCoverage=86%, E-value=0.0, Identity=72%"; Hit description =Chromosome chr19 scaffold_218, whole genome shotgun sequence
  Pfam annotation: Domain name=C2; Domain location=312-393; Score=85.9; E_value=1.3e-22; Accession=PF00168.21; Description=C2 domain
MGKEKIPHQAPFPIRAGQFLGRAIGGGLFVITPAGKRGMCCKAIKLGNPRVHERYVTRLRRKLQFEEWKQANQRRVLSDSETVRWLNHAVENIWPICMEQITSQKILFPIIPWFLEKYKPWTAKEAVVQHLYLGRNPPLITEVRVLRQSDDDHLVLELGLNFLTADDMSAILAVKLRKRLGFGMWAKLHITGMHVEGKVLVGVKFLPTWPFIGRLRVCFVEPPYFQMTVKPLFTHGLDMTELPGIAGWLDKLLSIAFEQTLVEPNMLVVDVEKFVSPQQEKLMVVIKLYPFVILNLTESWFKVDEKEPVAYAKVEVIEASDMKPSDLNGLADPYVKGQMGVYRFRTKIQRKTLTPKWHEEFKIPIITWESDNVLVIAVRDKDHFYDDILGDCSVNINEFRDGQRHDMWLSLKNIKMGSLHLAITILEDNGKGVDTTCEQEPMDFEEPKNSFEANETTDNSSFSPVPPEKSEKLADNYEPIDIKGQQETGVWVHHPGSEVSQRWEPRKGKSRRLDTEIHGEPNDSVGSGNSTVSGSLNNDSSSPDNNHEEKHRMRLVRKGLHKIGSVFHRSPVGEELLSPHDNISSFQTGKVQAEGGSTEGSSPESPASAKGNVKDMAKNILKHAEKSARGLRHVLSCKSRKFKDESPTVPEIEHESDSSDQESVAAQSPIDVIRTPVGSPAVVSGSNGSPNSGVNVVQIVPSNTNVDNQATTEIANEKDDPENTCSSDSNSPVIVNVRLVLHKHVRVSDGAVVCKHSSAQAPKFSDLRTEPGQNHSTSDVASSTLSLDSQNRILAAFSDDE

SEQ ID NO: 128986 - protein, 368 aa, Glycine max
  Coding DNA Sequence Number=SeqID_37301
  Homolog annotation: Hit_ID=A2Q1D6; Match level="QueryCoverage=24%, HitCoverage=14%, E-value=3e-10, Identity=40%"; Hit description =Ovarian tumour, otubain, related
MFNARVHEHVEDEIKSARGRGAVEQGVHVVEGLEGHVHALEGGEDRVELVRVEEGCVREVKRVVASFGVSQSLCLRRARIAVSRFGVVENWDRENNKNLVELWLEFGLILAELTNGLITLKDSENALGVARCTQHYCWCTQLLLKLPKLPLLPAVAAAPSFSLFMNSAAMNSASIYYTQHPTFKNGTMLPFAHCLFLFSLRCAMLPSLRLVWFGERLGYVKVKVHSGVRCCNDRRRHTAYEMDGDQWMYEGIMPKEVDMDYENEEECGVNEPHVYCSDAFNTSQVFDSRENVLRWARSVAYENGFMTVLVRSDRNTGSRGRTSFVLIDCERSGEYKCMKKEFVRRDTGTRKCGCPFKLRRKPVVGGQG

SEQ ID NO: 128987 - protein, 79 aa, Glycine max
  Coding DNA Sequence Number=SeqID_37302
MARQESLMKSLSKAKTSGCWDQSKVGPNVASCSHGDWKLMTGWKKKEDERILQVEKKIKVASGTPTMGTKVLKKPYIQR

SEQ ID NO: 128988 - protein, 669 aa, Glycine max
  Coding DNA Sequence Number=SeqID_37303
  Gene Ontology: Mol. function=nucleotide binding; Biological process =defense response
  Homolog annotation: Hit_ID=A5BH36; Match level="QueryCoverage=97%, HitCoverage=56%, E-value=2e-48, Identity=26%"; Hit description =Putative uncharacterized protein
  Pfam annotation: Domain name=LRR_1; Domain location=121-145; Score =0.4; E_value=2.6e+02; Accession=PF00560.24; Description=Leucine Rich Repeat
  Pfam annotation: Domain name=LRR_1; Domain location=151-174; Score =3.4; E_value=73; Accession=PF00560.24; Description=Leucine Rich Repeat
  Pfam annotation: Domain name=LRR_1; Domain location=178-201; Score =2.6; E_value=1e+02; Accession=PF00560.24; Description=Leucine Rich Repeat
  Pfam annotation: Domain name=LRR_1; Domain location=349-371; Score =0.3; E_value=2.7e+02; Accession=PF00560.24; Description=Leucine Rich Repeat
  Pfam annotation: Domain name=LRR_1; Domain location=492-514; Score =3.9; E_value=59; Accession=PF00560.24; Description=Leucine Rich Repeat
  Pfam annotation: Domain name=LRR_1; Domain location=541-565; Score =1.3; E_value=1.7e+02; Accession=PF00560.24; Description=Leucine Rich Repeat
  Pfam annotation: Domain name=LRR_1; Domain location=567-586; Score =4.1; E_value=54; Accession=PF00560.24; Description=Leucine Rich Repeat
  Pfam annotation: Domain name=LRR_1; Domain location=601-623; Score =4.8; E_value=39; Accession=PF00560.24; Description=Leucine Rich Repeat
  Pfam annotation: Domain name=LRR_1; Domain location=627-650; Score =2.6; E_value=1e+02; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=121-145::151 -174::178-201::349-371::492-514::541-565::567-586::601-623::627-650
MGGCDSIEWEVEGSKRESNNTNVRELQNLHNLTTLEISFKNTSDLPMDFQFPANLKRYNILIGICQFSSLWYGGALERTLKLTDYSWTSRSLFTTVEDLSFAKLKGVKDLLYDLDVEGFPQLKHLYIQDTDELLHLINPRRLMNPHFAFLNLETLVLDNLHKIEEICQGPMHTQSFAKLKVIKVTSCHRLKNLFLYSLTVNLSQLHEIEISSCEGMSEIIAVEKQEDQKELQQIVLPELHSVTLRRLLELQSFYCFLTVDQGSPSNQSYTLALFNNQQKIEAVSPTCNMTHVYIEVLAERECQNMKTIIPSFVPFQCLDELIVPSYDGQEICGSSNEGDPPLGEIAFMKLEELTLKCLPRLRSFCQGSYDFRFPSLQIVRLKECPMMEIFCQRNITTPSLTKVEYRLSGDNWYTSGDHWYGDLNTTVRTVFTKKDQYNPDLGKLAIRDNNDLKSIWPNLVTPNSFPNLTKIVISSCESQYVFPIHVAKVLRQLQVLKISFCTIENIVEESDSTCDMMVVYLQVQKCHDMMTIVPSSVLFHSLDVLHVYWCERLVNIIRPSTTTSLPNLRILRISECDELKEIYGSSNEGDGPVLDDIAFMKLEELTLNNLPRLTSFCQGSYGFRFPSLQKVHLKDCPMMETFCHGNLTTTSHIENIEQDLTSSSESDDS

SEQ ID NO: 128989 - protein, 42 aa, Glycine max
  Coding DNA Sequence Number=SeqID_37304
MRLREAGDEIQRQVFPKSGRINLSVTDIPTLIQHSMRGEEER

SEQ ID NO: 128990 - protein, 1068 aa, Glycine max
  Coding DNA Sequence Number=SeqID_37305
  Gene Ontology: Mol. function=nucleotide binding; Cellular component =cytoplasm; Biological process=defense response
  Homolog annotation: Hit_ID=A5AV39; Match level="QueryCoverage=95%, HitCoverage=96%, E-value=1e-131, Identity=30%"; Hit description =Putative uncharacterized protein
  Pfam annotation: Domain name=AAA; Domain location=129-314; Score= -35.0; E_value=0.024; Accession=PF00004.20; Description=ATPase family associated with various cellular activities (AAA)
  Pfam annotation: Domain name=LRR_1; Domain location=447-468; Score =9.3; E_value=5.9; Accession=PF00560.24; Description=Leucine Rich Repeat
  Pfam annotation: Domain name=LRR_1; Domain location=470-493; Score =11.2; E_value=2.5; Accession=PF00560.24; Description=Leucine Rich Repeat
  Pfam annotation: Domain name=LRR_1; Domain location=495-512; Score =0.9; E_value=2.1e+02; Accession=PF00560.24; Description=Leucine Rich Repeat
  Pfam annotation: Domain name=LRR_1; Domain location=621-645; Score =0.5; E_value=2.5e+02; Accession=PF00560.24; Description=Leucine Rich Repeat
  Pfam annotation: Domain name=LRR_1; Domain location=651-674; Score =0.7; E_value=2.3e+02; Accession=PF00560.24; Description=Leucine Rich Repeat
  Pfam annotation: Domain name=LRR_1; Domain location=678-701; Score =2.8; E_value=93; Accession=PF00560.24; Description=Leucine Rich Repeat
  Pfam annotation: Domain name=LRR_1; Domain location=704-725; Score =0.1; E_value=2.9e+02; Accession=PF00560.24; Description=Leucine Rich Repeat
  Pfam annotation: Domain name=LRR_1; Domain location=864-886; Score =3.5; E_value=70; Accession=PF00560.24; Description=Leucine Rich Repeat
  Pfam annotation: Domain name=LRR_1; Domain location=890-913; Score =3.0; E_value=87; Accession=PF00560.24; Description=Leucine Rich Repeat
  Pfam annotation: Domain name=LRR_1; Domain location=993-1016; Score =4.3; E_value=49; Accession=PF00560.24; Description=Leucine Rich Repeat
  Pfam annotation: Domain name=NACHT; Domain location=128-277; Score= -32.6; E_value=0.021; Accession=PF05729.3; Description=NACHT domain
  Pfam annotation: Domain name=NB-ARC; Domain location=92-386; Score =147.0; E_value=5.3e-41; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::NACHT::NB-ARC; Domain location=129-314::447-468::470-493::495-512::621-645::651 -674::678-701::704-725:...
  Pfam module annotation: Domain location=:864-886::890-913::993 -1016::128-277::92-386
DTQDGVQHRVVEAKRNGEKIENIVQNWLKKANEIVAAANKVIDVDGTRWCLGQYCPYLWTRCQLSKSFEKMTKEILDVIKKAKFDNRFSYRDAPDVTITPLERGYETLESRTSMLNEIKEILKDPKMYVIGVHGMGGVGKTTLVNELAWQVKKDGLFGAVAIADITNSQDVKKIQGQIADALDLKLEKESERGRATELRQRIKKEEKVLIILDDIWSELNLTEVGIPFGDEHNGCKLVITSREREVLTKMNTKKYFNLTALLEEDSWNLFQKIAGNVVNEVSIKPIAEEVAKCCAGLPLLIAAVAKGLIQKEVHAWRVALTKLKKFKHKELENIVYPALKLSYDNLDTEELKSLFLFIGSFGLNEMLTEDLFICCWGWGFYGGVDKLMDARDTHYALINELRASSLLLEGELGWVRMHDVVRDVAKSIASESPPTDPTYPTYIELSNLEILSLAKSSFAELPGGIKHLTRLRLLNLTDCSSLRVIPTNLISSLMCLEELYMGGCNNIEWEVEGSKSESDNANVRELQDLHNLTTLEISFIDTSVLPMDFQFPANLERYNILIGSWALSSIWYGGALERTLKLTDYWWTSRSLFTTVEDLSFAKLKGVKDLLYDLDVEGFPQLKHLYIQDTDELLHLINPRRLVNPHSAFLNLETLVLDDLCKMEEICHGPMQTQFFAKLKVIEVTSCDGLKNLFLYSLTGNLSQLHEIEISSCEGMTEIIAVEKQEDQKELLQIDLPELHSVTLRGLPELQSFYCSVTVDQSIPLALFNQQGQFPNSETVEMSIKNDRESIRPNQVPPNSFHHKLKIDISGCESMDFVFPISAATELRQHQFLEIRSGCNELEEICGSSNEGDGAVLDEIAFMKLEELTLNNLPRLRSFCQGSYDFRFPSLQIVRLENCPMMETFCQGNITTPSLTEVEYGSYDYRHMLSDGPPNSFHCMDSTGMKKITVEKCTGMKTIIPSCALFQCLDELIVFSCHTLVNIIRPSTTSLPKLRILRIWDCNELEEICGSSNEGIDIGMLTEAHKLLPGKLPLQVSITTNCTFDKMSNDGDFLSGKHNHTKPHKGGI

SEQ ID NO: 128991 - protein, 59 aa, Glycine max
  Coding DNA Sequence Number=SeqID_37306
MKSERINRNAPRTDAGNFVEGCGGNVGRGGRVSPGSSPAAASPALSNQFILDPWIFIYG

SEQ ID NO: 128992 - protein, 202 aa, Glycine max
  Coding DNA Sequence Number=SeqID_37307
MATEDVKVKIEKFDVLHRVKKKKFNKRICTWKIKGKKVQIQESLKFSQLEDYRVFEFWKNWTLQKPVQDLRIKRRCSGLHHVCTIVVAKELQQLQVLEIGRFENIETIVGKSDSGDAQDETASTKLEEQKARSENKGDTLGGFASMNLEELIPRNGNKGDAPGEIVFTKLEALFLISLPSLTSFCKASYNFKYPALDVVMVI

SEQ ID NO: 128993 - protein, 83 aa, Glycine max
  Coding DNA Sequence Number=SeqID_37308
MISCLARPHYKPIKVLSDPPSVAKFQTFTPDTCVQRETLPLIKPVTRAEALITDDVILTRSGLLDTSYRVRMMPLPVREDKSG

SEQ ID NO: 128994 - protein, 21 aa, Glycine max
  Coding DNA Sequence Number=SeqID_37309
MMKEKGMEIDTWTEMRKVMRK

SEQ ID NO: 128995 - protein, 1714 aa, Glycine max
  Coding DNA Sequence Number=SeqID_37310
  Gene Ontology: Mol. function=nucleotide binding; Cellular component =mitochondrion; Biological process=defense response
  Homolog annotation: Hit_ID=A5BH36; Match level="QueryCoverage=61%, HitCoverage=91%, E-value=1e-158, Identity=31%"; Hit description =Putative uncharacterized protein
  Pfam annotation: Domain name=Glyoxalase; Domain location=1379-1489; Score=7.8; E_value=0.018; Accession=PF00903.16; Description =GlyoxalaseBleomycin resistance proteinDioxygenase superfamily
  Pfam annotation: Domain name=LRR_1; Domain location=1037-1059; Score =1.7; E_value=1.5e+02; Accession=PF00560.24; Description=Leucine Rich Repeat
  Pfam annotation: Domain name=LRR_1; Domain location=1063-1086; Score =1.1; E_value=1.9e+02; Accession=PF00560.24; Description=Leucine Rich Repeat
  Pfam annotation: Domain name=LRR_1; Domain location=552-572; Score =8.1; E_value=9.6; Accession=PF00560.24; Description=Leucine Rich Repeat
  Pfam annotation: Domain name=LRR_1; Domain location=574-595; Score =14.6; E_value=0.38; Accession=PF00560.24; Description=Leucine Rich Repeat
  Pfam annotation: Domain name=LRR_1; Domain location=597-620; Score =11.2; E_value=2.6; Accession=PF00560.24; Description=Leucine Rich Repeat
  Pfam annotation: Domain name=LRR_1; Domain location=622-639; Score =1.4; E_value=1.7e+02; Accession=PF00560.24; Description=Leucine Rich Repeat
  Pfam annotation: Domain name=LRR_1; Domain location=762-786; Score =2.5; E_value=1.1e+02; Accession=PF00560.24; Description=Leucine Rich Repeat
  Pfam annotation: Domain name=LRR_1; Domain location=819-842; Score =4.4; E_value=48; Accession=PF00560.24; Description=Leucine Rich Repeat
  Pfam annotation: Domain name=LRR_1; Domain location=923-945; Score =6.6; E_value=18; Accession=PF00560.24; Description=Leucine Rich Repeat
  Pfam annotation: Domain name=LRR_1; Domain location=950-974; Score =3.5; E_value=70; Accession=PF00560.24; Description=Leucine Rich Repeat
  Pfam annotation: Domain name=LRR_1; Domain location=976-998; Score =0.0; E_value=3e+02; Accession=PF00560.24; Description=Leucine Rich Repeat
  Pfam annotation: Domain name=NACHT; Domain location=186-335; Score= -40.4; E_value=0.084; Accession=PF05729.3; Description=NACHT domain
  Pfam annotation: Domain name=NB-ARC; Domain location=152-444; Score =128.5; E_value=2e-35; Accession=PF00931.13; Description=NB-ARC domain
  Pfam module annotation: Pfam domain module=Glyoxalase::LRR_1::LRR _1::LRR_1::LRR_1::LRR_1::LRR_1::LRR_1::LRR_1::LRR_1::LRR_1::LRR _1::NACHT::NB-ARC; Domain location=1379-1489::1037-1059::1063 -1086::552-572::574-595::...
  Pfam module annotation: Domain location=597-620::622-639::762 -786::819-842::923-945::950-974::976-998::186-335::152-444
YKGLAMDAIAHVPDVSEIAHLPGVSQIATVITFIKDQIGYISSYEENLEKLMTEVQRLKDTQDGVQHRVVEAERNGEKIENIVQNWLKKANEIVAAANKVIDVEGTRWCLGQYCPYLWTRCQLSKSFEKMTKEISDVIKKAKFETISYRDTPDVTITPSSRGYVALESRTSMLNEIKEILKDPKMYMIGVHGMGGVGKTTLVNELAWQVKKDGLFGAVAIAAITNSPDVKKIQGQIADALDLKLEKESERGRAINLRQRIKKQEKVLIILDDIWSELNLPEVGIPFGDEHNGCKLVITSREREVLTYMETQKDFNLTALLEEDSWNLFQKIAGNVVNEVSIKPIAEEVAKCCAGLPLLITPVAKGLKKKKVHAWRVALTQLKEFKHRELENNVYPALKLSYDFLDTEELKSLFLFIGSFGLNEILTEDLFICCWGLGFYGGVDKLMEARDTHYTFINELRDSSLLLEGELDWVGMHDVVRDVAKSIASKSRPTDPTYSTYADQFRKCHYIISEYLTKVPDDNFFFGMGEVMTLSVYEMSFTPFLPSLNPLISLRSLNLNSCILGDIRIVAELSNLEILSLGGSSITELPGEIKHLTRLRLLNLTYCDSLRVIPTNLISSLMRLEELYMGGCYNIEWEVEGKKSESNNANVRELQNLHNLTTLEISFINTWVLPRNFRFPANLKRYNILIANHMLAYNILIGSDRGKWELSSIWYGGALERTLKLTDYWQTSRSLFTTVEDLSLAKLKGVKDLYDLDVDGFPQLKHLYIHGNGELLHLINPRRLVNPHSAFLNLETLVLYNLYKMEEICHGPMQTQSFAKLKVIEVTSCHRLKNLFLYSLSGNLSQLHEMKISSCEGMTEIIAVEKQEDQKKLLQIVLPELHSVTLRGLLELQSFYCSVTVDQGNPSSQSIPLALFNQKVVTPKLETLELYDMNVCKIWDDKLLVLSCFQNLTRLIVVKCNCLTSLFPSGVARVLVKLQHVEISSCERLKVIFAQEEKIEAVSPTCDMTHVYLEVLAEICGSSNEGDGPVLDEIAFMKLEELTLKYLPRLTSFCQGSYSFKFPSLQKVHLKECPMMETFCHGNLTTTSHIEGRMGLAGTSVENSSHSAAYSFFGFSFLHIFAPSVIILKYEILVNSIATLIFMNVIVSIVFNFGEIEHENATPYVLLSNWFAAVKKIVGGLEIQNLRGKKTPATATTLPLPLPPLSPPPQNITASTTTTTSVLPPLFSLLTFHGNSLVQSNANPDLLAAFKTGGAKLLYEIHLLSTSQCIAAASFLIENRCDGKAAQELAHAMKDFPSKRGDKGWESFDYTLERDCLSFMYYWQSREHRNPSEQRTSALEQGLGVAEMEAARNVILEELEGKGVSEKKIQKQTVSLMAASFRWILQLHKDVPKAARFYSEGLDFSINVCSLRWAELQSGSLKVALVHSPNEQQQATQKGYSSLLSFTVNDMNNTVTKLMALGAELDGPIKYEVHGKVAAMRCIDGHVLGLYEPGEDLLRESGIPYAIVRPCALTEEPAGANLILDQGDNITKYQEKVASKSKKKSNNLACIQAKDRTTGRTEIASCVKVVEIRVGAHIYPQNPVLHIGSPFNLSIKGLSDTVSGQWFTTNGSVISVDTLSGMAKAIGEGCAQDPVEADSCKEHLVPLADMVNTCYKAAGNHVLPNLAVKRHVQMGSHQQEPWLLQNGKPRVLTKETRHGRSAHRMSSTSLRKKSS

SEQ ID NO: 128996 - protein, 112 aa, Glycine max
  Coding DNA Sequence Number=SeqID_37311
MQERGLYLLMTRAMWCSEDDGDCRMRGSDFDVDGGTIVFRRLLQLQVQYDEVTTTRAITNHTMTVFGTRPSLYGNNKFTSLPPNNIQRQVRANVVVLFLLITKMSPPHFQPS

SEQ ID NO: 128997 - protein, 121 aa, Glycine max
  Coding DNA Sequence Number=SeqID_37312
  Subcellular localization annotation: CTP_CleavageSite=43; ConfidenceScore=5.23e-01
MTKGQTTQMPFNMSPQNMTVPQMAGIRHSTMTENPIPTWTEVRMTAPQTIDANMIANSISMPSKVILMMPKNQELSKFQRFKNQLSSFKIQDSRIKFQESRFKNNQDQDSRIKRRLNQDKY

SEQ ID NO: 128998 - protein, 252 aa, Glycine max
  Coding DNA Sequence Number=SeqID_37313
  Gene Ontology: Mol. function=endonuclease activity
  Homolog annotation: Hit_ID=Q2HUP4; Match level="QueryCoverage=82%, HitCoverage=71%, E-value=2e-80, Identity=70%"; Hit description =Endonuclease/exonuclease/phosphatase
MACAEMHGRVAVARDLFDRMPERNMVSLSATIDGYMGKCFIQEVNARSLPGSNALYGSSTVSKEQGPLHRCPDVVKSKQGFPHFRERVWVKKLVHDRRIRFGTWNIGTVTGKSMEIVDVMVRRKINFMCLQETKWTGEKAKELDNSGFKLWYTGKIRSRNGVGIIVDKEWKKDVVDVRRVGDRIIALKLVVGQDTFNVISGYAPQVGLAEHFKVKFWEDLEGVLQDIPQGENVFLGGDLNGHVGSVARGFEG

SEQ ID NO: 128999 - protein, 50 aa, Glycine max
  Coding DNA Sequence Number=SeqID_37314
MAHHAAIRPQEAKESIDEEDPRPTSSTWSYIKNRLIRFREAKTQRHFIVV

SEQ ID NO: 129000 - protein, 74 aa, Glycine max
  Coding DNA Sequence Number=SeqID_37315
MEDIEAFSATNRAKLDEAELAKSVPDNICLEIIRTISTSTAHVLTSSCECKAENKLTDASGSRDIGLFQVNQWS

SEQ ID NO: 129001 - protein, 67 aa, Glycine max
  Coding DNA Sequence Number=SeqID_37316
MALKNEEVEQGPKFSTFREIRELLSDCEVQRGGGDIPPPVNFSIGKCIVSLELDKAGLDNCIARDRV

SEQ ID NO: 129002 - protein, 122 aa, Glycine max
  Coding DNA Sequence Number=SeqID_37317
MNTLSEFIAPVEDFDFQMNTLGVALWLHERGRQQLHYSRPDMTDPDLHTKRPGTVARIIELERRNWHKELTNFADGSIDVAVVKEFYANLYDLEDTSPKQVRPPSLFQVCQIEARSRRAGSP

SEQ ID NO: 129003 - protein, 56 aa, Glycine max
  Coding DNA Sequence Number=SeqID_37318
MDNKGSKLGVESPGRTGAATEGRADEDGADAQALEIQRIRCDFLGLAQGSDEGRKT

SEQ ID NO: 129004 - protein, 168 aa, Glycine max
  Coding DNA Sequence Number=SeqID_37319
MTQKIKDQLEESITEKDVRMKAQAIQKQNTTPHVLSREGYELLEKKLIYEKKKKQLEEVAKFGSTNTLIDPPSSIRRHVKWKMARTKKTYQMTCEATKEIGDKINSLEEQVSQGSFVSYGCQDLQGPATFLLPRLPRPRAMTQKIKDQLEESITEKVTQQLMLSFSQM

SEQ ID NO: 129005 - protein, 81 aa, Glycine max
  Coding DNA Sequence Number=SeqID_37320
MKLTLTPTSTVVARLAISGSENKESRRGEFVMERNTYTEARDSNVMNREWMSCDEEDDAGDTRVATERKICNKVFSSKALE

SEQ ID NO: 129006 - protein, 109 aa, Glycine max
  Coding DNA Sequence Number=SeqID_37321
MGEGIPTRGLPRSLLESSHVQSGGYECGYYVMHWIWNIVSGGLKNDWPMWFGDGTTLDNKTITIIRYKCAAYFVKVNELEVRQPHLPSQMPEARRLSEHYLDWGTGEPV

SEQ ID NO: 129007 - protein, 123 aa, Glycine max
  Coding DNA Sequence Number=SeqID_37322
MPSTIEENEVDDVQANHNDHDEGLSENIPMVMGTPPRSPLHSEGHSEVTSKKSRQSTQLRRLTLRSLHQPRLIVHVDPATGRGSGPQKQKFHNYLGVVAREKIPIVHDNCNWKHVPESLKDLV

SEQ ID NO: 129008 - protein, 1311 aa, Glycine max
  Coding DNA Sequence Number=SeqID_37323
  Gene Ontology: Mol. function=nucleotide binding; Cellular component =cytoplasm; Biological process=defense response
  Homolog annotation: Hit_ID=A5BH36; Match level="QueryCoverage=92%, HitCoverage=94%, E-value=1e-141, Identity=33%"; Hit description =Putative uncharacterized protein
  Pfam annotation: Domain name=LRR_1; Domain location=1008-1033; Score =1.9; E_value=1.4e+02; Accession=PF00560.24; Description=Leucine Rich Repeat
  Pfam annotation: Domain name=LRR_1; Domain location=1089-1111; Score =4.5; E_value=44; Accession=PF00560.24; Description=Leucine Rich Repeat
  Pfam annotation: Domain name=LRR_1; Domain location=1139-1161; Score =4.2; E_value=52; Accession=PF00560.24; Description=Leucine Rich Repeat
  Pfam annotation: Domain name=LRR_1; Domain location=1165-1188; Score =1.6; E_value=1.6e+02; Accession=PF00560.24; Description=Leucine Rich Repeat
  Pfam annotation: Domain name=LRR_1; Domain location=518-540; Score =0.7; E_value=2.3e+02; Accession=PF00560.24; Description=Leucine Rich Repeat
  Pfam annotation: Domain name=LRR_1; Domain location=542-562; Score =10.8; E_value=3.1; Accession=PF00560.24; Description=Leucine Rich Repeat
  Pfam annotation: Domain name=LRR_1; Domain location=564-585; Score =10.2; E_value=4; Accession=PF00560.24; Description=Leucine Rich Repeat
  Pfam annotation: Domain name=LRR_1; Domain location=587-610; Score =10.2; E_value=4; Accession=PF00560.24; Description=Leucine Rich Repeat
  Pfam annotation: Domain name=LRR_1; Domain location=612-629; Score =0.9; E_value=2.1e+02; Accession=PF00560.24; Description=Leucine Rich Repeat
  Pfam annotation: Domain name=LRR_1; Domain location=741-762; Score =1.2; E_value=1.8e+02; Accession=PF00560.24; Description=Leucine Rich Repeat
  Pfam annotation: Domain name=LRR_1; Domain location=798-821; Score =3.0; E_value=87; Accession=PF00560.24; Description=Leucine Rich Repeat
  Pfam annotation: Domain name=LRR_1; Domain location=984-1006; Score =1.3; E_value=1.7e+02; Accession=PF00560.24; Description=Leucine Rich Repeat
  Pfam annotation: Domain name=NB-ARC; Domain location=136-431; Score =140.0; E_value=6.9e-39; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::NB-ARC; Domain location=1008-1033::1089-1111::1139-1161::1165-1188::518 -540::542-562::...
  Pfam module annotation: Domain location=564-585::587-610::612 -629::741-762::798-821::984-1006::136-431
MDAIAHVPGVSQIANYVITFIKDQIGYISSYEENLEKLMTQVQTLEDTQVLVKNRVAEAERNGYKIENIVQNWLKNANEIVAEAKKVIDVEGATWCLGRYCPSRWIRCQLSKRLEETTKKITDHIEKGKIDTISYRDAPDVTTTPFSRGYEALESRTSMLNEIKEILKDPKMYMIGVHGMGGVGKTTLVNELAWQVKKDGLFVAVAIANITNSPNVKKIQGQIADALWDRKLKKETESGRAIELRERIKKQEKVLIILDDIWSELDLTEVGIPFGDEHNGCKLVITSREREVLIKMDTQKDFNLTALLEEDSWNLFQKIAGNVNEVSIKPIAEEVAKCCAGLPLLITALGKGLRKKEVHAWRVALKQLKEFKHKELENNVYPALKLSYDFLDTEELKSLFLFIGSFGLNEMLTEDLFICCWGLGFYGGVDKLMEARDTHYTLINELRASSLLLEGKLDWVGMHDVVRDVAKSIASKSPPTDPTYPTYADQFGKCHYIRFQSSLTEVQADKSFSGMMKEVMTLILHKMSFTPFLPPSLNLLINLRSLNLRRCKLGDIRIVAELSNLEILSLAESSFADLPVEIKHLTRLRLLNLTDCYDLRVIPTNIISSLMCLEELYMGGCNNIEWEVEGSKSESNNANVRELQDLHNLTTLEISFIDTSVLPMDFQFPANLERYHILISDLGEWELSSIWYGRALGRTLKLKDYWRTSRSLFTTVEDLRFAKLKGIKDLLYNLDVGGFSQLKHLYIQDNDELLYLINTRRLMNHHSAFLNLETLVLKLLYKMEEICHGPMQTQSLAKLKVIKVTYCNGLKNLFLYSLTGNLSQLHDMEISHCRGMTEIIAMEKQEDWKELQQIVLPELHSVTLEGLPELQSFYCSVTVDQGNPSGQSNTLALFNQQVQFPNSETVKISIMNDWESIWPNQEPPNSFHHNLDIDIYDCKSMDFVIPTSAAKEFHQQHQFLEIRSCGIKNIVEKSDIICDMTHVYLEKITVAECPGMKTIIPSFVLFQCLDELIVSSCHGLEIGGIDIGILTEAHKLLPGKLWLQGNLTTPSLTKVEYEGIQYVWHSSKLSEDHWYGDLNTTVRTVFTKKLQVLNISWSTIENIVEESDSTCDMTVVYLQEIYGSDNESDAPLGEIAFMKLEELTLEYLPRLTSFCQGSYNFKFPSLQKVHLKDCPVMETFCHGNLTTTNHIEVRCLHGWRYEESEDQWDGDLNTTIRTIFTKKGRMGLAGTCVENSSHSAAYSFFGFSFLHIFAPSAREILVNSIATLIFLNVIVSIVFNIGEIELVNATPYVLLFNSSAAVKKIVGGLER

SEQ ID NO: 129009 - protein, 193 aa, Glycine max
  Coding DNA Sequence Number=SeqID_37324
KPLARTHKTPYRRKFEENPTLLLELWLEENPRYTPPLGTSLLKQSWVLKAQSFLREIEGNMEYVEEANRAAGAIVRFKKVVSLLNSGLGHARVRLTAIVAAIVVVGFECRGDRRIIPPVLSISKARTTVLPLSCVIALIGSSYDRSTPQPLPVNKVCALPQFVALLSKFLISAVGLILFSLGQPFLDLNRFSS

SEQ ID NO: 129010 - protein, 132 aa, Glycine max
  Coding DNA Sequence Number=SeqID_37325
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=41%, HitCoverage=23%, E-value=7e-22, Identity=84%"; Hit description=MADS -box protein
MTNANCPQESLHSVSNGNLRVCVCLIRVIGVVMGDTHENAKIASKKVHVEYEELPAILSIRDAVNATGQCDRIIEGEIQMGEINSRNQYRQTWEAGEQSMPYGTQNAHSQGFSQPLECNPTLQIGYNPEASE

SEQ ID NO: 129011 - protein, 245 aa, Glycine max
  Coding DNA Sequence Number=SeqID_37326
  Homolog annotation: Hit_ID=A5CBL3; Match level="QueryCoverage=31%, HitCoverage=51%, E-value=7e-07, Identity=44%"; Hit description =Putative uncharacterized protein
MSSSEGVVELGIEFSEANNFLLMSLMEETQEEEYDGDDRLVSMIQSLEAEISDTEMSQMYEMSHVDDQDCSTSVSGPDHWVDMELISSLTFDGMNAWIPCGDEMMEHAAMEYEAGNDINDFQLCYGVFLEQQYRETNYLAQGPSEFLVGKPPPGVMPLLSHESSCVLGFYLNPFHNLDPGSALFSVVTSHPMIATILELVNSCRTDTLVSPSWLLDQSYSGPILPTSTKPIFIETGDLVESCDPN

SEQ ID NO: 129012 - protein, 298 aa, Glycine max
  Coding DNA Sequence Number=SeqID_37327
MAEPSKKRKGSSSRSQRHFEAQDIPIPSSISSSSLFSLEEQRTLDDDWKFDFSVHDARRLVCTSQADMIGRLLVDSLALESRILHYFVVRMLLPRSSNLAQVSEEDLIVMWAFHTGRQIDWAHLVRIPLDSEPYIPIKRSFLIGAAAVASFGYRKERDDSWVKKVAQPNDDEGQLSVEGDSSLLQSILDRFDGLQTYVGERFDALEQQVDMRFDAMDSRITNVEEYVTIIRDCLDLPPPPPSNKRGYISCGLVQVEGTSTWLFKENKGGYIPCGSLACKGFYKVERNLKNRRLLGDWM

SEQ ID NO: 129013 - protein, 343 aa, Glycine max
  Coding DNA Sequence Number=SeqID_37328
  Gene Ontology: Mol. function=phosphoprotein phosphatase activity
  Homolog annotation: Hit_ID=A7UQU7; Match level="QueryCoverage=39%, HitCoverage=23%, E-value=3e-16, Identity=39%"; Hit description=IMP dehydrogenase/GMP reductase, putative
  Pfam annotation: Domain name=DUF1723; Domain location=153-202; Score =49.7; E_value=1e-11; Accession=PF08330.1; Description=Protein of unknown function (DUF1723)
MVRARGLGRALGRVIGRGLGRENRDDSDDASQRRRPTPSARRQRKSVLVAADEPVVPAEEPVVGTNEPVVDANVHAKAAVDEPKGFPGGPSDPSVLIEYTEHVTTSVWSGERPELKLSSHGRKGQKLGRFVPAIEGLVAGTGLSPLIACSIDTGDQGLISSFVERWHRENSSFHLPMGEVTITLDDMASLLHLPIVGAFHIFQPLQVDETVLMLVDLLLVSGEAARAETTHCHEPYCWIHEHFLSVAECIADPDYDEVSPCACRWIATKKTVKIISIETYSPRVSFDFMLFRSAPLGARCCQTLNREGHAPVGVGKWASLPRVRPARIGSGPGQFTPLLTWTK

SEQ ID NO: 129014 - protein, 1437 aa, Glycine max
  Coding DNA Sequence Number=SeqID_37329
  Gene Ontology: Mol. function=nucleotide binding; Cellular component =mitochondrion; Biological process=defense response
  Homolog annotation: Hit_ID=A5BH36; Match level="QueryCoverage=91%, HitCoverage=94%, E-value=1e-152, Identity=30%"; Hit description =Putative uncharacterized protein
  Pfam annotation: Domain name=LRR_1; Domain location=1140-1162; Score =1.3; E_value=1.8e+02; Accession=PF00560.24; Description=Leucine Rich Repeat
  Pfam annotation: Domain name=LRR_1; Domain location=1189-1213; Score =7.1; E_value=15; Accession=PF00560.24; Description=Leucine Rich Repeat
  Pfam annotation: Domain name=LRR_1; Domain location=1215-1249; Score =4.1; E_value=53; Accession=PF00560.24; Description=Leucine Rich Repeat
  Pfam annotation: Domain name=LRR_1; Domain location=1274-1297; Score =2.6; E_value=1e+02; Accession=PF00560.24; Description=Leucine Rich Repeat
  Pfam annotation: Domain name=LRR_1; Domain location=519-541; Score =2.2; E_value=1.2e+02; Accession=PF00560.24; Description=Leucine Rich Repeat
  Pfam annotation: Domain name=LRR_1; Domain location=543-562; Score =1.4; E_value=1.7e+02; Accession=PF00560.24; Description=Leucine Rich Repeat
  Pfam annotation: Domain name=LRR_1; Domain location=564-585; Score =11.9; E_value=1.9; Accession=PF00560.24; Description=Leucine Rich Repeat
  Pfam annotation: Domain name=LRR_1; Domain location=587-610; Score =10.0; E_value=4.4; Accession=PF00560.24; Description=Leucine Rich Repeat
  Pfam annotation: Domain name=LRR_1; Domain location=612-629; Score =0.3; E_value=2.6e+02; Accession=PF00560.24; Description=Leucine Rich Repeat
  Pfam annotation: Domain name=LRR_1; Domain location=774-797; Score =2.0; E_value=1.3e+02; Accession=PF00560.24; Description=Leucine Rich Repeat
  Pfam annotation: Domain name=LRR_1; Domain location=801-824; Score =3.7; E_value=63; Accession=PF00560.24; Description=Leucine Rich Repeat
  Pfam annotation: Domain name=LRR_1; Domain location=905-927; Score =2.9; E_value=90; Accession=PF00560.24; Description=Leucine Rich Repeat
  Pfam annotation: Domain name=LRR_1; Domain location=932-956; Score =4.4; E_value=48; Accession=PF00560.24; Description=Leucine Rich Repeat
  Pfam annotation: Domain name=LRR_1; Domain location=958-982; Score =1.4; E_value=1.7e+02; Accession=PF00560.24; Description=Leucine Rich Repeat
  Pfam annotation: Domain name=LRR_1; Domain location=998-1020; Score =1.8; E_value=1.4e+02; Accession=PF00560.24; Description=Leucine Rich Repeat
  Pfam annotation: Domain name=NB-ARC; Domain location=136-432; Score =128.1; E_value=2.6e-35; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::NB-ARC; Domain location=1140-1162::1189-1213::1215 -1249::1274-1297::...
  Pfam module annotation: Domain location=519-541::543-562::564 -585::587-610::612-629::774-797::801-824::905-927::932-956::958 -982::998-1020::136-432
MDAIANVPGVSEIANYVITFIKGQIGYISSYDENLEKLITEAQTLKDTQDGVQHRVVEAERNGDKIENIVQNWLKKANEMVAAANKVIDVEGTRWCLGHYCPYLWTRCQLSKSFEKITKEISDVIEKGKFDTISYRDAPDLTITPFSRGYEALESRTSMLSEIKEILKDPKMYMIGVHGMGGVGKTTLVNELAWQVKNDGSFGAVAIATITSSPNVENVQDQIVVAICGKNLEHTTKVGRMGELRRRIKAQNNVLIILDDIWSELDLTEVGIPFGDEHNGCKLVITSREREVLIKMDTQKDFNLTALLEEDSWNLFQKIAGNVVNEVSIKPIAEEVAKCCAGLPLLITAVAKGLRKKEVHAWRVALKQLKEFKHKELENNVYPALKLSYDFLDTEELKSLFLFIGSFGLNHILTEDLFRCCWGLGFYGGVDKLMEARDTHYTLINELRASSLLLEGELDWVGMHDVVRDEAKSIASKSPPIDPTYPTYADQFGKCHYIRFQSSLTEVQADNLFSGMMKEVMTLSLYEMSFTPFLPPSLNLLIKLRSLNLRCKLGDIRMVAKLSNLEILSLEESSIEELPEEITHLTHLRLLNLTDCYELRVIPTNLTSNLTCLEELYMGGCNSIEWEVEGSRSESKNASLSELQNLHNLTTLEISIKDTSVLSRGFQFPAKLETYNILIGNISEWGRSQNWYGEALGPSRTLKLTGSSWTSISSLTTVEDLRLAELKGVKDLLYDLDVEGFPQLKHLHIHGSDELLHIINSRRLRNPHSSAFPNLKSLLLYNLYTMEEICHGPIPTLSFAKLEVIKVRNCHGLDNLLLYSLARNLSQLHEMEINNCRCMKEIIAMEEHEDEKELLEIVLPELRSLALVELTRLQSFCLPLTVDMGDPSIQGIPLALFNQQVVTPKLETLKLYDMDICKIWDDKLPLHSCFQNLTHLIVVRCNSLTSLFASWMGRGLVKLQYLNIYWCQMLKAIFVQEEIYGSNNESDDAPLGEIAFRKLEELTLKYLPRLTSFCQGSYDFRFPSLQIVIIEECPVMDTFCQGNITTPSLTKVEYRLSRDNWYRIEDHWYGDLNTTVRTAFTKKYLYDDWETLDIRNNNNLKSIWPNQVTPNFFPNLTKIVIYRCESQYVFPIYVAKVLRQLQVLEIGLCTIENIVEESDSTCEMMVVYLEVRKCHDMMTIVPSSVQFHSLDELHVSRCHGLVNIIMPSTIANLPNLRILMISECDELEEVYGSNNESDEPLGEIAFMKLEELTLKYLPWLKSFCQGSYNFKFPSLQKVHLKDCPMMETFCHGNLTTTSHIEVRCLYGWSNEESEDHWDGDLNTTIRTIFTKECYMSGNGKGGMGLAGTCVKNSSHSAAYSNSSIIVKYEILVNSITTLIFMNVIVSIVFNFGEIELANATPYVLLSNSSAAVKKIVDQKDKVHMFLAVRGSITGILK

SEQ ID NO: 129015 - protein, 199 aa, Glycine max
  Coding DNA Sequence Number=SeqID_37330
MVLKSSPFSDSQCKKQLATLEELRARDVRFIQREDMTSFCEKLHGESLRKPIEREVKTRSSCSRGKSRADRLARSSQTQVDVPSTCTTKDVPSNVLRQRSQAVKPLILCEWGYKRILRREKEDTKEFRRLVLRSFGKGRRKTQKEFRQLVLGEFFLAKGEENEKMNSTSFQGLENQKTSKRFWYKEEEEVQRESRLVKD

SEQ ID NO: 129016 - protein, 51 aa, Glycine max
  Coding DNA Sequence Number=SeqID_37331
MEKFDKKTFKDKKGKKTYITWEDNDLDSSGDSENEVMNLSFMPKNYESNEE

SEQ ID NO: 129017 - protein, 239 aa, Glycine max
  Coding DNA Sequence Number=SeqID_37332
  Gene Ontology: Cellular component=cytoplasm
  Homolog annotation: Hit_ID=A7QXG6; Match level="QueryCoverage=82%, HitCoverage=86%, E-value=2e-71, Identity=65%"; Hit description =Chromosome undetermined scaffold_223, whole genome shotgun sequence
  Pfam annotation: Domain name=SOUL; Domain location=47-231; Score =290.8; E_value=2.7e-84; Accession=PF04832.3; Description=SOUL heme -binding protein
  Subcellular localization annotation: CTP_CleavageSite=21; ConfidenceScore=5.10e-01
MAAASTMITLKFSFLWSLLLSVSLLGVKSSHSHQNGGRRTIPPTCKRIECPTHDVIEVGDGYEIRRYNNNSTVWMSTSPIQDISLVEATRTGFRSLFDYIQGKNNYKQKIEMTAPVITEVSPSDGPFCKSSFVVSFFVPKLNQANPPPAKGLHVQRWNNMYVAARQFGGHVNDSNVAVEAAVLRASIEGTKWSGAIDKNQKAGHASVYTVAQYNDPFEYQNRVNEIWFLFEMESERHAI

SEQ ID NO: 129018 - protein, 55 aa, Glycine max
  Coding DNA Sequence Number=SeqID_37333
MAKFGMSSSVGMLATAGDGNGMDVRYRGWYTCINWGWGWCGCGGGVSATSKDLTA

SEQ ID NO: 129019 - protein, 139 aa, Glycine max
  Coding DNA Sequence Number=SeqID_37334
  Subcellular localization annotation: CTP_CleavageSite=25; ConfidenceScore=5.14e-01
MASLLCESHVAWKPPVVMAIQAQVQVASFSGESGHRFPVSLFRGRHMVEAFPEGTFFRYTMNSVMIVLYFNGRVYEDNDGVIFEGSKKAIQIKRGISFNAFKKKIGDKCHENILPCKFAMTKTLKRCWKVLNNNKKCQF

SEQ ID NO: 129020 - protein, 233 aa, Glycine max
  Coding DNA Sequence Number=SeqID_37335
MKSRFHLLKVFGNITESRFHCAAGQWIGIHLYLMWLQCHLDGEIRMMEVKDFQEQDNLLNWAQPVKKEHRTQTARTNGEFGVLEQIASTNGVSCMQRRNRQSKWRYGLRFGNRQSNWRVPWPEAAGLRPCHGSAVLQVQAKPLLPLAVCLAQGLPRKRYYHWRKKLRDCTALPSFASIALLFFFLISSYLVAVAFFLFGCCLLFLGCALFQSWYVISLLFILREFSVLDLVGM

SEQ ID NO: 129021 - protein, 250 aa, Glycine max
  Coding DNA Sequence Number=SeqID_37336
  Gene Ontology: Mol. function=transporter activity; Cellular component= integral to membrane; Biological process=transport
  Homolog annotation: Hit_ID=A7QYY3; Match level="QueryCoverage=93%, HitCoverage=70%, E-value=3e-86, Identity=69%"; Hit description =Chromosome undetermined scaffold_259, whole genome shotgun sequence
  Pfam annotation: Domain name=DUF572; Domain location=1-250; Score =350.3; E_value=3.3e-102; Accession=PF04502.4; Description=Family of unknown function (DUF572)
MGERKVLNKYYPPDFDPSKLPRARRPKNQQIKVRMMLPMSIRCNTCGNYIYKGTKFNSRKEDVIGETYLGIQIFRFYFKCTKCSAEVTMKTDPQNSDYIVESGATRNFEPWRAEDEEADKTKEKRDAEEMGDAMKSLENRTLDSKREMDILAALDEMKSMKSRHATVTVDEMLEALQRTAADKCYLSSAFGTKILNSDGFVRRIRDEDIETEEQLDQFSNGHGETSSSNTKKQREREEERAREKLEFVEL

SEQ ID NO: 129022 - protein, 117 aa, Glycine max
  Coding DNA Sequence Number=SeqID_37337
MGSYIPQLLLISSGYLVSKYKLFGIIALISCYTELPWHSFRKIKANWTELGSRKVPRCASKGFIVRACLLCRLKCNGTKLNTLSPQKQGRGCFLETKVGTKRKLESKIQNDTKCMFG

SEQ ID NO: 129023 - protein, 159 aa, Glycine max
  Coding DNA Sequence Number=SeqID_37338
MEFSVMFDRTLSFVVFLPFGFTFTHHVQPIIEEVESIVEAEVDLDVMAVKVYDPLPSRVYVRLVEAKLLKMREALAQDSDYVEKETMKWHLIADFFHEKATGYEFPSPLNSHVFPSLIDLSSESNDSGDEFLKKLDEEFNVTIPHTSVFILSDNIRVLP

SEQ ID NO: 129024 - protein, 161 aa, Glycine max
  Coding DNA Sequence Number=SeqID_37339
MAHAQPGLIDGSLLRLQDNHILNQVWEGQQRIIHLRAHIMKLIGGCLMPNTSSAKVHFMYLLLFSNLTEAWDRIKCITPKIDNLSVEEVQEGLGFPLTRKWSHPTIETNIHANSVRLMHVIFDRLHMNYYLDHHQHQSYVKSNVPLVHVSGYMPQHYQSQA

SEQ ID NO: 129025 - protein, 382 aa, Glycine max
  Coding DNA Sequence Number=SeqID_37340
  Homolog annotation: Hit_ID=A2Q6B4; Match level="QueryCoverage=41%, HitCoverage=83%, E-value=6e-13, Identity=25%"; Hit description =Ribosomal protein L33; Nucleic acid-binding, OB-fold
  Pfam annotation: Domain name=DUF223; Domain location=36-129; Score= -6.3; E_value=0.012; Accession=PF02721.5; Description=Domain of unknown function DUF223
MAHSPNKTKSIDGSRETLKLAVRITDLWFIWIPNKSEQAEMGDEIHVLGKKDQLKSWKDDLKENFTYVMHNFKVMKNDGQFRLCDHQYKLAFTEVTVVRQSDLDHLPFRKFRFADFSNVIAGHFQTGLLVLSCTLWEDCCLQFLAYLNEVENDRPIIILLTHARIKEDQGSYPSSVSNSLKVSKLMINELVLEIQEFSERLSDLEIEVRSVFTSLGQGSSQLSGSSQLSSKNAFLSKSEAKSICQINAISKDGDVDLNASPQALDRLLGCVLAFKVKLQPKFRNSIVLKYSNELDLINVVLNMLPNTEACSKIDSSILHSNDATQLEFQFMSVIADHDPLLSIPLTPTKRLSSNELDDEPRSSQILPAQLSSNKLARHCQIE

SEQ ID NO: 129026 - protein, 210 aa, Glycine max
  Coding DNA Sequence Number=SeqID_37341
MSSKVILMMPKNQELSKVLSKDSRIKFQVSRFKNNQDQDSRVKIQESREDSIKICALDDDWKFDFSVHDAHRLVCTNQADMTGRLLVGSLAFECLIMHYLIVRILLPRSSNLAQVFLTGRQIDWAHLLRYCMHKALRSNTPLPYPHLITLFLQHFNVSLDSEPFVKVKRSFSIGVNVFSSFGYRKEMDDSWIKKDAPVQAAEDRSPSPHS

SEQ ID NO: 129027 - protein, 63 aa, Glycine max
  Coding DNA Sequence Number=SeqID_37342
MNLHGAVLLGQFDSELAVVGGATTVDSENLDDVRVVEGQNVREVGRKWLKNNTMAQRMGEGRE

SEQ ID NO: 129028 - protein, 275 aa, Glycine max
  Coding DNA Sequence Number=SeqID_37343
  Gene Ontology: Mol. function=metal ion binding; Cellular component =intracellular; Biological process=regulation of transcription
  Homolog annotation: Hit_ID=Q8RWD0; Match level="QueryCoverage=26%, HitCoverage=17%, E-value=4e-19, Identity=59%"; Hit description=Zinc finger protein CONSTANS-LIKE 16
  Pfam annotation: Domain name=zf-B_box; Domain location=10-57; Score =22.7; E_value=0.00053; Accession=PF00643.15; Description=B-box zinc finger
MKVAGALGAKTALACDSCVSRRPRWFCAADDAFLCHASNTLVHSANQLASTHERAQLQTASSKIIILSHYCTTTPPTTYKELNFVDTNVTVSRTLETDIDIENEQMKHAMAVATATTVPAHAAMAAIAAVILLTSAANGTSKSIEEAAAIKIQSSFRSHLLFHFLRNRVLSLRFNVVGTSNRSLGEKTIEGNTDMHAGFGHMQHKSDLRKYPHWIKTPGLRIDVNLGVSKQDQHPLRMELLLTGEQPPEKQIEKHEQTRQSRIVEEKQVQQLKSL

SEQ ID NO: 129029 - protein, 284 aa, Glycine max
  Coding DNA Sequence Number=SeqID_37344
MEYAKKHRKYKNSTTLPTYCLMEDMVVAPPSPIARHVKWKMARTNKYGQMTSIAAQEIFDKIEQTTHRTFVPHGRQDILNTVLGSPKHPGRVRVAGHGVTIGNFWTACQWLQQFFGNDHPISIGGNHRKSKARVEERALVRPLNPDVLVARVSTKESCVEAAANVVAKDRSAVDETTMGKRVDQVEVAAESSGIAVGREPIWTSKYWGKIFHTHADVAEIISGHKCLSISILQFWIMMSAVEAEVMGHCMVSLSLSRYTMLRTDVNNANNTFKHGSRNHNDNCT

SEQ ID NO: 129030 - protein, 170 aa, Glycine max
  Coding DNA Sequence Number=SeqID_37345
  Gene Ontology: Mol. function=nucleic acid binding
  Homolog annotation: Hit_ID=A7QK80; Match level="QueryCoverage=94%, HitCoverage=63%, E-value=4e-81, Identity=75%"; Hit description =Chromosome chr19 scaffold_111, whole genome shotgun sequence
  Pfam annotation: Domain name=RRM_1; Domain location=84-153; Score =43.1; E_value=9.8e-10; Accession=PF00076.13; Description=RNA recognition motif. (a.k.a. RRM, RB
MIFIVSFELKVIDCRICGDPHSVLRFAFVEFADEYGARTALNLGGTVLGYYPVRVLPSKTAILPVNPTFLPRSDDEREMCARTVYCTNIDKKVSQAEVKNFFESACGEVMRLRLLGDHVHSTRIAFVEFAMAESAIIALNCSGMLLGTQPIRVSPSKTPVRPRVTRPASH

SEQ ID NO: 129031 - protein, 437 aa, Glycine max
  Coding DNA Sequence Number=SeqID_37346
  Homolog annotation: Hit_ID=A2Q4S5; Match level="QueryCoverage=30%, HitCoverage=23%, E-value=3e-10, Identity=34%"; Hit description=IMP dehydrogenase/GMP reductase, putative
  Pfam annotation: Domain name=DUF1723; Domain location=264-313; Score =46.2; E_value=1.2e-10; Accession=PF08330.1; Description=Protein of unknown function (DUF1723)
MSGSMVALGGGWIYMGEVGDMLGVPSNIVAAISVCLRNLCGVVAVFLASRHGNCLKMAKMKGSETPGRTSFGSFSGRSSSGEATGRRFFLKNNFFFRKNLLLVACSEEGSSGRALARVIGRGRQDKHDAIDVARRRRPTASARRQHVHIVVDEGVPQVIEDVLHMADDVPQTSKDAPQMTSDVDATVAEDLGRDSAKGSHADEGFLGGLHDPSVLTSFAKHECLELNLVSHERKVVLIGRPVPEIEGLVTTTRLSPLIGCSVVTDDPGLISVFVERCHRETNTFHLPVGELTITLDDVLSLLHLSISDAFHNFEALSMDEAIFLLMELLEVSDEMPDTTMDCSSSCLSPAAGFLRPGLEWGLCLGSYDPDHEDYMQPDILEVIVAFDPPRHAVAIAERLECVLNLRRVTAGTELHDILQDCLRIVRGGASANGSVRD

SEQ ID NO: 129032 - protein, 89 aa, Glycine max
  Coding DNA Sequence Number=SeqID_37347
MVSPHKAPKKPPITFTTSDFKAIYPVQDDPVVISVEINNKTYSSKKKKDGGRKVSSSMARSLQIANSSYFPRNRLHNMACKCHHGQKIE

SEQ ID NO: 129033 - protein, 29 aa, Glycine max
  Coding DNA Sequence Number=SeqID_37348
MEECPCIHGPLALEGKLVLKAHGGHNQQS

SEQ ID NO: 129034 - protein, 144 aa, Glycine max
  Coding DNA Sequence Number=SeqID_37349
METSIRYALAMSNYIRYALAMSNYIRYVPIGLNTQTSKVGWLLLPALPKLLPTLFSEYFLTFQIGHSISKKGSAFPNTKREPKKQLKSAESNSPHPSAPKDQKTMANRAHLVSSSHVHTRKNNYEKFCRTFQIFNHTPKLNYHD

SEQ ID NO: 129035 - protein, 199 aa, Glycine max
  Coding DNA Sequence Number=SeqID_37350
  Homolog annotation: Hit_ID=B0F481; Match level="QueryCoverage=53%, HitCoverage=14%, E-value=6e-15, Identity=43%"; Hit description =Mitochondrial bifunctional diaminopelargonate synthase-dethiobiotin synthetase
MVTKKPVGGHVQLIKQLGRVRYVEAEAPSFPSSPSKPASPPTLRLPLHLQQALPTLPHPQSPHSTLRLPPHHQRVPIVMASNLLADEEGVGPPLELLCKTLYAWEEAVSPLLATEREGLVPKDSTVLETLGECLNDVAEWGASKERLLVKLPVQDLLARFDVTCTAFVGDGRLGGISGTISAYESPLMLWMLFLRITIF

SEQ ID NO: 129036 - protein, 241 aa, Glycine max
  Coding DNA Sequence Number=SeqID_37351
MAFLGETSSQTIVNSRLAFIFQNGSVIHNECGIYFQSSTPVPMRVPNTCDFATLKSRIHNTLQLNDNQVVDEIHYRQPLEDTDNKIHFQCMQLKDDMDVNTMLMCNDRFSCVGPIELSCTASRTPDGILNLLERTMTSTHDVVLYYNGRWNMPRQNNFVGYAFTRKNPQKFDIPKGCTIYELKDLIKQVAPKGNPLHGIHESQLVLVESNYWKQFMPIEILALFSKPVMENKDEVVTSLQD

SEQ ID NO: 129037 - protein, 629 aa, Glycine max
  Coding DNA Sequence Number=SeqID_37352
  Gene Ontology: Mol. function=endonuclease activity
  Homolog annotation: Hit_ID=Q2HUP4; Match level="QueryCoverage=23%, HitCoverage=48%, E-value=1e-36, Identity=56%"; Hit description =Endonuclease/exonuclease/phosphatase
  Subcellular localization annotation: CTP_CleavageSite=91; ConfidenceScore=5.11e-01
MEKKAKGYLTVRGTRKGSMLPHELPVASQLIPASFRSFSSTWATTNGALHVSAQRWNCSASSCCFRVRECRCKWKRVLRCCSTTVMNGKLRAQAIRKACNLLHEAFIARKLVRKCQCSQSLGIDFESTRKRLLSLFDPERTLPSFQQPPYEASMAAVHDCHSPYGASTFHYHHPFPSHSFHTANHQQPCPQHPFPSMSNTSKHEGSLTHLEAVLTRLDESMHSMNLKIDELLNRFPPATPISNANPIPVPHPYHAAPANNHRINLEGPWTDGTAPHLQEEKLSECCPWTPSPPPPPPPAPSPPPPSPPLVALIQPPPTTLPGPLPIVIVSLITNSNPHMSSDPRGITILGVRKEHFSRGKELDHSFPLTFYTAKWLDFRNTNLHLLISSPILIWDPGSNVEAMVALGSRNPSITLSRLHAFLMGCTRSFPFITTTEFVIASDDNYGKKQVVSLTPFLYDYVLKNVREPEAIATGDDLYAWKSDVVARKQRAVWLEYSVKRARAAASPPGCSEKRIRFGTWNIGTLTGKSMEIVDVMVRRKINFMCLQETKWTGEKAKELDNSGFKLWYTGKIRSRNGVGIIVDKEWKKDVVDVRRVGDRIIVLKLVVGQDTFNVISGYAPQVGLAEYFK

SEQ ID NO: 129038 - protein, 38 aa, Glycine max
  Coding DNA Sequence Number=SeqID_37353
MESCIIRIDARKLEEWAGVQNPTSLVEFSSKEGEAEKI

SEQ ID NO: 129039 - protein, 105 aa, Glycine max
  Coding DNA Sequence Number=SeqID_37354
  Subcellular localization annotation: CTP_CleavageSite=60; ConfidenceScore=5.74e-01
MVLISSFSPPPSPTSLFSLITKQTFSSLHFFITFHCEMTKLRSSRLTMEVAPPRFVSVTRCRVKKMLDTIKEEENDFAADKRFSSPSCGSSSLSLVERPVLLKNF

SEQ ID NO: 129040 - protein, 280 aa, Glycine max
  Coding DNA Sequence Number=SeqID_37355
  Gene Ontology: Mol. function=glutathione transferase activity; Cellular component=cytoplasm; Biological process=metabolic process
  Homolog annotation: Hit_ID=O49235; Match level="QueryCoverage=100%, HitCoverage=93%, E-value=1e-102, Identity=87%"; Hit description=2,4 -D inducible glutathione S-transferase
  Pfam annotation: Domain name=GST_C; Domain location=97-193; Score =77.6; E_value=4.2e-20; Accession=PF00043.16; Description=Glutathione S-transferase, C-terminal domain
  Pfam annotation: Domain name=GST_N; Domain location=223-278; Score =21.2; E_value=0.004; Accession=PF02798.11; Description=Glutathione S- transferase, N-terminal domain
  Pfam annotation: Domain name=GST_N; Domain location=3-76; Score=90.3; E_value=6.2e-24; Accession=PF02798.11; Description=Glutathione S -transferase, N-terminal domain
  Pfam module annotation: Pfam domain module=GST_C::GST_N::GST_N; Domain location=97-193::223-278::3-76
MADEVVLLDFWPSPFGMRVRIALAEKGIKYEYKEEDLRNKSPLLLQMNPVHKKIPVLIHNGKPICESLIAVQYIEEVWNDRNPLLPSDPYQRAQARFWADYVDKKIYDLGRKIWTSKGEEKEAAKKEFIEALKLLEEQLGDKTYFGGDNLGFVDIALVPFYTWFKAYETFGTLNIESECPKFIAWAKRCLQKESVAKSLPDQQKLGASKMLTNQANHQKETCYNIYGINPYGMRVRIALEEKGIKYENREENLSNKSPLLIQMNPVHKKIPVLIHNGRPI

SEQ ID NO: 129041 - protein, 151 aa, Glycine max
  Coding DNA Sequence Number=SeqID_37356
MVVQSWVEDVSDLGLVEKNHDHLREKNMGIALNQLDVLDSRIAGVGSDGDVGAGKDRGVVDLGLLEWERGWRKEKREENFDRPRGRDWLRTHRSRVNKCTRKGRVMENLERGRGRMRTKNNCKEVRQSVVGNLEIERSRENESAQRIAAER

SEQ ID NO: 129042 - protein, 127 aa, Glycine max
  Coding DNA Sequence Number=SeqID_37357
MVGLALKSAISTSDDSEGEDAEGSKAENLTLLKKQNEEKPGYIAWKENASSSSSGSNDEEEENLYLMANEEVDSNVGASDFDQLLDAFNEMHEEVQKLSLANNFLKGKLRWHPSNLCGIMATDAQGI

SEQ ID NO: 129043 - protein, 998 aa, Glycine max
  Coding DNA Sequence Number=SeqID_37358
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=98%, HitCoverage=93%, E-value=0.0, Identity=53%"; Hit description=Kinesin, putative; 56847-62063
  Pfam annotation: Domain name=Kinesin; Domain location=317-638; Score =534.7; E_value=9.9e-158; Accession=PF00225.14; Description=Kinesin motor domain
RSILGYSLTSPDLVICGSPDIAGISYGDSPELLKNKHSKDVEQSMELSLEYGIKGSQVEADNGHKIPTVKFSNFCQAFEQEEELLSPEASFELLPPLVTKNESPQDLPLRDTEMLEDIGVSQEAEMESSEVCLFVNRDRFAVLSRKNDTEDIGMEAKFKRLKRDFDSQRKELTETRRELGEIKRENQQKSRECQEAWNSLKELQNELMRKSMHVGSLAFAIEGQVKEKSKWFSSLRDLTRKLKIMKMEHIKLLEEAEASKKYQADMREMGLIIKSKINEQLESHEDLKSKYIEGATERKDLYNKVLELRGNIRVFCRCRPLNTDEIYAGATVALDFESAKDGDLTVMSNGAPKRTFKFDAVFGPQAEQADIFKDTAPFATSVLDGFNVCIFAYGQTGTGKTFTMEGTEEARGVNFRTLEKMFDIIKERQKLYCYDISVSVLEVYNEQIRDLLVAGNHPGTAAKRLEIRQAGEGMHHIPGLVEAHVNNMTEVWEVLQTGSNARAVSSTNSNEHSSRSHCIHCVMVKGENLLNGECTRSKLWLVDLAGSERVAKTEVHGDRLKETQNINRSLSALGDVISALATKSSHIPFRNSKLTHLLQDSLGGDSKALMFVQISPNENDLSETICSLNFASRVRGIELGPARKQLDTVELLRHKQMVEKVKQEVRLKDLQIKKLEETIHGLESKMKERDSKNKNLQEKSSFPQVDGFSWTSLANVSSLSVFTSKVKELESQLLVERKLARQHVDSKIAEQHQMKHQEEQNNTLLRPALASRPLGSLKNFNDPVSGGWFKDQQINSAKPLTENNILKPRIPFSTMESSIKCIDHAEKENNPDMADKALLPKRPGRASICMMTPRVPSAVASRRNSLIPLPSIPSLTQFQSPLLPKLTNQFDQKDANGESETNCVPAQTHCESPKEVRSGAKRIGSILRRSLHKKIQVKSPLQQHMRKVGVNVGMEKVRVSIGSRGRLAPRGQVGSGRRGGAKDIQQKNSQKEKERGWI

SEQ ID NO: 129044 - protein, 122 aa, Glycine max
  Coding DNA Sequence Number=SeqID_37359
MWLCWKNKVGDFCLNLILLEGGFSNLYTILRRTSWMHLLVTTHRSYDKVWGTEEEPWLRKQGHRYVETPMVEGLEDMTVADIVSHQNDSWNLDIINQILIPDDIIDVTHTIVPSLMADDKLK

SEQ ID NO: 129045 - protein, 102 aa, Glycine max
  Coding DNA Sequence Number=SeqID_37360
MAYGKYADTLLMAIAQDNVNHIFPVEEETTSVWDVYKSTNVDRSHELCVATIYFTEHHAYENFFGGLLARENVTKIQRRSVGYDPRRSTKNCLSSHLAFPSK

SEQ ID NO: 129046 - protein, 50 aa, Glycine max
  Coding DNA Sequence Number=SeqID_37361
MVPIRWGIRDNTGEKEGFLPNLFLLNPCLLKDLEKGFEQNQSTKETILKS

SEQ ID NO: 129047 - protein, 167 aa, Glycine max
  Coding DNA Sequence Number=SeqID_37362
  Homolog annotation: Hit_ID=A7R8H9; Match level="QueryCoverage=46%, HitCoverage=30%, E-value=2e-18, Identity=49%"; Hit description =Chromosome undetermined scaffold_2575, whole genome shotgun sequence
MGDAGFMLEFVKFLNAKSFEVREMAAEALSGMVIVPRNRKSCTSGRKKIVSSGYAKNIEKLADAEVSSDANRLVKKFSAGYAAIVVRPLAMADCTKECSKNIIVYAFVLCYHMLKTSILGKHIVIDEVSICIAFPCSKAMSFGYSYFLVVNEQCEHVAIANCSYHVA

SEQ ID NO: 129048 - protein, 165 aa, Glycine max
  Coding DNA Sequence Number=SeqID_37363
  Gene Ontology: Mol. function=electron carrier activity; Cellular component=anchored to membrane; Biological process=electron transport
  Homolog annotation: Hit_ID=P29602; Match level="QueryCoverage=66%, HitCoverage=76%, E-value=1e-14, Identity=41%"; Hit description =Cucumber peeling cupredoxin
  Pfam annotation: Domain name=Cu_bind_like; Domain location=33-124; Score=42.6; E_value=1.4e-09; Accession=PF02298.8; Description =Plastocyanin-like domain
MGFNLIGSSIFAMIFIIGVTEATNYTVGDSFGWSVPSNKSFYTDWASTKKFFVGDNLIFNWNGNHSIKITMKTIDYESCNSSWFDALTYLVTKNGTAMSIHTIDAPIGYRYFYCIVGNHCELGQKFSINVQSHSGSSPAPAPAPSFGILSAFLSSLAVYFFTLTR

SEQ ID NO: 129049 - protein, 80 aa, Glycine max
  Coding DNA Sequence Number=SeqID_37364
MQNIREEFFLSGSNFVKSFYKGSEKSQVGCLSIGRRHGIYRTNYIPISVDNRYVKTQTSGSEVVWWHGVAQSRSCGFRQV

SEQ ID NO: 129050 - protein, 76 aa, Glycine max
  Coding DNA Sequence Number=SeqID_37365
MSFATLRKAVTDVIGGDNCVEYNCMELKYNNEVGKMFFTFSQFSSKGPIELFAMVGRSPIEILVLLHKPRKPRPAE

SEQ ID NO: 129051 - protein, 417 aa, Glycine max
  Coding DNA Sequence Number=SeqID_37366
  Gene Ontology: Mol. function=phosphoinositide phospholipase C activity; Biological process=intracellular signaling cascade
  Homolog annotation: Hit_ID=A2WQY6; Match level="QueryCoverage=44%, HitCoverage=16%, E-value=2e-14, Identity=27%"; Hit description =Putative uncharacterized protein
MRYLQFLRDLGECITYAWGVALLGDFTLLIQLWAWKRCPTLAPSFISPQQQNAPLAYRWLGGEFHHIGNDNLLDFRRKLDVMKRDEFVWVPYSGHVKMNLSQSDRVMRQFGMQQPISGPVMQPSNIHDLTLKGKEGRNWMQLMQPALHEWNSRYERRVEQTSPQTGTLGLNSEYMRWYRRKTKVYVDPKHARRGLLGEIAETLHFMMLPVGRRVCTFDNLLPCIEKITLLSDEEDKILEAHEDAPPSQPQFEHQLFNILQRSVETRGLARCRKTIDAATYNLPPMPERQHEMYYTPLTFTQEPSQMSSMYSYPHDFQPGYILADIFGSFPPSTGTPSFTQSGELSTPNAPLGGPWNVPGDILDMDDLLGVDLRHDFSAEADQVDERANHRRRNPDRAARNWDRACGTSSRHHRHSDD

SEQ ID NO: 129052 - protein, 108 aa, Glycine max
  Coding DNA Sequence Number=SeqID_37367
MWVYKWQSKDTVLDNLLYKPFPQNYVIWDLHGEKKASESSQMEDVLQEHVHPQDPMEMMINDAFEHCKQQDTNVGVSQPLGSDEILNEGLRDDHSVFHDLFNGKSQTF

SEQ ID NO: 129053 - protein, 926 aa, Glycine max
  Coding DNA Sequence Number=SeqID_37368
  Gene Ontology: Mol. function=binding
  Homolog annotation: Hit_ID=Q0WQI5; Match level="QueryCoverage=60%, HitCoverage=99%, E-value=1e-115, Identity=41%"; Hit description =Putative uncharacterized protein At1g04390
  Pfam annotation: Domain name=BTB; Domain location=720-856; Score =14.8; E_value=0.00015; Accession=PF00651.22; Description=BTBPOZ domain
MASNVAVKLVSSIPNSLLQLHMLDLVYCLSSLLSSHQVEVATPCAIALNLVISNLSATSEKAVMEALNETETSIRIVRNIKFFAEDAKKIEYFKEMTLLLSAILWRWPPSRFSVGNDVILMKGLANIHTRTESSIKIALLKLYTSLARKLIEDGEGFPQMVVQAMGKSNPHAVQIEGFRLAQCLLRSQENCLEVVGLCGEALVDAIICGMKETGLSSKKIGNNHGSLSVEACQLALITRWAGDHHINFWKQGIDRILLNLLIENIQDQLSEPVLSLEKQISMAKEGLKANYHLGLRSYLWDILGWLTIHCGENLNPYTHGSKLCINLLITCACLSFVDTLEKWCRICQKDIDDHFQSEPVSRAVLMMIHSPCNTISSYARFLLLDALEVKGLSCLKSLIHTLDYTSSLESYGSFDKLQLVINLIGLTCLSSLPEYQSCIIESKGIKAIVLLVKRCLSNDIHVERRNFTPHLHTTFQERSCCCMDKEDWEGSNVLLFYSLLGLSEILRQCDLLQDNSQQYSREVTNIRAQLVSKLHEICSGNSFSPGVRWYVLYILTYFGFYGFPNELAKRIGKSLNKEEYSDMRLVVANGVSVSVHGVILAVRCPSLLPPQLLPSMKNSEKVTDKFVRETMREVQLSSHVDYEALVLLLEYVYLGCLHAGEETVKKLKILAKRCKLQHLLQMLYRQRPKWGTPFPSFNLTPSLGSAGSCFSYDFLVDQLLIKYLEIAWDAILEAKSNKLVGWTCNICSDTVPHMHVHKVILQSGCDYLQGLFRSGMRESHSQVIKVDISWEALIKLVQWFYSDELPNPPSGCLWDNMDDEEKLFNLQPYVELCWLAEFWILENIQEACWDVIMSCLDSSSQLPIKIIKMAYNHSLWKLVDVAANLMAPSYRQLQNSGELEEFDDALVHLIYSASIQLNQEGKNCFR

SEQ ID NO: 129054 - protein, 359 aa, Glycine max
  Coding DNA Sequence Number=SeqID_37369
  Homolog annotation: Hit_ID=A5B4X3; Match level="QueryCoverage=83%, HitCoverage=73%, E-value=5e-58, Identity=47%"; Hit description =Putative uncharacterized protein
MPSLAIEPTFLDFEFPLDPPTTMLPADQLFSDGKLLPLHPLTSTITTSKSPSSSAVNATASAATTATTADPCLFSPKAPRCSSRWKDLLGLKKFYQATNNAKAAPPSSAKSLKNLLHRKTTSPSLSSENAPLLASNSSDAESLSITSSRLSLSSSSSGHDHDDLPRLSLDSEKPNPNPNQISLHRNPNPRIRLVRNRTNSFDAHKPSSDQHYSRPGRSSIRRESETVTCRGVSVDSPRMNSSGKIVFQSLERSSSSPSTFNGGPRFKHRGMERSYSANVRVTPVLNVPVCSLRGSSKSGSVFGFGQLFSSPQITTTGKGHHQSVFWEMMPKIQTEAPALLNYYYLFARQSDPKTFMAYN

SEQ ID NO: 129055 - protein, 481 aa, Glycine max
  Coding DNA Sequence Number=SeqID_37370
  Gene Ontology: Mol. function=translation initiation factor activity; Cellular component=eukaryotic translation initiation factor 2 complex; Biological process=translational initiation
  Homolog annotation: Hit_ID=A7QBK2; Match level="QueryCoverage=99%, HitCoverage=99%, E-value=0.0, Identity=85%"; Hit description =Chromosome chr13 scaffold_74, whole genome shotgun sequence
  Pfam annotation: Domain name=Dynamin_N; Domain location=35-184; Score= -48.4; E_value=0.099; Accession=PF00350.14; Description=Dynamin family
  Pfam annotation: Domain name=GTP_EFTU; Domain location=30-237; Score =186.1; E_value=9.2e-53; Accession=PF00009.18; Description=Elongation factor Tu GTP binding domain
  Pfam annotation: Domain name=GTP_EFTU_D2; Domain location=268-342; Score=11.3; E_value=0.029; Accession=PF03144.16; Description =Elongation factor Tu domain 2
  Pfam annotation: Domain name=MMR_HSR1; Domain location=33-185; Score=- 9.1; E_value=0.0072; Accession=PF01926.14; Description=GTPase of unknown function
  Pfam annotation: Domain name=eIF2_C; Domain location=379-466; Score =188.6; E_value=1.6e-53; Accession=PF09173.2; Description=Initiation factor eIF2 gamma, C terminal
  Pfam module annotation: Pfam domain module=Dynamin_N::GTP_EFTU::GTP _EFTU_D2::MMR_HSR1::eIF2_C; Domain location=35-184::30-237::268 -342::33-185::379-466
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFVSPPNMIVIRSFDVNKPGYEVDEIKGGVAGGSILRVNQFIEVRPGIVVKDESGNIRCTPIYSRIVSLYAEQNELQFAVPGGLIGVGTTMDPTLTRADRLVAMPNYPFMPPAMNEDNDPYKISSFISFACQSGGIGSVVNFFLLRRLLGVRTKGSERQGKVSKLAKGEMLMLNIGSMSTGARVVAVKNDLAKLQLTSPVCTSKGEKIALSRRVEKHWRLIGWGQIQAGITLDVPPAPQLS

SEQ ID NO: 129056 - protein, 290 aa, Glycine max
  Coding DNA Sequence Number=SeqID_37371
  Gene Ontology: Mol. function=transferase activity; Cellular component= endoplasmic reticulum membrane; Biological process=biosynthetic process
  Homolog annotation: Hit_ID=A7NUA1; Match level="QueryCoverage=87%, HitCoverage=66%, E-value=6e-85, Identity=55%"; Hit description =Chromosome chr18 scaffold_1, whole genome shotgun sequence
  Pfam annotation: Domain name=Glycos_transf_1; Domain location=83-230; Score=-0.6; E_value=0.00062; Accession=PF00534.11; Description =Glycosyl transferases group 1
MADASLCVTKAMQHELAQNWGINATVLYDQPPDIFHPASLEERHKLFCRLNEDLFRSLGVRDCVSNGNSLVASCHQNETLFATEVGSNIYLKPNRPALVVSSTSWTPDEDFGILLEAAVMYDRRVAAILGEDDSVDEEFWVISGSADLGVCLHTSSSGLDLPMKVVDMFGCGLPVCAVSYSCIRELVRVDKNGLLFSSSSELADELLLLFKGFPDDCDALKVLKYGALETGSSSRWATEWEEHAKPLITEASSFFYSMHYVIIRSSTLVVVDFLCLSDQFLIYRNRQNLE

SEQ ID NO: 129057 - protein, 149 aa, Glycine max
  Coding DNA Sequence Number=SeqID_37372
  Homolog annotation: Hit_ID=A5C0G0; Match level="QueryCoverage=57%, HitCoverage=13%, E-value=1e-12, Identity=43%"; Hit description =Putative uncharacterized protein
MATPSIENLNINEDDPVLNGGLWSFDKNMSIFGVIEEGKDPTTIPLFYVPFLIQMHNLPVEFMSQKVEESLRNYTIQFLEYDEKNNVNFLCLFMRIKLMLTVEAEDLFFFGVNHSTVTFSPSLPTSSMSRCIIVIIQPRLIGFYRYPDR

SEQ ID NO: 129058 - protein, 137 aa, Glycine max
  Coding DNA Sequence Number=SeqID_37373
MFLILKGRWGNTQFRQSARGAHLRAELEHAAETGVDPRDRYRGAEQELGEEAEETAGRGVEEEERIGADPGGVEPLELTDSAPDQARVYDKEKGRYKATMRERKVKGEWKMKGQQKCTREEKINKREKKHNNSKTGF

SEQ ID NO: 129059 - protein, 160 aa, Glycine max
  Coding DNA Sequence Number=SeqID_37374
  Gene Ontology: Mol. function=oxidoreductase activity; Cellular component=proton-transporting two-sector ATPase complex; Biological process=ethylene biosynthetic process
  Homolog annotation: Hit_ID=Q9XH70; Match level="QueryCoverage=50%, HitCoverage=21%, E-value=5e-27, Identity=66%"; Hit description =Putative uncharacterized protein p69RF
MKGWVTKIPRLFDHPLVVNHGIPVTVLEDFKDGVQRFYEQDTEVKKELYTRDEMRPFVYNNNYDLYSSPTLNWRDTFMCYLAHNPPKHEDLPLVYRCTPRISPTIGIRARFDQVPVQTSMQVPQVARMASGTACPAGEAGWPEWLAGRASTAGGHGYTRG

SEQ ID NO: 129060 - protein, 318 aa, Glycine max
  Coding DNA Sequence Number=SeqID_37375
  Gene Ontology: Mol. function=DNA binding; Cellular component=nucleus; Biological process=regulation of transcription, DNA-dependent
  Homolog annotation: Hit_ID=A7PJT0; Match level="QueryCoverage=91%, HitCoverage=91%, E-value=1e-84, Identity=56%"; Hit description =Chromosome chr12 scaffold_18, whole genome shotgun sequence
  Pfam annotation: Domain name=NAM; Domain location=25-156; Score =248.4; E_value=1.6e-71; Accession=PF02365.6; Description=No apical meristem (NAM) protein
MGVNEDFNQDIDYDHHEYVDDDDVPLPGFRFHPTDEELVSFYLQRKLDKKPISIELIKQIDIYKYDPWDLPKTSATGGEKEGYFFCRRGRKYRNSIRPNRVTGSGFWKATGIDKPVYSHGGEGNDCIGLKKTLVYYRGSAGKGIKTDWMMHEFRLPSNTDNNNTNLRSSKNYVDVPQEAEIWTLCRIFKRNVSQRKHTPDLKQISAKRQSIHDKSSRMSNVEFNTTNQESYINFGGHYHNEQKPTINYTNSDQRNQYHVMTHHQLCAPVAQQHQQPQQLTSPSSNFWINNPPGNDFFTFDNWDELGSLVKFAVDSPSL

SEQ ID NO: 129061 - protein, 165 aa, Glycine max
  Coding DNA Sequence Number=SeqID_37376
  Homolog annotation: Hit_ID=A4PIT0; Match level="QueryCoverage=18%, HitCoverage=3%, E-value=1e-07, Identity=80%"; Hit description =Isoamylase-type starch-debranching enzyme 3
MAYSSIFLVLNQIKALAPSPQPSPPHLVGSIDALDGGMIEMVLDPDLNKTRDIWHICIELFFQYAVKDKIIYPVKVEDDAYVSNVFESSQTKTVFTRCWRKHRLCLRTFKDVAYVSNIFESGSLSTTYDFDPSLNSFIFHDVGYNDGRPPSLYPVFHRLRIAFLQ

SEQ ID NO: 129062 - protein, 73 aa, Glycine max
  Coding DNA Sequence Number=SeqID_37377
  Homolog annotation: Hit_ID=A7PJF3; Match level="QueryCoverage=53%, HitCoverage=10%, E-value=3e-08, Identity=69%"; Hit description =Chromosome chr12 scaffold_18, whole genome shotgun sequence
MEVSITYEIAGTLELNPDRLRELKAFDDSKADVKGLVDGGVTKIPTLFYHPLMQRTKFTPPRDCWQNTEADEK

SEQ ID NO: 129063 - protein, 89 aa, Glycine max
  Coding DNA Sequence Number=SeqID_37378
MVARVGDQKKSLTMGKFVQWQPRKGKGRRYIYAASAEQCSEGVKCNDGEHTDDTVDHCLLCILCVTLASVAKMFAMKKGYDSEEEYTKW

SEQ ID NO: 129064 - protein, 373 aa, Glycine max
  Coding DNA Sequence Number=SeqID_37379
  Gene Ontology: Mol. function=oxidoreductase activity; Biological process=hydrogen peroxide-mediated programmed cell death
  Homolog annotation: Hit_ID=A7PWN2; Match level="QueryCoverage=40%, HitCoverage=53%, E-value=5e-35, Identity=44%"; Hit description =Chromosome chr19 scaffold_35, whole genome shotgun sequence
  Pfam annotation: Domain name=2OG-FeII_Oxy; Domain location=260-358; Score=2.8; E_value=0.075; Accession=PF03171.11; Description=2OG -Fe(II) oxygenase superfamily
MSRNRAKYCSLSFFGGIKGYGMSFTGTEVIPGVGSPTFALREISPLVVYILEVFLDGTLDGSITKDDIVTGYHILNQLYSFISKPWKRSRALLSDSSGNWWNEEISTFPLEVSDSGKYFFKNFSTTFSHVCKLFPLNKCNHLLSSPAKEKKNGLRRMTSSGTPAIFIVLQISIFNFGAGYAFEILGCKGTRVVLQGDPPWPVFCHDVFFKVGIWKKDDIEDDVVLDYLKLSSKVARNIVEVLIGKLGVEPDASNIEGILGLKKVTMNYYPACQNPEFTVGAGRHSNMGTLTVLFQYGIGGLYVKVEPENDDDAGNSTNPWSSPTEKIGPLPELVKKDGLARYTEVVYNDYLNNFFGNALARKKSLDFARFNFA

SEQ ID NO: 129065 - protein, 148 aa, Glycine max
  Coding DNA Sequence Number=SeqID_37380
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=Q9M4Q9; Match level="QueryCoverage=65%, HitCoverage=15%, E-value=5e-44, Identity=90%"; Hit description=Malic enzyme
  Pfam annotation: Domain name=Malic_M; Domain location=1-105; Score= -52.3; E_value=7.8e-08; Accession=PF03949.6; Description=Malic enzyme, NAD binding domain
MEGSGGRITGSAIFASGSPFPPVEYEGKVFVPGQANNAYIFPGFGLGLIMSGTTRVHDDLLWAASEALAAQVSQENFDKGLIYPPFTNIRKISAHIAANVASKAYELGLATRALLSLTLLVASLESLSCATAETRRGTPSQCHPRCFN

SEQ ID NO: 129066 - protein, 56 aa, Glycine max
  Coding DNA Sequence Number=SeqID_37381
MTIKLMRVGPENDVEAVKIVASGAGVHHFDGATCKAEGEEVRVKGKCERRELRMRE

SEQ ID NO: 129067 - protein, 226 aa, Glycine max
  Coding DNA Sequence Number=SeqID_37382
  Gene Ontology: Mol. function=molecular_function; Cellular component =anchored to membrane; Biological process=biological_process
  Homolog annotation: Hit_ID=A9PEG5; Match level="QueryCoverage=83%, HitCoverage=52%, E-value=1e-33, Identity=43%"; Hit description =Putative uncharacterized protein
  Pfam annotation: Domain name=Thaumatin; Domain location=31-219; Score= 67.3; E_value=5.1e-17; Accession=PF00314.8; Description=Thaumatin family
  Subcellular localization annotation: CTP_CleavageSite=64; ConfidenceScore=5.35e-01
MVQPTWLFSLLILTLQLSASGVNSTKFTLVNQCNYTVWPALMGNVNLSTLKGNDNLSTTGFVLRSGESSTVTPPAKWNGRIWGRTLCTNSSGNFSCVTGDCGSGKIACDGKAGSMPVTVLEFSLRHTHYADYYDVSLVDGFNVPFDNCSHKQQQQVTPVVGGPKNDIFVVLVVMRDPTANQACTTRKYSRLHARKPTATQKATKPACSAATILSITTLSFVLHLAT

SEQ ID NO: 129068 - protein, 90 aa, Glycine max
  Coding DNA Sequence Number=SeqID_37383
  Gene Ontology: Mol. function=unfolded protein binding; Cellular component=endoplasmic reticulum; Biological process=protein folding
  Homolog annotation: Hit_ID=A0A762; Match level="QueryCoverage=47%, HitCoverage=10%, E-value=3e-18, Identity=93%"; Hit description =Calreticulin-1
MQTDGKIVELNQIGKKDENLTGEWNHTSGQWNGDANDKGIQTSEDYRFYVISAEYPELGLFVSPDLNQDYLFDVLIWEFKGVIVWLEVQW

SEQ ID NO: 129069 - protein, 117 aa, Glycine max
  Coding DNA Sequence Number=SeqID_37384
MGHPLQASYPRLILVVKLLLLGLFPSGWCLPSPLLLCLPLHLHGVKSPLKDLIEAQRSSLLKIPTSKLPSHHFTKVLSAVLSLMTSSRKRNLMFLMNNFNHKKWTSMSTTDKKQATS

SEQ ID NO: 129070 - protein, 180 aa, Glycine max
  Coding DNA Sequence Number=SeqID_37385
  Gene Ontology: Mol. function=helicase activity; Biological process =protein amino acid phosphorylation
  Homolog annotation: Hit_ID=A2Q378; Match level="QueryCoverage=98%, HitCoverage=13%, E-value=7e-45, Identity=44%"; Hit description =Putative uncharacterized protein
  Pfam annotation: Domain name=DUF889; Domain location=17-180; Score =109.9; E_value=7.9e-30; Accession=PF05970.5; Description=Eukaryotic protein of unknown function (DUF889)
LKDIMHNDISFGGKVIVFGSDFHQILPVVSRGSRSDIVHASINASYIWDHCQILKLTKNTRLQTNAADTNSDDLKQFSNWLLDIGDGKLGEPNDGYGEISIPDEFLIKDFNDPMQAIVETTYPNSLQNYSNVDFFEEKEYCSADSVDKSNELLNPAFGVLTAEFLNSLKISGIPNHKLKI

SEQ ID NO: 129071 - protein, 152 aa, Glycine max
  Coding DNA Sequence Number=SeqID_37386
MESKEGRRGAYHSMAQPNNIKGRGEGYPLIANTKPQVSRIWAYGRVYDPYNSPFHTQTFSEHTHPLTYIKAHLLKPKLTKHTKTYARHHHCCRYKSATLPNPPTPITISGFKINEDNMRDVLTESNFDEEVVEGFMELNAMCFEEDEEGLQR

SEQ ID NO: 129072 - protein, 84 aa, Glycine max
  Coding DNA Sequence Number=SeqID_37387
MGIQGKQQGRVSDRRERELQEIMDSILGVEIKKSKKSKYEGPNEISYLPDVILGSILSFHQKKKQFELVFYSRGGYTSRHSSPS

SEQ ID NO: 129073 - protein, 80 aa, Glycine max
  Coding DNA Sequence Number=SeqID_37388
MALPGGVERDAMLGEESKVGIGRVIDERDGKEARAREVVEGVCVDVNVEEEGNFGKGLFGGEADKFGRVGMRIGGMGNGI

SEQ ID NO: 129074 - protein, 137 aa, Glycine max
  Coding DNA Sequence Number=SeqID_37389
  Gene Ontology: Mol. function=nucleic acid binding
  Homolog annotation: Hit_ID=A7QKV5; Match level="QueryCoverage=96%, HitCoverage=31%, E-value=4e-24, Identity=40%"; Hit description =Chromosome chr8 scaffold_115, whole genome shotgun sequence
  Pfam annotation: Domain name=zf-CCHC; Domain location=90-107; Score =18.1; E_value=0.0028; Accession=PF00098.14; Description=Zinc knuckle
DARVRDNQRILNKLLDIANKIKLLGSDFVDLRIVEKILVTVPKRLMRQDCVVEGALPTKHHEVDESKKDFFKKNQPTSSENSANNQNKDAKCNKCNQIGHEAVICPNKNHHDEGAQIANQEEEDQLFVATCFLSSES

SEQ ID NO: 129075 - protein, 84 aa, Glycine max
  Coding DNA Sequence Number=SeqID_37390
EEAPSKMALPNGVERDAVQGEESKVGIGRVIDERDGKEAVNGRDKGWGGTKGVCVDVNVEEFVRGEVEEFGRVGMGIGGMGNGI

SEQ ID NO: 129076 - protein, 81 aa, Glycine max
  Coding DNA Sequence Number=SeqID_37391
MALSGGVERDAMLGEESKVGIGRVIDERDGKEAVNGRDKGGELDINVGEEEEGYFGKGFFGGEVEKFGKVGMRIGGMGNGI

SEQ ID NO: 129077 - protein, 197 aa, Glycine max
  Coding DNA Sequence Number=SeqID_37392
MELAPFWEPIEEVRNLTTFSLALLPLARWEILEEDQSVGSMFSAPPARPAWRWNSEELNPWKTLQELLPYNQYEEERTPNLEGVFAEFMAYHASSKANQNSMQKQEIHVGKSYSIENYQWEQELQPYNQYEEERGSNLDNLLKQFKETTESTQQAFKSLEIQVGKLAKEVAKFVATSEENFVEVEAHEESLVEEHDS

SEQ ID NO: 129078 - protein, 159 aa, Glycine max
  Coding DNA Sequence Number=SeqID_37393
  Homolog annotation: Hit_ID=A7P7R4; Match level="QueryCoverage=50%, HitCoverage=22%, E-value=3e-22, Identity=66%"; Hit description =Chromosome chr9 scaffold_7, whole genome shotgun sequence
MGIIIQLLLLLLFFFLEKDDEKYLVIVNSRPRVISWEIGEEILKFPNGLGNVEHISISSDAKNLVTSDFKDQHEAAEGVLLDDDLNEPTMGEKLASLSVLDGNKSRSDIEQESSIPTKPPSADSVHVLLKQALNADDRTLLLDCLFTQIEKVLFLSYFY

SEQ ID NO: 129079 - protein, 70 aa, Glycine max
  Coding DNA Sequence Number=SeqID_37394
MKEFYANLYDPEDKSPKQVWVRGHLIKFDANSLNTFLETLVVLEQGESLPYYSRFHSLLNPTPRGMDFQP

SEQ ID NO: 129080 - protein, 145 aa, Glycine max
  Coding DNA Sequence Number=SeqID_37395
MFYMCVCVCVCVCVCVCVCVCVSIHVAQLISNAIYQFARITPPSGPKKVQQSTGVSGLDHGSLPVLWVPTQLNEIFYRYTLHQPSQDPSPYSWPTPEQFGAIVAWPGDRPSFQARAGPAVTPRDEDGTREDNDMADVMDYFLRGG

SEQ ID NO: 129081 - protein, 29 aa, Glycine max
  Coding DNA Sequence Number=SeqID_37396
MDVLFCVTLCKMPNLLPWWYRKRQRRDEN

SEQ ID NO: 129082 - protein, 463 aa, Glycine max
  Coding DNA Sequence Number=SeqID_37397
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=A7QJ39; Match level="QueryCoverage=18%, HitCoverage=28%, E-value=2e-29, Identity=72%"; Hit description =Chromosome chr2 scaffold_105, whole genome shotgun sequence
MVFLHLANSSIHNFSLCLTRYQYDSTLISAWISFIFKRGVHNLHIQYADNVHFPSHSLFSCNSLVQLVLQMKCTISVPIFSFLPNLQNLSISGIRLVSESSNYSEDLILNFPVLKVLEARGCEWLTKQNISIKAPQLERFSIAIWNSLSNESHKSAIKIFAPNLTDFSYEGDLEQHIILLNSASIRSASVVVVIDEDNKERMENLGFKVHNLLAQIREVERLKLLFYKVSVKVNKYTRSSAPTLSPSLLIFERGFVEVATDIGCERFSSEQQGLIIKWKKRGSISLIARCWKPFGHGDDADNATIVGRECKDDLLWYYDIEKFAANYFSMGMVDPKQVPLDHVLFQPNKGMVDPSSNLHYDNMLFTQIDAVYSALDSLAYRKLPVHISETSSPSKGDLDETSVNLENAKNYNGNLIKISLSLPPFRHYLVVPVVHIPTVKYLQRKTDDYYLGKETDSCCHFGI

SEQ ID NO: 129083 - protein, 142 aa, Glycine max
  Coding DNA Sequence Number=SeqID_37398
MARVLRRYNKMRPCKSNRWDFENKNYWSLAKHEWSTKRNSNREEVALSAQRCITPNYNQEEVALSAQGVKNTIFHSPLLQKCHPNPKTSFSPPKTTGFRRKPSLLAVGPPHQEEHFNRSGILRILLKASVEKMLQSSISKFL

SEQ ID NO: 129084 - protein, 90 aa, Glycine max
  Coding DNA Sequence Number=SeqID_37399
  Subcellular localization annotation: CTP_CleavageSite=66; ConfidenceScore=5.22e-01
MVNIMAWNSNKSFWSIGNENKNSNWSFGGPRNKDSNWGKKSNWNYGSSDANQSTIWRRNSSWNIANASSDEGSNENSIGVGGGNSQWLPK

SEQ ID NO: 129085 - protein, 83 aa, Glycine max
  Coding DNA Sequence Number=SeqID_37400
MGWEVKEEGWGREEERGVRRRRVGEERRERGEKFEMGVEGSFPLQVGAKSNYDKGNSSPHMDGCVLVFFVTFCVLNLVNFGKH

SEQ ID NO: 129086 - protein, 413 aa, Glycine max
  Coding DNA Sequence Number=SeqID_37401
  Homolog annotation: Hit_ID=Q9LUC4; Match level="QueryCoverage=95%, HitCoverage=94%, E-value=7e-25, Identity=28%"; Hit description=F -box/LRR-repeat protein At3g14710
  Pfam annotation: Domain name=F-box; Domain location=21-68; Score =21.2; E_value=0.0038; Accession=PF00646.24; Description=F-box domain
  Pfam annotation: Domain name=FBD; Domain location=332-381; Score =56.0; E_value=1.3e-13; Accession=PF08387.1; Description=FBD
  Pfam module annotation: Pfam domain module=F-box::FBD; Domain location=21-68::332-381
MNSIIATKRLPPEQTVVEGEGIISKLHESILGKILSFLPTTDAVHTSVLSKGWIHVWKSITGLQFNDALHPLGKKMQKEHFVCFVKKNLHIQYADEILFPSCSLFSCNSLVQLVLQMKCTISVPIFSSLPNLQNLSISGIRLVSESSNYSEDLILNFPVLKVLEARGCEWLTKQNIGIKAPLLERFSIAIWNSLSNKSHKSAIKIFAPNLADFSYGGDLEQEIILLNSASIHSASVVIVADEDKMTNVGKLGFQVHKLLAQIREVKQLKLLFYKVLMHARDIFTHLPAFSRLSYLQLNEVTGEALLNILNNCPILSSLVLQNGVSESNKDHVLTSASVPQCFLSSLKVFQFKEFNVREHELLLAKFVLANAAVLEQMIICTAFWLRYSEIDVEKVKDQILSFPKCSNLVMIQF

SEQ ID NO: 129087 - protein, 51 aa, Glycine max
  Coding DNA Sequence Number=SeqID_37402
MGLDGASSKEGKMHRVATNVYSRKMSGKPKLEKVEGKVLAPHAPVTRDNNL

SEQ ID NO: 129088 - protein, 28 aa, Glycine max
  Coding DNA Sequence Number=SeqID_37403
MVVESIKCTSFPHVESHFFNVRVLANYN

SEQ ID NO: 129089 - protein, 244 aa, Glycine max
  Coding DNA Sequence Number=SeqID_37404
MWLIFNLCPTPLAILIYHCKEQALWSIHGGFCFCTIGSTFSISFQKTPRPMAIPPSSPPPPPPPPPSPPPFIEAASQSPSSMKQTRKVIRLRSLATRPPGADRSIVHVDPSTGKANGPHKKKLKTYLGIFARDKVDVTYKNRNQVSVAQKDLIWEDIKIVGERWRRFKYDLTSKWALAADKDNVDDTICEKYGISKEKWAQFCQSQRPLMGEQKLMAEKTKKKLEEVSQSISTKAMIDPPSPIR

SEQ ID NO: 129090 - protein, 106 aa, Glycine max
  Coding DNA Sequence Number=SeqID_37405
MTTDVNSPWMWLAPRCLGHSTTFKNFNVIVFDHDRGAFNRTAMDFSRTIIVDNTERTDRDYHSYLVNPNRAIGGGVLESTKNATIANGECLSDYIEVRGELLTLGD

SEQ ID NO: 129091 - protein, 140 aa, Glycine max
  Coding DNA Sequence Number=SeqID_37406
  Homolog annotation: Hit_ID=Q6L477; Match level="QueryCoverage=70%, HitCoverage=15%, E-value=4e-07, Identity=25%"; Hit description =Putative uncharacterized protein OSJNBa0009L15.8
MVFFGHAKPHIYDPCLLDHLVLKDQWSMLILLPARLTVDVTYENWKEIPTAQKDLIWEDIQAEFEILEASDCRTKKKLLQTVSESWRQFKSDLTRKWALAADQDGVDDTVCEKYGISKEKWAQLFQTRRDPSWEDVLKKA

SEQ ID NO: 129092 - protein, 527 aa, Glycine max
  Coding DNA Sequence Number=SeqID_37407
  Gene Ontology: Mol. function=oxidoreductase activity; Biological process=response to red or far red light
  Homolog annotation: Hit_ID=Q4W8C1; Match level="QueryCoverage=23%, HitCoverage=37%, E-value=1e-43, Identity=73%"; Hit description =Gibberellin 2-oxidase
  Pfam annotation: Domain name=2OG-FeII_Oxy; Domain location=126-237; Score=38.9; E_value=1.8e-08; Accession=PF03171.11; Description=2OG -Fe(II) oxygenase superfamily
IDHSLTSSKKAHGGEKMNERKLRGIGLIWDKVRLTRSKGDEGDEGKGIELVPVLRTVDKGHDLASVEAWVVGDVSDLLFRKSMSSSVTAYTEGVRELACEILELMAEGLGVPDTWFFSRLIREVDSDSVLRFNHYPPIILNKDCFKDNHNHTKVIGFGEHSDPQILTILRSNDVAGLQISLQDGVWNPVAPDPLAFCVNVGDLLQPYNLAWFHFPEHNTIVQSGHAKRDGLAYSRFYNTYPDPQELAAKLCIPGQGFLLNAEEAPWKQLRKDLTTLAQTWSVLCYSNLAPTSPTSDLNMDRVRLVYGLVMKVDMDVGSIISSQISQMAQSNSSRLGFPALIIALCIARGVVSDSLTFESLSPIINLAYIRKSYWNPNDPTITFPGSRKARARAPSDASTSAPAPTPTLVPALAPPAPADPSMQSTNAIVPIINIEDFMAQVAWPGVQPSSKGGGEAGAEAEETPKETPIDTPVEELKEGGATDDDPWWRCHYVADVTTVQRTWDPWPTPAQDTPIPPYDDPTPTQEE

SEQ ID NO: 129093 - protein, 58 aa, Glycine max
  Coding DNA Sequence Number=SeqID_37408
MVLKAQKSKFKWEIVKSEKKESHEDSTNGGFDPFSVSLTFGNSIGVVGGKTGGILGNR

SEQ ID NO: 129094 - protein, 262 aa, Glycine max
  Coding DNA Sequence Number=SeqID_37409
MVTKNEEDEAACARKWGCLLLLLCEEKCIGVADKSEKEWSLLNGSVEFEILLRTTILVEFVDGEKYSDVEAATAPSILRTRIVDNNNDYGDVNNNDNGRDTSDGCSDNDHSSGDNDDVMIIVVVMMVMIKVVVAVTLIVMSMVMVVTPRDGGCGDNDGGGIVGVGGNNANDDGDWSCSDSDSKCYGGGGSNVSDDGNANDDGGDDSGVDSHGSDGDNDSDSDIDGGDYDDNNVGGDGDVDDDSGVNDDGDNSRSANGCSGDS

SEQ ID NO: 129095 - protein, 17 aa, Glycine max
  Coding DNA Sequence Number=SeqID_37410
MSNVSLLLFLEILVSLI

SEQ ID NO: 129096 - protein, 129 aa, Glycine max
  Coding DNA Sequence Number=SeqID_37411
MTGESHQQEWQNKGFTNRNSETPLKNRLPQANLPLRKLKEKDGFLGAQDFFLKEGLRQEVGSGSLIGEAYDSKGEKIYCERCTITIVEFTINLTGDKISGVGPLIKMFIGLSTKLGTKPSLNMFITFVT

SEQ ID NO: 129097 - protein, 271 aa, Glycine max
  Coding DNA Sequence Number=SeqID_37412
  Gene Ontology: Mol. function=helicase activity; Cellular component =chromatin; Biological process=viral genome replication
  Homolog annotation: Hit_ID=Q2A9I1; Match level="QueryCoverage=99%, HitCoverage=19%, E-value=3e-56, Identity=41%"; Hit description =Putative uncharacterized protein
MLTTSKGPTSFEDIRTVANVLYPTYREACFAMGFLQDDRKFVEAIKEAKEWGTTNYLRKLFVLMLLTGTITKPEELWNQTWHWLADDIAYHYRKSTANTELHINDEHLKNLTLLEIEKLLHANQKSLKDYPPMLYPDDANSTPSLDNSLILSKLNYNNDETRSEFEHLFSSMTDEQKGIYNRIMEVVNNNESDMFFLYGYGGTGKTYIWRTLATSLRTNNQIVIMVASSSIASLLLPRGRTAHSKFKIPVPIFEDSTCNIHQGSQLADLLN

SEQ ID NO: 129098 - protein, 143 aa, Glycine max
  Coding DNA Sequence Number=SeqID_37413
  Gene Ontology: Mol. function=helicase activity; Biological process =viral genome replication
  Homolog annotation: Hit_ID=Q94LS3; Match level="QueryCoverage=97%, HitCoverage=9%, E-value=1e-21, Identity=41%"; Hit description =Putative helicase
MLDEYNVHAKSFRMTRNKFKDGQVHNVRLKLIVNRENDGRTYNVPIVLEVVALIVGDLDANSKGDIIVETQHGQLQRIHELHSSYLVLQYPFMFPSGEDGYRPDILHSSTPERLSYIRNNQKNFELTIFAAYNTHWMMDARKA

SEQ ID NO: 129099 - protein, 117 aa, Glycine max
  Coding DNA Sequence Number=SeqID_37414
MPLGQSSSQLSGSTQLSSKDAFLSKAEAKSISQINAISEDRECAELIGQSADEVNSLKMAGGDVDLNASPQALDRLLGCVLAFKVKVQSKFSNVIVLKYSNELDLINVVQDMLPDTE

SEQ ID NO: 129100 - protein, 271 aa, Glycine max
  Coding DNA Sequence Number=SeqID_37415
  Homolog annotation: Hit_ID=A6BLN7; Match level="QueryCoverage=49%, HitCoverage=27%, E-value=3e-08, Identity=29%"; Hit description =Putative transposase
  Subcellular localization annotation: CTP_CleavageSite=49; ConfidenceScore=5.44e-01
MASELSTNSTGTSTSSNSSSATSKIQYPINTKPSILQFTAIFHNDREIVCVTVGTITKIMMDNHSWCYLACSRCHKKTDIGVVPFTCGFGKHNDQPVLRYQVEVMVKDKDEDTKFLLWDRECVELIGQSTNEVNSPKMAGGDVDLNASPQALDRLLGCVLAFKVKVQPKFSNVVLKYSNELDLINSVLDMLPDTESCSKIDSPIVESRDPTQVESCDVFCYHLMKTDHDPLLRVPLTPTKRLSADELDDEPRSSEISPVQLSSNKLTRPSN

SEQ ID NO: 129101 - protein, 287 aa, Glycine max
  Coding DNA Sequence Number=SeqID_37416
  Gene Ontology: Mol. function=helicase activity; Biological process =viral genome replication
  Homolog annotation: Hit_ID=A2Q378; Match level="QueryCoverage=89%, HitCoverage=16%, E-value=2e-48, Identity=38%"; Hit description =Putative uncharacterized protein
MLLKDYIFIFQANSVVYEDNDYIDDVLSKPSITDSKFILWMNTNQNSVEGRSLTYAKFVSKFVYNKKKRCWQLRKKGYTIGRLLWVPPITGKLFYLRMMLTVCKGPTSFEDLRTVGNVQYPTYREACFVMGLLQDDKEFIEAIKEAKHWGSAHYIRKLFVLLLLTRTMNKLEQVWDQTWHWMADGIVYNYKKSSTSPALQLNDNSLKNLVLLEIEQLLQANQRSLKGYPSMSYPEDANCPTYLDNSLILTKLNYNNQELISEFKHLFPHMKGILTTEQFRPLKIVIC

SEQ ID NO: 129102 - protein, 114 aa, Glycine max
  Coding DNA Sequence Number=SeqID_37417
MQFLLDLLLACCFLPLGITDRICQKSPPKTMTLPPKILLSLELCLIVIKCLKTEFVESSKTGTRILNFECAVLPPGNNREAMLLEAIIITILLSTLSELANIFQMYVFPVPPYS

SEQ ID NO: 129103 - protein, 37 aa, Glycine max
  Coding DNA Sequence Number=SeqID_37418
MEAWCQLKKWRFRCRCKFNNNSEHSPPSLLKILKNNT

SEQ ID NO: 129104 - protein, 61 aa, Glycine max
  Coding DNA Sequence Number=SeqID_37419
MSASEADSMEESGPGGIATSGDLLYRNLMNGRHTPQPKSKAPARWIVVKCNRQKGTTECGY

SEQ ID NO: 129105 - protein, 56 aa, Glycine max
  Coding DNA Sequence Number=SeqID_37420
MGKRNKAEPERPRNCLPEGFVDVVLAGDGARGGRLGGRRLFINIYIIIFSVQRFIT

SEQ ID NO: 129106 - protein, 401 aa, Glycine max
  Coding DNA Sequence Number=SeqID_37421
  Gene Ontology: Mol. function=oxidoreductase activity; Cellular component=extracellular region; Biological process=hydrogen peroxide catabolic process
  Homolog annotation: Hit_ID=A7QML8; Match level="QueryCoverage=67%, HitCoverage=79%, E-value=3e-99, Identity=67%"; Hit description =Chromosome chr19 scaffold_126, whole genome shotgun sequence
  Pfam annotation: Domain name=peroxidase; Domain location=163-401; Score=333.4; E_value=4.2e-97; Accession=PF00141.14; Description =Peroxidase
MEKHASEAWQQEKKRKACWEGKPEASGSKKRKIRDEIRSKAYPRGEGNQCGNGGACGKKKEKTQNGRRGAATRVSTWWAASNQRCPPVQPRPVTAPATDTASHRSRTRMGVRCESDMGHTGDEPHPCFIGNAPKKSFKPLLPPEALLSIGHYHTTCPDVEGIISQKVAAWVKKDPTLAPAIIRLHFHDCAVGGCDASILLNHPGSERTALESRTLRGFQLIDNIKIELEKRCPRIVSCADILTAAARDATLMAGGPFWEVPFGRKDNKISLAREANMVPHGHENITALIAFFQEKGLDILDLVTLSSSHTIGRSICSSIMDKIYNFNRTGKPDPSLNVYFLKLLRKRCKRVMDLVHLDVITPRTFDTTYYTNLMRKVGLLSTDQSLFSDARTAPFVEAFAT

SEQ ID NO: 129107 - protein, 152 aa, Glycine max
  Coding DNA Sequence Number=SeqID_37422
  Homolog annotation: Hit_ID=A7P2V8; Match level="QueryCoverage=100%, HitCoverage=9%, E-value=6e-29, Identity=47%"; Hit description =Chromosome chr1 scaffold_5, whole genome shotgun sequence
MDDIGVSNDDMTVSFSLRHSSRAEGSLDDPIREMEGMLVDLYGRFEARALCCTCICSHYYVFLVRVSGIGNATFQLPSFLSSHLFEEDEDNDFPSNLSLVDASRTVVDSETSTVTPSDKHHCILEDVDCELEMEDVSGHFKGGKACIIEQSF

SEQ ID NO: 129108 - protein, 203 aa, Glycine max
  Coding DNA Sequence Number=SeqID_37423
  Homolog annotation: Hit_ID=A7P2V8; Match level="QueryCoverage=96%, HitCoverage=15%, E-value=2e-47, Identity=46%"; Hit description =Chromosome chr1 scaffold_5, whole genome shotgun sequence
MESSLPGNQIVQMAGNSFPGGHNSYVVKNDILQQPFACFPPMAGCNSQEPCGYNPPRQLEYGQNDMYLNSQGPQPDLQLQPANPSFAPRHMHPALPQNPSNQYSYPNPTIQQHLPHSSHPFFSFPSLPNGQRQYVANEQWRMSSSEGLWIGYFRPPLERPPINNVGFQHANPSNMPAHPMSGYGVPQMSCRPDIPALNCWRPT

SEQ ID NO: 129109 - protein, 147 aa, Glycine max
  Coding DNA Sequence Number=SeqID_37424
MRAGNSDIYGFLEQQSIQRSGQSQFESESYIKTWMQSSKRDVYLGAYLNGPDNYLKGIINSALKGLDDAPQPKSKAPARWIVVKCNRQKGSTECGYYVMHWMSTINLGTFRNNWEAYFNDPRPLEPERLKALRIQWTQFYLRVRDQA

SEQ ID NO: 129110 - protein, 610 aa, Glycine max
  Coding DNA Sequence Number=SeqID_37425
  Gene Ontology: Mol. function=nucleic acid binding; Cellular component= nucleus; Biological process=RNA splicing
  Homolog annotation: Hit_ID=A7QCC6; Match level="QueryCoverage=52%, HitCoverage=87%, E-value=1e-89, Identity=52%"; Hit description =Chromosome undetermined scaffold_77, whole genome shotgun sequence
  Pfam annotation: Domain name=zf-CCCH; Domain location=215-241; Score =20.1; E_value=0.003; Accession=PF00642.15; Description=Zinc finger C- x8-C-x5-C-x3-H type (and similar)
  Pfam annotation: Domain name=zf-CCCH; Domain location=393-413; Score =0.5; E_value=1.2; Accession=PF00642.15; Description=Zinc finger C-x8- C-x5-C-x3-H type (and similar)
  Pfam module annotation: Pfam domain module=zf-CCCH::zf-CCCH; Domain location=215-241::393-413
MAVDGDNGRRRPSPSPPPFVNQHNRVSHREDRNGGEGFDGRSKSMSREEKRKAMKKMKRKQARKEASERERREEEERLIDPEEQRQMQLLEQQEAERMQRDMILFQEREKEWMDTVIARKQQQQQHQQQREEEDEDDEFDCVEEEGPPEIIWQGNEIIFKKKQLRVRVTDKDKPKPNETNQNDHQEDNRPTSNPLPPDSTLENVAQQIPNFGTEQDKAHCPFHLKTGACCFGIRCSRVHFYPDKSSTFLIKNMYNGPGLACDRDQDEGLEYKDEEVERCFEEFYEDVHTEFLKFGEVVNFKVCKNGSFHWRGNVYVQYKSLDSALLAYNSVNGRYFAGKQRKFSSILKAYVRFKVQSEFFQRMVVLVHRCFTIKCRRLELLDVVHMFFSLFSSGYDLWQTCSHGTACNFIHCFRNPGGDYEWADSDKPPPKFWVKKMITLFGFSDDYETSREQGNLSLSKTDSDRKQQDETKHRTPDKDWNANFKRKSRGRTPDSDSDSDWEWLEKEENRERHHVYTLNSRSHEEDSDVEWDSRGGGDASESDKDLLGRGEMETQHDYYSRKRSRHRRRSGLQDEYKYHENENDKVYGDWSRKDCSQREEHHHKKKTSKH

SEQ ID NO: 129111 - protein, 142 aa, Glycine max
  Coding DNA Sequence Number=SeqID_37426
DSDWCGDKDDRKSTAGLSSSIAGSFNGRTKLEKLQSYEEKLELEFCRSEDQVVDILTKTLKSIKFKELRDKEKNSFRKYLVRLVRVGDKEVVKDNAAGVGVGLRAVVVDKAEDLRHDEDGVHMLCGGACHRGSGGRRRSGGI

SEQ ID NO: 129112 - protein, 55 aa, Glycine max
  Coding DNA Sequence Number=SeqID_37427
MALKGLDDAPQPKSKAPARWIVVNYFNDPRSLEPERLKALRIQWAQYYLRVRDQT

SEQ ID NO: 129113 - protein, 45 aa, Glycine max
  Coding DNA Sequence Number=SeqID_37428
MKGGEHKYGFNNNKREKPQKVFMLFLHHSTSSCHSFPESFKYSSE

SEQ ID NO: 129114 - protein, 172 aa, Glycine max
  Coding DNA Sequence Number=SeqID_37429
  Gene Ontology: Mol. function=amino acid transmembrane transporter activity; Cellular component=integral to membrane; Biological process=amino acid transport
  Homolog annotation: Hit_ID=A7P3E9; Match level="QueryCoverage=50%, HitCoverage=23%, E-value=4e-25, Identity=51%"; Hit description =Chromosome chr1 scaffold_5, whole genome shotgun sequence
MTNANYLQESLHSISNGNLRLGLKFAFTHFNTENEDGIKSKPYIFLLGLLMSQYTLIGYDASAPYVTSIPYILSESNDAGGYAIAEMFYQAFKTRYGNGIGGIICLWLSNWPDSSQHVIQRDFLDQCPIICKTDMVDWGPKPFRTFPRVSNTNSMKERWEQQICTTIPSICL

SEQ ID NO: 129115 - protein, 122 aa, Glycine max
  Coding DNA Sequence Number=SeqID_37430
MGLPPTIATCFLILVLPLVVLCLWKLLNWVWLRPKKLERALRAQGLQGNPYRLLVGDNREKFRILMNASKSQQSTSSLSDDKNVAPHIVTFNHHIVNKFGTYTFLPSLSLWCYMQYLLLRYS

SEQ ID NO: 129116 - protein, 34 aa, Glycine max
  Coding DNA Sequence Number=SeqID_37431
MACCWVNGVMAGWNDHAIADALQDLAQAIENPNR

SEQ ID NO: 129117 - protein, 195 aa, Glycine max
  Coding DNA Sequence Number=SeqID_37432
MGVVKYMTMDELKCLSIPSEMLKFFNHSSFPHKGHPTRKINMQQGQIYILVATFPDPNYGVKTVNFIINSPHLLVFAKEAQNIQWWFQSQKRCKDKLKLTRNKHRIMGSSQCGVSTENNGGPWWPPVVVGDGEEAWDIGNGFGRRKEKENGVFPRLHEIQRLKHSNAYALGKRSVSHTPEDISQIATIRLWKSVL

SEQ ID NO: 129118 - protein, 324 aa, Glycine max
  Coding DNA Sequence Number=SeqID_37433
MVLETPKLGVDEAKEIREDIMGPGPSGESFDRGLLGIKLGNENHLASRARNLHRRRGRERLRENLLLEQGPTSKIEKLTKWNILTTIFPYSTTYISSRKHDASAVRFLHDYASCMGLMLFASCNPLTSCRPPPISTRIIPRPLEIHLAFKVIRSTMTTKVIPGSQGLWRQNSLSLAPARSAKTAGLHLRETMIDPKNPAGKIVGRGEVMDWSCMGAKGGDGGVVAGGGGGGGVVTGGSGTVVNASLKKVVDGGGQGVNGSGEVVLAEEGGLAVVEGSHGGFVRWVVWMVGGMAAMEGSHELKLGNENHLASRARTSIEEEGKRD

SEQ ID NO: 129119 - protein, 178 aa, Glycine max
  Coding DNA Sequence Number=SeqID_37434
  Subcellular localization annotation: CTP_CleavageSite=41; ConfidenceScore=5.42e-01
MAESSKKRKGSSSTAAAAAHRRHGPSESPTTPIHPSLSSPRSSILFSSDDQRLRYLSPFSSRIILDPKYLDVDFFNDETFDYYQVFQNFGLVDFMSLKLPYYPELVKVFYCNLKIQDGIFSSEVHGIPMIIDQSLFFSLTKLPSQGAPFEGTIFDDWKFDYSSHDARRMVCNDQAEMT

SEQ ID NO: 129120 - protein, 47 aa, Glycine max
  Coding DNA Sequence Number=SeqID_37435
MTTVDLWTWNISEDLEIPCIESLSTVGSSDISRRCSGGTSIKSACGL

SEQ ID NO: 129121 - protein, 44 aa, Glycine max
  Coding DNA Sequence Number=SeqID_37436
MEGKMEPDNTDLMNPLSQNWVPVTEVPLLLGLITENGSSGSDEV

SEQ ID NO: 129122 - protein, 97 aa, Glycine max
  Coding DNA Sequence Number=SeqID_37437
MTPVEMAPLTGTSHVACRHCDWRQRTAYRSSYWRVQRLQHLQLQGRSWKALLEVAIWVKKKVVAVEREVAGGCLCVESGADQFVFFHFIKAFLGSIR

SEQ ID NO: 129123 - protein, 483 aa, Glycine max
  Coding DNA Sequence Number=SeqID_37438
  Gene Ontology: Mol. function=kinase activity; Cellular component =Golgi apparatus
  Homolog annotation: Hit_ID=A2Q5C6; Match level="QueryCoverage=80%, HitCoverage=64%, E-value=0.0, Identity=79%"; Hit description=Generic methyltransferase
  Pfam annotation: Domain name=DUF248; Domain location=1-442; Score =747.5; E_value=8.6e-222; Accession=PF03141.7; Description=Putative methyltransferase
  Pfam annotation: Domain name=Methyltransf_11; Domain location=117 -212; Score=27.7; E_value=4.2e-05; Accession=PF08241.3; Description =Methyltransferase domain
  Pfam annotation: Domain name=Methyltransf_12; Domain location=117 -210; Score=7.2; E_value=0.085; Accession=PF08242.3; Description =Methyltransferase domain
  Pfam module annotation: Pfam domain module=DUF248::Methyltransf _11::Methyltransf_12; Domain location=1-442::117-212::117-210
YTPCEDVQRSLKFPRENLIYRERHCPTEEELLRCRVPAPFGYRVPLRWPESRDAAWFANVPHKELTVEKKNQNWVRFEGDRFRFPGGGTMFPRGADAYIDDIGKLIDLKDGSIRTALDTGCGVASWGAYLLSRDILAVSFAPRDTHEAQVQFALERGVPALIGVLASIRLPYPSRSFDMAHCSRCLIPWGQNEGIYLNEVDRVLRPGGYWILSGPPINWENHWNGWKRTRESLKEEQDGIEKVAKSLCWKKLVQKGDLAIWQKPTNHIHCKITRKVYKNRPFCEAKDPDTAWYTKMDICLTPLPEVNDIREVSGGELPKWPQRLKSVPPRISSGSLKGITERGRYRNLLDMNAYLGGFAAALIDDPVWVMNTVPVEAEVNTLGAIYERVKPCPLTLELMTSYMVTQFLASTRTAVEFFMQIASMNSTTLRHATRGCVASATGDSSDVATCNGALAMQAGVAGQTSASLRVAAAFAGAAVKVQH

SEQ ID NO: 129124 - protein, 2787 aa, Glycine max
  Coding DNA Sequence Number=SeqID_37439
  Gene Ontology: Mol. function=nucleotide binding; Cellular component =cytoplasm; Biological process=defense response
  Homolog annotation: Hit_ID=A5BEQ7; Match level="QueryCoverage=99%, HitCoverage=98%, E-value=1e-161, Identity=27%"; Hit description =Putative uncharacterized protein
  Pfam annotation: Domain name=AAA; Domain location=178-421; Score= -0.3; E_value=2e-05; Accession=PF00004.20; Description=ATPase family associated with various cellular activities (AAA)
  Pfam annotation: Domain name=LRR_1; Domain location=1014-1035; Score =7.6; E_value=12; Accession=PF00560.24; Description=Leucine Rich Repeat
  Pfam annotation: Domain name=LRR_1; Domain location=1040-1063; Score =1.3; E_value=1.8e+02; Accession=PF00560.24; Description=Leucine Rich Repeat
  Pfam annotation: Domain name=LRR_1; Domain location=1099-1121; Score =2.3; E_value=1.2e+02; Accession=PF00560.24; Description=Leucine Rich Repeat
  Pfam annotation: Domain name=LRR_1; Domain location=1186-1206; Score =5.9; E_value=25; Accession=PF00560.24; Description=Leucine Rich Repeat
  Pfam annotation: Domain name=LRR_1; Domain location=1242-1265; Score =3.3; E_value=75; Accession=PF00560.24; Description=Leucine Rich Repeat
  Pfam annotation: Domain name=LRR_1; Domain location=1266-1290; Score =0.8; E_value=2.2e+02; Accession=PF00560.24; Description=Leucine Rich Repeat
  Pfam annotation: Domain name=LRR_1; Domain location=1495-1519; Score =2.6; E_value=1e+02; Accession=PF00560.24; Description=Leucine Rich Repeat
  Pfam annotation: Domain name=LRR_1; Domain location=1521-1545; Score =2.6; E_value=1e+02; Accession=PF00560.24; Description=Leucine Rich Repeat
  Pfam annotation: Domain name=LRR_1; Domain location=1581-1603; Score =4.2; E_value=50; Accession=PF00560.24; Description=Leucine Rich Repeat
  Pfam annotation: Domain name=LRR_1; Domain location=1684-1705; Score =5.7; E_value=27; Accession=PF00560.24; Description=Leucine Rich Repeat
  Pfam annotation: Domain name=LRR_1; Domain location=1742-1763; Score =3.6; E_value=66; Accession=PF00560.24; Description=Leucine Rich Repeat
  Pfam annotation: Domain name=LRR_1; Domain location=1766-1790; Score =0.5; E_value=2.5e+02; Accession=PF00560.24; Description=Leucine Rich Repeat
  Pfam annotation: Domain name=LRR_1; Domain location=1937-1961; Score =0.1; E_value=2.9e+02; Accession=PF00560.24; Description=Leucine Rich Repeat
  Pfam annotation: Domain name=LRR_1; Domain location=2021-2044; Score =0.8; E_value=2.2e+02; Accession=PF00560.24; Description=Leucine Rich Repeat
  Pfam annotation: Domain name=LRR_1; Domain location=2107-2129; Score =5.2; E_value=34; Accession=PF00560.24; Description=Leucine Rich Repeat
  Pfam annotation: Domain name=LRR_1; Domain location=2202-2223; Score =1.0; E_value=2e+02; Accession=PF00560.24; Description=Leucine Rich Repeat
  Pfam annotation: Domain name=LRR_1; Domain location=2260-2281; Score =4.0; E_value=57; Accession=PF00560.24; Description=Leucine Rich Repeat
  Pfam annotation: Domain name=LRR_1; Domain location=2284-2308; Score =4.3; E_value=48; Accession=PF00560.24; Description=Leucine Rich Repeat
  Pfam annotation: Domain name=LRR_1; Domain location=2310-2346; Score =0.1; E_value=2.9e+02; Accession=PF00560.24; Description=Leucine Rich Repeat
  Pfam annotation: Domain name=LRR_1; Domain location=2478-2502; Score =5.0; E_value=37; Accession=PF00560.24; Description=Leucine Rich Repeat
  Pfam annotation: Domain name=LRR_1; Domain location=2723-2746; Score =4.4; E_value=47; Accession=PF00560.24; Description=Leucine Rich Repeat
  Pfam annotation: Domain name=LRR_1; Domain location=2747-2771; Score =2.8; E_value=93; Accession=PF00560.24; Description=Leucine Rich Repeat
  Pfam annotation: Domain name=LRR_1; Domain location=527-550; Score =2.7; E_value=96; Accession=PF00560.24; Description=Leucine Rich Repeat
  Pfam annotation: Domain name=LRR_1; Domain location=552-573; Score =8.6; E_value=7.7; Accession=PF00560.24; Description=Leucine Rich Repeat
  Pfam annotation: Domain name=LRR_1; Domain location=575-596; Score =5.2; E_value=33; Accession=PF00560.24; Description=Leucine Rich Repeat
  Pfam annotation: Domain name=LRR_1; Domain location=598-619; Score =14.6; E_value=0.38; Accession=PF00560.24; Description=Leucine Rich Repeat
  Pfam annotation: Domain name=LRR_1; Domain location=621-644; Score =10.5; E_value=3.5; Accession=PF00560.24; Description=Leucine Rich Repeat
  Pfam annotation: Domain name=LRR_1; Domain location=680-702; Score =5.2; E_value=34; Accession=PF00560.24; Description=Leucine Rich Repeat
  Pfam annotation: Domain name=LRR_1; Domain location=781-803; Score =0.8; E_value=2.2e+02; Accession=PF00560.24; Description=Leucine Rich Repeat
  Pfam annotation: Domain name=NB-ARC; Domain location=140-501; Score= -24.4; E_value=1e-08; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_1::LRR_1::LRR _1::LRR_1::NB-ARC; Domain location=178-421::1014-1035::1040 -1063::1099-1121::1186-1206::1242-1265::1266-1290::1495-1519::1521 -1545::1581-1603::1684-1705:...
  Pfam module annotation: Domain location=:1742-1763::1766-1790::1937 -1961::2021-2044::2107-2129::2202-2223::2260-2281::2284-2308::2310 -2346::2478-2502::2723-2746::2747-2771::527-550::552-573::575 -596::598-619::621-644::...
  Pfam module annotation: Domain location=680-702::781-803::140-501
MDPITSVAAQSALEIAKQVVNRQVGYIFHYKDKLKEVEQYIERLNDTRKRVQNEVNSAEKNGEEIEDDVQHWLKKVDEKIKKYECFINDERHAQTRCSIRLIFPNNLWLRYRLGRNATKMIEEIKADGHSNKRFDKVSYRLGPSFDAALSNTGYVSFGSRNEIMKKIMKALEDSTVNIVGVYGAGGVGKTTLVKEVANKAREKKLFNMVVMANVTRIPDIQKIQEQIAEMLGMRLEEESEIVRADRIRKRLKKEKENTLIILDDLWDGLNLNILGIPRSEDDNGSQQDANDLSDFGYNNMEKEVFSADFNMMKKDKLSVDSNTIKKEKLSGDHKGCKILLTSRSKEVICNKMDVQERSTFSVGVLDENEAKTLLKKEAGIHVQSFEFDEKVIEIAKMCDGLPIALVSIGRMGNDALIMNLVKFCIGLGLLQGVHTIREARNKVNILIEELKESTLLGESYSRDRFNMHDIVRDVALSISSKEKHVFFMKNGILDEWPHKDELERYTAICLHFCDINDGLPESIHCPRLEVLHIDNIDDFLKIPDNFFKDMIELRVLILTGVNLSCLPSSIKCLKKLRMLSLERCTLGENLSIIGELKKLRILTLSGSNIESLPLEFGQLDKLQLFDISNCSKLRVIPSNIISRMNSLEEFYMRDSLILWEAEENIQSQNASLSELRHLNQLQNLDIHIQSVSHFPQNLFLDMLDSYKIFIGEFNMLTVGEFKIPDIYEEAKFLALNLKEGIDIHSETWVKMLFKSVEYLLLGQLNDVHDVFYELNVEGFPYLKHLSIVNNFGIQYIINSVERFHPLLAFPKLESMCLYKLDNLEKLCVNNQLEEASFCRLKIIKIKTCDRLENIFPFFMVRLLTLLETIEVCDCDSLKEIVSVERQTHTINDDKIEFPQLRLLTLKSLPAFACLYTNDKIPCSAHSLEVQVQNRNKDIITEVEQGAASSCISLFNEKFGLFDNKRVPQTCYDFSSLYGAKISEPSKLDNYRLQALPNLVHIWKNDSSEILKYNNLQSIRIKGCPNLKHLFPLSVATDLEKLEILDVYNCRAMKEIVAWDNGSNENLITFKFPRLNIVSLKLSFELVSFYRGTHTLEWPSLNKLSIVDCFKLEGLTKDITNSQGKPIVLATEKVIYNLESMEMSLKEAEWLQKYIVSVHRMHKLQRLVLYELKNTEILFWFLHRLPNLKSLTLGSCHLKSIWAPASLISRDKIGVVMQLKELELKSLLSLEEIGFEHDPLLQRIERLVIYRCIKLTNLASSIVSYSYIKHLEVRNCRSMRHLMASSTAKSLVQLTTMKVRLCEMIVEIVAENEEEKCDFKFPLLESLVVSECPQMKKFSKVQITPNLKKVHVVAGEKDKWYWEGDLNATLQKHFTDQVSFEYSKHKRLVDYPQTKGFRHGKPAFPENFFGCLKKLEFDGESIRQIVIPSHVLPYLKTLEELYVHNSDAAQIIFDTVDTEAKTKGIVFRLKKLTLEDLSSLKCVWNKNPPGTLSFRNLQEVVVLNCRSLSTLFPFSLARNLGKLKTLEIQNCDKLVEIVGKEDVTEHGTTEMFEFPCLWQLLLYKLSLLSCFYPGKHHLECPVLKCLDVSYCPKLKLFTSEFGDSPKQAVIEAPISQLQQQPLFSIEKIVPNLENLTLNEEDIMLLSDAHLPQDFLFKLTDLDLSFENDDNKKDTLPFDFLQKVPSLEHLRVESCYGLKEIFPSQKLQVHDRSLPALKQLTLYDLGELESIGLEHPWGKPYSQKLQLLMLWRCPQLEKLVSCAVSFINLKELEVTNCDMMEYLLKYSTAKSLLQLERLSIRECESMKEIVKKEEEDASDEIIFGSLRRIMLDSLPRLVRFYSGNATLHFTCLQVATIAECHNMQTFSEGIIDAPLFEGIKTSTDDADLTPHHDLNTTIETLFHQQVFFEYSKHMILLDYLETTGVRHGKPAFLKNFLGSLKKLEFDGAIKREIVIPSHVLPYLKTLEELNVHSSDAAQVIFDIDDTDANTKGMVLPLKNLTLKDLPNLKCVWNKNPQGLGFPNLQQVFVTKCRSLATLFPLSLAKNLGKLQTLTVLRCDKLVEIVGKEDAMELGRTEIFEFPCLLELCLYKLSLLSCFYPGKHHLECPVLKCLDVSYCPMLKLFTSEFQNSHKEAVIEQPLFMVEKVDPKLKELTLNEENIILLRDAHLPQDFLYKLNILDLSFDDYENKKDTLPFDFLHKVPSVECLRVQRCYGLKEIFPSQKLQVHHGILARLNQLELNKLKELESIGLEHPWVKPYSAKLEILNIRKCSRLEKVVSCAVSFISLKELYLSDCERMEYLFTSSTAKSLVQLKILYIEKCESIKEIVRKEDESDASEEIIFGRLTKLWLESLGRLVRFYSGDDTLQFSCLEEATITECPNMNTFSEGFVNAPMFEGIKTSREDSDLTFHHDLNSTIKKLFHQHIEVSNCQSVKAIFDMKGTKADMKPGSQFSLPLKKLILNQLPNLEHIWNPNPDEILSLQEVCISNCQSLKSLFPTSVANHLAKLDVRSCATLEEIFVENEAALKGETKLFNFHCLTSLTLWELPELKYFYNGKHSLEWPMLTQLDVYHCDKLKLFTTEHHSGEVADIEYPLRTSIDQQAVFSVEKVMPSLEHQAIACKDNMIGQGQFVANAAHLLQNLRVLKLMCYHEDDESNIFSSGLEEISSIENLEVFCSSFNEIFSSQIPSTNCTKVLSKLKKLHLKSLQQLNSIGLEHSWVEPLLKTLETLEVFSCPSIKNLVPSTVSFANLTSLNVEECHGLVYLFTSSTAKSLGQLKHIPYGIAKQYKK

SEQ ID NO: 129125 - protein, 45 aa, Glycine max
  Coding DNA Sequence Number=SeqID_37440
MVVMEQVSKWNLFQELRFPHALLDAIQDKEQLDDTTEVHRQLRCD

SEQ ID NO: 129126 - protein, 2141 aa, Glycine max
  Coding DNA Sequence Number=SeqID_37441
  Gene Ontology: Mol. function=nucleotide binding; Cellular component =cytoplasm; Biological process=defense response
  Homolog annotation: Hit_ID=A7QMT0; Match level="QueryCoverage=91%, HitCoverage=99%, E-value=0.0, Identity=28%"; Hit description =Chromosome undetermined scaffold_127, whole genome shotgun sequence
  Pfam annotation: Domain name=AAA; Domain location=178-425; Score= -7.9; E_value=9.4e-05; Accession=PF00004.20; Description=ATPase family associated with various cellular activities (AAA)
  Pfam annotation: Domain name=LRR_1; Domain location=1028-1050; Score =3.3; E_value=76; Accession=PF00560.24; Description=Leucine Rich Repeat
  Pfam annotation: Domain name=LRR_1; Domain location=1053-1074; Score =0.8; E_value=2.2e+02; Accession=PF00560.24; Description=Leucine Rich Repeat
  Pfam annotation: Domain name=LRR_1; Domain location=1079-1109; Score =0.2; E_value=2.8e+02; Accession=PF00560.24; Description=Leucine Rich Repeat
  Pfam annotation: Domain name=LRR_1; Domain location=1135-1155; Score =1.6; E_value=1.6e+02; Accession=PF00560.24; Description=Leucine Rich Repeat
  Pfam annotation: Domain name=LRR_1; Domain location=1161-1182; Score =6.0; E_value=24; Accession=PF00560.24; Description=Leucine Rich Repeat
  Pfam annotation: Domain name=LRR_1; Domain location=1220-1241; Score =3.3; E_value=76; Accession=PF00560.24; Description=Leucine Rich Repeat
  Pfam annotation: Domain name=LRR_1; Domain location=1246-1269; Score =1.3; E_value=1.8e+02; Accession=PF00560.24; Description=Leucine Rich Repeat
  Pfam annotation: Domain name=LRR_1; Domain location=1305-1327; Score =1.3; E_value=1.8e+02; Accession=PF00560.24; Description=Leucine Rich Repeat
  Pfam annotation: Domain name=LRR_1; Domain location=1368-1390; Score =3.9; E_value=57; Accession=PF00560.24; Description=Leucine Rich Repeat
  Pfam annotation: Domain name=LRR_1; Domain location=1392-1412; Score =5.7; E_value=27; Accession=PF00560.24; Description=Leucine Rich Repeat
  Pfam annotation: Domain name=LRR_1; Domain location=1448-1470; Score =4.9; E_value=37; Accession=PF00560.24; Description=Leucine Rich Repeat
  Pfam annotation: Domain name=LRR_1; Domain location=1472-1496; Score =2.3; E_value=1.1e+02; Accession=PF00560.24; Description=Leucine Rich Repeat
  Pfam annotation: Domain name=LRR_1; Domain location=1729-1753; Score =0.6; E_value=2.3e+02; Accession=PF00560.24; Description=Leucine Rich Repeat
  Pfam annotation: Domain name=LRR_1; Domain location=1815-1837; Score =4.2; E_value=50; Accession=PF00560.24; Description=Leucine Rich Repeat
  Pfam annotation: Domain name=LRR_1; Domain location=1918-1942; Score =4.2; E_value=51; Accession=PF00560.24; Description=Leucine Rich Repeat
  Pfam annotation: Domain name=LRR_1; Domain location=1976-1997; Score =5.8; E_value=26; Accession=PF00560.24; Description=Leucine Rich Repeat
  Pfam annotation: Domain name=LRR_1; Domain location=2000-2021; Score =2.9; E_value=88; Accession=PF00560.24; Description=Leucine Rich Repeat
  Pfam annotation: Domain name=LRR_1; Domain location=593-616; Score =0.0; E_value=3e+02; Accession=PF00560.24; Description=Leucine Rich Repeat
  Pfam annotation: Domain name=LRR_1; Domain location=618-639; Score =8.6; E_value=7.7; Accession=PF00560.24; Description=Leucine Rich Repeat
  Pfam annotation: Domain name=LRR_1; Domain location=641-662; Score =4.4; E_value=48; Accession=PF00560.24; Description=Leucine Rich Repeat
  Pfam annotation: Domain name=LRR_1; Domain location=664-685; Score =14.6; E_value=0.38; Accession=PF00560.24; Description=Leucine Rich Repeat
  Pfam annotation: Domain name=LRR_1; Domain location=687-710; Score =11.8; E_value=2; Accession=PF00560.24; Description=Leucine Rich Repeat
  Pfam annotation: Domain name=LRR_1; Domain location=746-768; Score =4.2; E_value=52; Accession=PF00560.24; Description=Leucine Rich Repeat
  Pfam annotation: Domain name=LRR_1; Domain location=847-869; Score =0.1; E_value=2.9e+02; Accession=PF00560.24; Description=Leucine Rich Repeat
  Pfam annotation: Domain name=LRR_1; Domain location=931-952; Score =0.2; E_value=2.8e+02; Accession=PF00560.24; Description=Leucine Rich Repeat
  Pfam annotation: Domain name=NB-ARC; Domain location=140-501; Score =38.0; E_value=1.1e-12; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::NB-ARC; Domain location=178-425::1028-1050::1053-1074::1079-1109::1135-1155::1161 -1182::1220-1241::1246-1269::1305-1327::1368-1390::1392-1412::1448 -1470::1472-1496::...
  Pfam module annotation: Domain location=1729-1753::1815-1837::1918 -1942::1976-1997::2000-2021::593-616::618-639::641-662::664-685::687 -710::746-768::847-869::931-952::140-501
MDPITSATAQSALQIAEHVVKRQLGYIFNYKDKFKEVEQYIERMDDNRKRVQNKVDDAEKNGEEIEDDVQHWLKQVDEKIKKYECFINDERHAQTRCSIRVIFPNNLWLRYRLGRNATKMVEEIKADGHSNKEFDKVSYRLGPSFDAALLNTGYVSFGSRNETMEKIMKALEDSTVNIVGVYGAGGVGKTTLVKEVADKAREKKLFNMVVMANVTRIPDIERIQGQIAEMLGMRLEEESEIVRADRIRKRLMKEKENTLIILDDLWDGLNLNILGIPRSEDDDGSQQDVNDLSDFGYNKMEKEVFSADFNTMKKDKLAVDFSMTKKGKLSVDSNMIKKEKLSGDHKGCKILLTSRSKEVICNKMDVQERSTFSVGVLDENEAKTLLKKLAGIRAQSSEFDEKVIEIAKMCDGLPMALVSIGRALKNKSSFVWQDVCQQIKRQSFTEGHESMEFTVKLSYDHLKNEQLKHIFLLCARMGNDALIMNLVMLCIGLGLLQGVHTIREARNKVNILIEELKESTLLGESYSRDRFNMHDIVRDVALSISSKEKHVFFMKNGILDEWPHKDELERYTAICLHFCDINDGLPESIHCPRLEVLHIDSKDDFLKIPDDFFKDMIELRVLILTGVNLSCLPSSIKCLKKLRMLSLERCTLGENLSIVGELKKLRILTLSGSNIESLPLEFGQLDKLQLFDLSNCSKLRVIPSNIISKMNSLEEFYLRDSLILWEAEENIQSQNASLSELRHLNQLQNLDVHIQSVSHFPQNLFLDMLDSYKIVIGEFNMLTEGEFKIPDMYDKAKFLALNLKEDIDIHSETWVKMLFKSVEYLLLGELNDVYDVLYELNVEGFPYLKHLSIVNNFCIQYIINSVERFHPLLAFPKLESMCLYKLDNLEKICGNNHLEEASFCRLKVIKIKTCDKLEYIFPFFMVGLLTMLETIEVCDCDSLKEIVSIERQTHTINDDKIEFPKLRVLTLKSLPAFACLYTNDKMPCSAQSLEVQVQNRNKDIITEVEQGATSSCISLFNEKVSIPKLEWLELSSINIQKIWSDQSQHCFQNLLTLNVTDCGDLKYLLSFSMAGSLMNLQSLFVSACEMMEDIFCPEHAENIDVFPKLKKMEIICMEKLNTIWQPHIGLHSFHSLDSLIIGECHKLVTIFPSYMGQRFQSLQSLTITNCQLVENIFDFENIPQTGVRNETNLQNVFLKALPNLVHIWKEDSSEILKYNNLKSISINESPNLKHLFPLSVATDLEKLEILDVYNCRAMKEIVAWGNGSNENAITFKFPQLNTVSLQNSVELVSFYRGTHALEWPSLKKLSILNCFKLEGLTKDITNSQGKPIVSATEKVIYNLESMEISLKEAEWLQKYIVSVHRMHKLQRLVLNGLENTEIPFWFLHRLPNLKSLTLGSCQLKSIWAPASLISRDKIGVVMQLKELELKSLLSLEEIGLEHDPLLQRIERLVISRCMKLTNLASSIASYNYITHLEVRNCRSLRNLMTSSTAKSLVQLTTMKVFLCEMIVEIVAENGEEKVQEIEFRQLKSLELVSLKNLTSFSSSEKCDFKFPLLESLVVSECPQMKKFSKVQSAPNLKKVHVVAGEKDKWYWEGDLNDTLQKHFTHQVSFEYSKHKRLVDYPETKAFRHGKPAFPENFFGCLKKLEFDGESIRQIVIPSHVLPYLKTLEELYVHNSDAVQIIFDMDHSEAKTKGIVSRLKKLTLEDLSNLECVWNKNPRGTLSFPHLQEVVVFKCRTLARLFPLSLARNLGKLKTLEIQICDKLVEIVGKEDVTEHGTTEMFEFPCLWKLILYKLSLLSCFYPGKHHLECPVLKCLDVSYCPKLKLFTSEFGDSPKQAVIEAPISQLQQQPLFSIEKIVPNLEELTLNEEDIMLLSDAHLPQDFLFKLTDLDLSFENDDNKKETLPFDFLQKVPSLDYLRVERCYGLKEIFPSQKFQVHDRSLPGLKQLRLYDLGELESIGLEHPWVKPYSQKLQLLKLWGCPQLEELVSCAVSFINLKELEVTNCNRMEYLLKCSTAKSLLQLESLSISECESMKEIVKKEEEDASDEITFGSLRRIMLDSLPRLVRFYSGNATLHFKCLEEATIAECQNMKTFSEGIIDAPLLEGIKTSTEDTDHLTSNHDLNTTIQTLFHQQGAC

SEQ ID NO: 129127 - protein, 158 aa, Glycine max
  Coding DNA Sequence Number=SeqID_37442
VTAEAAAEVRVVGAVGGEGHPAVMEVAYGEWQPLKAVVGAPYGTRGSLGIEQAQQPLAGTLKINPKGLSWMRKGRSGVQQRRVQHLREKERVREREDKLREELSFAFDIFLMTIALYFERGTRQCVWERRVFGIWCCELGGVTWCKGKWLNIYAAGEP

SEQ ID NO: 129128 - protein, 1030 aa, Glycine max
  Coding DNA Sequence Number=SeqID_37443
  Gene Ontology: Mol. function=nucleotide binding; Biological process =defense response
  Homolog annotation: Hit_ID=A5C6R2; Match level="QueryCoverage=93%, HitCoverage=55%, E-value=2e-55, Identity=28%"; Hit description =Putative uncharacterized protein
  Pfam annotation: Domain name=LRR_1; Domain location=123-146; Score =2.2; E_value=1.2e+02; Accession=PF00560.24; Description=Leucine Rich Repeat
  Pfam annotation: Domain name=LRR_1; Domain location=149-173; Score =0.2; E_value=2.8e+02; Accession=PF00560.24; Description=Leucine Rich Repeat
  Pfam annotation: Domain name=LRR_1; Domain location=209-231; Score =5.8; E_value=26; Accession=PF00560.24; Description=Leucine Rich Repeat
  Pfam annotation: Domain name=LRR_1; Domain location=304-325; Score =0.4; E_value=2.5e+02; Accession=PF00560.24; Description=Leucine Rich Repeat
  Pfam annotation: Domain name=LRR_1; Domain location=362-390; Score =5.8; E_value=26; Accession=PF00560.24; Description=Leucine Rich Repeat
  Pfam annotation: Domain name=LRR_1; Domain location=587-608; Score =5.0; E_value=36; Accession=PF00560.24; Description=Leucine Rich Repeat
  Pfam annotation: Domain name=LRR_1; Domain location=646-670; Score =5.0; E_value=37; Accession=PF00560.24; Description=Leucine Rich Repeat
  Pfam annotation: Domain name=LRR_1; Domain location=892-915; Score =2.4; E_value=1.1e+02; Accession=PF00560.24; Description=Leucine Rich Repeat
  Pfam annotation: Domain name=LRR_1; Domain location=916-940; Score =2.8; E_value=93; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=123-146::149 -173::209-231::304-325::362-390::587-608::646-670::892-915::916-940
MALKVFFEYSKHMILVDYLETTGVRHGKPAFLKNFFGGLKKLEFDGEIKREIVIPSHVLPYLKTLEELNVHSSDAVQVIFDIDDSDANTKGMVLPLKKLTLKGLSNLKCVWNKTLRRILSFPNLQVVFVTKCRSLATLFPLSLAKNLVNLETLTVWRCDKLVEIVGKEDAMELGRTEIFEFPCLSKLYLYKLSLLSCFYPGKHHLECPVLECLDVSYCPKLKLFTSEFHNSHREAVIEQPLFMVEKVDPKLKELTLNEENIILLRDAHLPQDFLCKLNILDLSFDDYENKKDTLPFDFLHKVPRVECLRVQRCYGLKEIFPSQKLQVHHGILARLNELYLFKLKELESIGLEHPWVKPYSAKLETLEIRKCSRLEKVVSCAVSFSSLKELQVSECERMEYLFTSSTAKSLVQLKMLYIEKCESIKEIVRKEDESDASEEMIFGRLTKLRLESLGRLVRFYSGDGTLQFSCLEEATIAECPNMNTFSEGFVNAPMFEGIKTSREDSDLTFHHDLNSTIKKLFHQHVEKSACDIEHLKFDDHHHLEEIWLGAVPIPSKNCFNSLKSLTVVEFESLPNVIPFYLLRFLCNLKEIEVSNCHSVKAIFDMKGAEADMKPASQISLPLKKLILNQLPNLEHIWNPNPDEILSLQEVCISNCQSLKSLFPTSVANHLAKLDVRSCATLEEIFLENEAALKGETKPFNFHCLTSLTLWELPELKYFYNGKHSLEWPMLTQLDVYHCDKLKLFTTEHHSGEVADIEYPLRASIDQQAVFSVEKVMPSLEHQATTCEDNMIGQGQFVANAAHLLQNLKVLKLMCYHEDDESNIFSSGLLEEISSIENLEVFCSSFNEIFSSQIPSTNYTKVLSKLKKLHLKSLQQLNSIGLEHSWVEPLLKTLETLEVFSCPNMKNLVPSTVSFSNLTSLNVEECHGLVYLFTSSTAKSLGQLKHMSIRDCQAIQEIVSREGDHESNDEEITFEQLRVLSLESLPSIVGIYSGKYKLKFPSLDQVTLMECPQMKYSYVPDLHQFKLLEQI

SEQ ID NO: 129129 - protein, 173 aa, Glycine max
  Coding DNA Sequence Number=SeqID_37444
  Gene Ontology: Mol. function=binding
  Homolog annotation: Hit_ID=A2Q5C9; Match level="QueryCoverage=100%, HitCoverage=36%, E-value=7e-55, Identity=60%"; Hit description =Armadillo
  Pfam annotation: Domain name=Arm; Domain location=43-83; Score=36.6; E_value=8.8e-08; Accession=PF00514.14; Description=Armadillobeta -catenin-like repeat
  Pfam annotation: Domain name=Arm; Domain location=84-126; Score=16.6; E_value=0.086; Accession=PF00514.14; Description=Armadillobeta -catenin-like repeat
  Pfam annotation: Domain name=HEAT; Domain location=53-85; Score=15.8; E_value=0.12; Accession=PF02985.13; Description=HEAT repeat
  Pfam annotation: Domain name=HEAT; Domain location=91-128; Score=1.9; E_value=14; Accession=PF02985.13; Description=HEAT repeat
  Pfam module annotation: Pfam domain module=Arm::Arm::HEAT::HEAT; Domain location=43-83::84-126::53-85::91-128
VISEGGVRSLLAYLDGPLPQESASGSLGAQQAAAAAICCACSSTDMKKMVGEAGCIPLLVKMLEAKSNSVREVAAQAIASLMVVSQNRREVKKDDKSVPNLVQLLDPSPQNTAKKYAVTCLGSLSSCKKCKKLMISYGAIGYLKKLTEMDIPGAKKLHERLERGKFRSLFSKK

SEQ ID NO: 129130 - protein, 195 aa, Glycine max
  Coding DNA Sequence Number=SeqID_37445
  Gene Ontology: Mol. function=metal ion binding; Cellular component =integral to membrane; Biological process=ubiquitin cycle
  Homolog annotation: Hit_ID=A2Q3Q2; Match level="QueryCoverage=100%, HitCoverage=100%, E-value=2e-88, Identity=83%"; Hit description=Zinc finger, RING-type
  Pfam annotation: Domain name=zf-C3HC4; Domain location=98-133; Score =18.1; E_value=0.00078; Accession=PF00097.16; Description=Zinc finger, C3HC4 type (RING finger)
MLGSGTNLVTTVIGFGMSATFIVFVCTRIICGRLRGGVESRMMYEIESRIDMEQPEHHVNDPESDPVLLDAIPTLKFNQEAFSSLEHTQLSFSLSIVDYREREVLRIMPKCGHTFHLSCIDIWLRKQSTCPVCRLPLKNSSETKHVRPVTFTMSQSLDESHTSDRNDDIERYVEPTPTAASNSLQPTSGEQEARQ

SEQ ID NO: 129131 - protein, 161 aa, Glycine max
  Coding DNA Sequence Number=SeqID_37446
MAIENESCSVFTPFETRSLQGNDSCSVPKVVDMQHSFELYKAMFFGFGVCVHFGVLHGLEHYETPCCASSGFEEEPEFSQGLRDFEGVNMENGSLIVVLLSCFKDSNREVLMCQLKIHSPSADEDLTLKLRKHRVNDPESKPILLDAIPTLKFNQEAFSSI

SEQ ID NO: 129132 - protein, 665 aa, Glycine max
  Coding DNA Sequence Number=SeqID_37447
  Gene Ontology: Mol. function=endonuclease activity; Cellular component=nucleus; Biological process=response to DNA damage stimulus
  Homolog annotation: Hit_ID=A2Q3P8; Match level="QueryCoverage=77%, HitCoverage=99%, E-value=1e-116, Identity=73%"; Hit description =Helix-hairpin-helix motif, class 2
  Pfam annotation: Domain name=XPG_I; Domain location=129-219; Score =63.1; E_value=9.7e-16; Accession=PF00867.9; Description=XPG I-region
  Pfam annotation: Domain name=XPG_N; Domain location=1-97; Score=34.1; E_value=5.1e-07; Accession=PF00752.8; Description=XPG N-terminal domain
  Pfam module annotation: Pfam domain module=XPG_I::XPG_N; Domain location=129-219::1-97
MGVGGNFWDLLKPYARKEGFDFLRNKRVAVDLSFWIVQHENAIKATHVRNPHLRLTFFRTINLFSKFGALPVFIVDGTPSPLKSRARIVRYFRSSGIELASLPVPEEGVSAERNHMFSSHVQKCVELVELLGMPVLKAKGEAESLCAQLNSEGHVDACITADSDAFLFGANCIIKCFCPNFKEPFECYNMSDIEAGLGLKRKHLIAISLLVGNDHDIKGVRGIGLDTALRFVKAFSEEDILNRLMKVARENQRILNVIASPVIWYDLTIRKYFRKPSSDGPHIVWGKPNIEMLIDFLNFHQHWEPAYVRRMMFPMMSTIFLRDMTTTTEETMLFGQYQFDSIERVKMRYGYQFFVVKWKHAGVNISCKVPLKESSVQQDAIIELDETVDLLDDCDVPEIHEDSGCRFLLTDENMDLVGAAFPAEVKRFWQDQELKRRKNSTSRSQENEKSPSPNSRSIQLNITEFYPSTKVKHRQSKQGGGESSKIADSQGNEGSKMKRKMSSPDKIPKSVRRRLFGSNEQPNMSPSSLCSLQTFPPISHALLNRHHKPAHDSTAGVRRRTPYVVCAEKGSRASTRSADDYHATLKALNSKGRFPRKSLGQHYMLNADINDQLAGAAGVEQGDVVLEIGPGTGSLTNVLLNSGAFVLAVEKFVNNEPVSCTCLHM

SEQ ID NO: 129133 - protein, 519 aa, Glycine max
  Coding DNA Sequence Number=SeqID_37448
  Gene Ontology: Cellular component=nucleus
  Homolog annotation: Hit_ID=A7PZ55; Match level="QueryCoverage=95%, HitCoverage=88%, E-value=0.0, Identity=63%"; Hit description =Chromosome chr4 scaffold_39, whole genome shotgun sequence
  Pfam annotation: Domain name=SET; Domain location=22-317; Score=81.2; E_value=3.3e-21; Accession=PF00856.19; Description=SET domain
MASPEEAKLETFMQWLQANGVELRGCKIKWCGSKRGFGIFSDKDVCDGNINMDRVVGVGVIAWVMLVVPLDLAITPMRVLQDPLLGPACRAMFEEGDVDDRLLMMLLLTVERLRKNSLWKPYLDMLPTTFGNPLWFSDDELQELRGTTLYRATELQKKSLLSLYESKVKDIVKKLLTLDGNSEIEVCFEDFLWYVVYLCRALNIPMPHSYVFPEMQDAQDICDPEADEKRSQIEQSDNLTKEGTCNPMTGDTVWVEGLVPGIDFCNHDLKPIATWEVDGTGLASGVPFSMYLISAAQSPLQIDQEIYISYGNKGNEELLYLYGFVIDDNTDDYLMVHYPAEAINTISFSESKNQLLEVQKAELRCLLPKTSLDNGFFPLNTQNGEENNKSKADQVCNYSWSGQRKMPSYVNKLVFPEKFMTTLRTIAMQEDELFKVSSMLEELAGPERERQLSDTDVQSAVWEVCGDSGALQLLVDLLRVKMMDLEESSGTEENDLDLLKKALIIDSHEDSKQCLSNLR

SEQ ID NO: 129134 - protein, 89 aa, Glycine max
  Coding DNA Sequence Number=SeqID_37449
MVLVRKKGYSSYLTLQLGFKILPPSFIHGFEHQTREVCLFLRCVYNALSTQLKWDITLAHEKSIDNVKGVCSRHCGVVEYIVGDDVGRL

SEQ ID NO: 129135 - protein, 471 aa, Glycine max
  Coding DNA Sequence Number=SeqID_37450
  Gene Ontology: Mol. function=transporter activity; Cellular component= Golgi apparatus; Biological process=transport
  Homolog annotation: Hit_ID=Q2HVI9; Match level="QueryCoverage=98%, HitCoverage=64%, E-value=0.0, Identity=72%"; Hit description=Beta -lactamase, class A; SPX, N-terminal; Major facilitator superfamily MFS_1
  Pfam annotation: Domain name=SPX; Domain location=1-90; Score=-22.0; E_value=0.00015; Accession=PF03105.10; Description=SPX domain
IEKIVLFLLEQQGVLAHRLSNIGQDHHTLFQQSNSINISELQEAYRDVGRDLLRLLNFVEMNAIGLRKILKKFDKRFGYKFTDYYVKTRANHPYSQLRQGIGAVVGVLSHGLADLQDLQQSLGSYISIYDQPSYTHQDPILDSIKEAVARLSNSTNFLQFLGRHAFIMKEELPFPSEDHIVDERYHFMSLLLNLANTFLYMVNTYIIVPTADNYTLSLGAAASVCGVVIGMMAVAQVFSSVYFSAWSNRSYLRPLIFSSIVLVVGNTLYALAFDMNSIVVLLMGRLFCGKIPSFLTDYLKCETMLGSARAVNRRYISDCVPLKLRMQASAGFVSASALGMACGPALACLLQTNFRIYRFTMNQDTLPGWIMALAWLVYLLWLWICFKEPAHENQGNLVLYHADTEPVVQVAVGNERTQPLLMNSEEKELDEDGEEENDNTEETKKPVTSIVVAYKLLTPSVKEGKGKEKRH

SEQ ID NO: 129136 - protein, 321 aa, Glycine max
  Coding DNA Sequence Number=SeqID_37451
  Gene Ontology: Mol. function=transferase activity, transferring glycosyl groups; Cellular component=chloroplast; Biological process =biosynthetic process
  Homolog annotation: Hit_ID=Q6DW75; Match level="QueryCoverage=100%, HitCoverage=64%, E-value=1e-154, Identity=85%"; Hit description =Digalactosyldiacylglycerol synthase 2, chloroplast
MDKKEHIAIFTTASLPWLTGTAVNPLFRAAYLAKSGERDVTLVIPWLSLKDQRLVYPNNITFASPSEHEKYICQWLEERVGFTSGFSIQFYPGKLFGHRYEHLSAFTLKNPLISVLCKPYCYFSRDKRSILAVGDISEIIPDKVADIAVLEEPEHLTWYHHGKRWKTKFRLVIGIIHTNYLEYVKREKNGVMQAFLLKYLNNWVVIRLSAATQDYTGSIICNVHGVNPKFLEIGKKKREQQQKGEHAFTKGAYFIGKMIWSKGYKELLQLLKDHEKELSALEVDLFGSGEDSDEVQKAAEKLELAVRVHPARDHADALFHE

SEQ ID NO: 129137 - protein, 45 aa, Glycine max
  Coding DNA Sequence Number=SeqID_37452
MAASNVDASTSAMRAVPIRTEDVAVRNSPSEFLRTALIPYRMDPT

SEQ ID NO: 129138 - protein, 531 aa, Glycine max
  Coding DNA Sequence Number=SeqID_37453
  Gene Ontology: Mol. function=binding; Cellular component=nucleus; Biological process=activation of protein kinase C
  Homolog annotation: Hit_ID=A7R1T0; Match level="QueryCoverage=100%, HitCoverage=88%, E-value=1e-163, Identity=54%"; Hit description =Chromosome undetermined scaffold_376, whole genome shotgun sequence
  Pfam annotation: Domain name=PPR; Domain location=130-164; Score =33.2; E_value=9.4e-07; Accession=PF01535.11; Description=PPR repeat
  Pfam annotation: Domain name=PPR; Domain location=165-199; Score=4.2; E_value=2.4; Accession=PF01535.11; Description=PPR repeat
  Pfam annotation: Domain name=PPR; Domain location=200-234; Score =14.5; E_value=0.15; Accession=PF01535.11; Description=PPR repeat
  Pfam annotation: Domain name=PPR; Domain location=262-296; Score =44.7; E_value=3.3e-10; Accession=PF01535.11; Description=PPR repeat
  Pfam annotation: Domain name=PPR; Domain location=297-331; Score=5.9; E_value=1.6; Accession=PF01535.11; Description=PPR repeat
  Pfam annotation: Domain name=PPR; Domain location=332-366; Score =32.6; E_value=1.4e-06; Accession=PF01535.11; Description=PPR repeat
  Pfam annotation: Domain name=PPR; Domain location=379-413; Score=2.8; E_value=3.6; Accession=PF01535.11; Description=PPR repeat
  Pfam annotation: Domain name=PPR; Domain location=415-449; Score=3.2; E_value=3.3; Accession=PF01535.11; Description=PPR repeat
  Pfam annotation: Domain name=PPR; Domain location=43-77; Score=17.1; E_value=0.066; Accession=PF01535.11; Description=PPR repeat
  Pfam module annotation: Pfam domain module=PPR::PPR::PPR::PPR::PPR::PP R::PPR::PPR::PPR; Domain location=130-164::165-199::200-234::262 -296::297-331::332-366::379-413::415-449::43-77
MVNPNLRTDPSTIYNLLKSYALSPSTILKAHHLFQQIHRPTLPFWNLMIQGWSLSDQPTEAIRMYNLMYRQGLLGNNLTYPFSSRPVLESLMLLASLLFVSNSLIHMYGSCGHLDLAQKVFVEMPETDLVSWNSLICGYCQCKRSRDVLGVFDAMRVAGVKDDVVTMVKVVLACTSLGEWGVADAMVDYIEENNVEIDVYLGNTLIDMYGRRGLVHMARGVFDRMQWRNLVSWNAMIMGYGKAANLVAAREFFDAMPHRDVISWTNLITGYSQAGQFTEAVRLFKVMMEAKVKPDEITVASVLSACAHIDSLDVGEAVHDYIRKYDVKADIYVGNALIDIYCKCGVVEKALEVFKEMRKKDSVMDFDHFRPCSVQPSHGAFVGILLACAHAGLVDKGLEYYESMEKVYGLKPEMKHYGCVADLLSRSGNLQRAFEFIKEMPVTPDVVVWRILLSASQVHGNISLAEIATKKLLELDSSNSGKYVLSSNTYAGSNRREDAIKMRELMEQSNVQKPSAMDRINQGSENFEPDP

SEQ ID NO: 129139 - protein, 90 aa, Glycine max
  Coding DNA Sequence Number=SeqID_37454
  Homolog annotation: Hit_ID=A9PBJ6; Match level="QueryCoverage=55%, HitCoverage=54%, E-value=6e-18, Identity=84%"; Hit description =Putative uncharacterized protein
MGGGGGDHGHGHGHGDFRNKVWSMSGGPYCRPKHWKRNTAIAMVGVVLICIPIAMKSAELEHYRKHIAPCFCVVRICGEIAAEYEQNCGG

SEQ ID NO: 129140 - protein, 70 aa, Glycine max
  Coding DNA Sequence Number=SeqID_37455
MGKFGSMGIVKRKRGQSLSTRPACNLVCISPTEIVVLPKSLASISSKISTSIFNFGESISCAHIIIYKRI

SEQ ID NO: 129141 - protein, 1220 aa, Glycine max
  Coding DNA Sequence Number=SeqID_37456
  Gene Ontology: Mol. function=transferase activity; Cellular component= endoplasmic reticulum; Biological process=RNA processing
  Homolog annotation: Hit_ID=Q2HRE0; Match level="QueryCoverage=83%, HitCoverage=93%, E-value=0.0, Identity=68%"; Hit description=C2
  Pfam annotation: Domain name=C2; Domain location=276-356; Score=98.5; E_value=2.1e-26; Accession=PF00168.21; Description=C2 domain
  Pfam annotation: Domain name=C2; Domain location=441-521; Score=67.9; E_value=3.4e-17; Accession=PF00168.21; Description=C2 domain
  Pfam annotation: Domain name=C2; Domain location=6-91; Score=86.7; E _value=7.3e-23; Accession=PF00168.21; Description=C2 domain
  Pfam annotation: Domain name=C2; Domain location=609-699; Score=59.8; E_value=9.5e-15; Accession=PF00168.21; Description=C2 domain
  Pfam annotation: Domain name=PRT_C; Domain location=862-1017; Score =361.2; E_value=1.7e-105; Accession=PF08372.1; Description=Plant phosphoribosyltransferase C-ter
  Pfam annotation: Domain name=RNase_PH; Domain location=1059-1186; Score=-11.4; E_value=0.0092; Accession=PF01138.12; Description=3' exoribonuclease family, domain 1
  Pfam module annotation: Pfam domain module=C2::C2::C2::C2::PRT _C::RNase_PH; Domain location=276-356::441-521::6-91::609-699::862 -1017::1059-1186
MNNLKLGVEVASAHDLVPKDGQGSSSTYVELHFDGQRFRTTTKNKDLSPFWNESFYFTITDPSKLPSLTLEACIYHYNKDNGSNVLLGKVRLTGTSFVSYSDAVLLHYPLEKKNIFSRSKGEIGLKVFVTDDPSVRASNLLPAVESFFNTDQNENLTEYQSPPPVSFTNSIQNNMSRKKTEPRHTFHNIAKSSNEQKQQSKPAADAKPSVTFGIHEMKSSQAPPKVVQAFAGPQEFSVKETSPTLGGGKVVGGRVIRGSLPATSSSYDLVEPMQYIFVRVVKARDLPSMDMTGSLDPYVEVKVGNFKGITNHFEKNQNPEWNKVFAFAKDNQQSFILDVTVKDKDRISDDVVGTVRFYDLHDIPKRIPPDSPLAPQWYWIENKNGEKRGELMLAVWRGTQADEAFQDAWHSDAVVSPDGSTISNYAQIRSKVYMSPRLWYVRVKVLEAQDLVSSDKSKVPDVYVKVHIGNQITKTKPLRAMNPQWNHEALFVAAEPFEEPLVFTVEERVGGNKDETIGNVVIPLSRIEKRADDRPIRDNWYLLEKYMSSAMEEQAKKQEKEKEKDKFFSRIRVIAFLDGGYHVLDESTYYSSDLRPTSRQLWKKPIGVLELGILNADVLPVPTKNRDGRGTADTYCVAKYGHKWVRTRTIANNLNPMFHEQYTWEVYDIATVLTLGVFDNAQITNSSNGNKDSKIGKVRIRISTLEAGRVYTHSYPLLSVQNSGLKKNGDVHLAIRFSYTSMFDTMALYFKPHLPKMHYTKPLNIMDQERLRLQAVLIVASRLGRAEPPLRKEVVEYMSDSESHLWSMRRSKANFNRLKEVFSGLFAFGIWFGQIAKWKNTFVTVLLHILYLMFMCFPELILPTVFLYVFVIGMWKWRFRPRYPPHMDASLSCAHVTSPEDFDEEMDTFPTTKSMDIVRWRYDRLRSLAGKVQSVVGQIATQGERLHALINWRDPRATSIFMVFCLVTAIVLYVTPPKMLFILSGFYLMRHPKFRGKTPGAPVNFFRRLPSLTDSMLGAYTLALIKTGRKLEYYTYAFTAFRIGFPMETDRPDGRTPNQLRPLVCSCSILHRSHGSASWAQGETKVLAAVYGPKAGTKKSENPEKASIEVIWKPKTGQIACAALVDAGIPLKHLAVAICCSVTDSGCIILDPTKDEEEGSLQAGSEPMAHGIMTSITQGAMSVDDYLHCLERGRAASARLSEFVRKNIELKSTSEASKAG

SEQ ID NO: 129142 - protein, 50 aa, Glycine max
  Coding DNA Sequence Number=SeqID_37457
MIKRFEPKRKNCPPTISSQAIPKSAWMLGRRISGYEAQKKEQYSWALEGL

SEQ ID NO: 129143 - protein, 80 aa, Glycine max
  Coding DNA Sequence Number=SeqID_37458
MTFWIRSGHEEDKVCTPRLWYLPEHSLRLWCLLEHWFDDNNGDSMRKEGKMECFNVRGSMMTLSTLIYLTAVKSGVRWTT

SEQ ID NO: 129144 - protein, 100 aa, Glycine max
  Coding DNA Sequence Number=SeqID_37459
  Subcellular localization annotation: CTP_CleavageSite=40; ConfidenceScore=5.08e-01
MELKKVALVKVALLLFLLGFSATTADATRFDPRSFITQMRARQAATHVAKIAFAIRNFLGRNLRCNNILMSLEDSLRLPHRDDHSGNVLVDIIEDKKLCG

SEQ ID NO: 129145 - protein, 132 aa, Glycine max
  Coding DNA Sequence Number=SeqID_37460
MVKFKLPLSKVFVATTIIWYTTTALLVGDKKRINTHSNDSMETLLVKKDIILFLEDIKINVSVRGKASTNSSHAFYSQFCRYMFMNAIESFHSVTLLSANDATDADPLPLTEDTPSSVCSVVHQNIFSGNHE

SEQ ID NO: 129146 - protein, 45 aa, Glycine max
  Coding DNA Sequence Number=SeqID_37461
MLTCTDPRLFNAEFLCGQPLKTEKKWQKEEREEEEEEYVRVGTVY

SEQ ID NO: 129147 - protein, 66 aa, Glycine max
  Coding DNA Sequence Number=SeqID_37462
MVKGDGVSFLYQGMKSCCAKDLRVLLAVIFSLLDDVAGGESGGYIIVSLEMLEGLRKWILSFIKVK

SEQ ID NO: 129148 - protein, 90 aa, Glycine max
  Coding DNA Sequence Number=SeqID_37463
MTLTTGSPHPINELQVAPNNYDATLRPDSVFRFELMGTVIYVDTTIGVKLVTPLAMTGTTMPPLTTAGQGLTRRDKEAHTVIRTSGTRLT

SEQ ID NO: 129149 - protein, 123 aa, Glycine max
  Coding DNA Sequence Number=SeqID_37464
  Homolog annotation: Hit_ID=A5ALI2; Match level="QueryCoverage=73%, HitCoverage=14%, E-value=2e-12, Identity=39%"; Hit description =Putative uncharacterized protein
MNSHSDVQDLGAHLGHVHLDVERLQILIVEKSLERLSLVEEQEKEDGFVFLVEKEPKKKVDVSLCLVRRFLTEKPIHFNVMKERMAVIWRLRRDILIKEMERDLYQFQFYYMVDFNCILQSSP

SEQ ID NO: 129150 - protein, 150 aa, Glycine max
  Coding DNA Sequence Number=SeqID_37465
  Homolog annotation: Hit_ID=A5B7B1; Match level="QueryCoverage=53%, HitCoverage=7%, E-value=7e-11, Identity=42%"; Hit description =Putative uncharacterized protein
MYGYKFDGMPNQESCILRSRNVTFNENLFYKAVKFSAESTCAGVEVESEPEPSTPPRKSSRISVPPDRRNRKRYRHRGSIGLKAEDLTSSEHGIRIDSQTFYQLRTPEQKGVVERMNRTLNEKARCMRIQSGLPKAFWAEAINTSSISHQ

SEQ ID NO: 129151 - protein, 227 aa, Glycine max
  Coding DNA Sequence Number=SeqID_37466
  Homolog annotation: Hit_ID=Q6WAY6; Match level="QueryCoverage=98%, HitCoverage=51%, E-value=9e-19, Identity=27%"; Hit description =Putative uncharacterized protein
MVSIWDLARVEVSMEPIASLTQYYDQPLRCFIFGDFQLSPMVEEFEEILGCPLGGRKPYLFSGFYPSLARISKKGPNLGAGIRPPKASRKWGGRNTKKIFGVLFPNVDGLVDLAAIDVFLAYHKPQGKVRSLCGAGFTPFSPRKVGPSIRYKEGRIKILSSCEGCPNVPLMGTRGCINYNPVLAIRQLGYPMRGAPLDESITPFIARGFRDHNARVLQGVRKAWNAA

SEQ ID NO: 129152 - protein, 153 aa, Glycine max
  Coding DNA Sequence Number=SeqID_37467
MKADSPHKKKLRTYLGIVARDKVDVTYENWKQVLAAYKDLIWGDIQTTEERWRQFKFDLTSKWALAADKDSVDDTVCEKYNISKEKWTQFCQSRRDHSWEAIQKQNIAPHLLSRGGYEFLENKLMEEKKKKQLEEAAKSGSTDIVIDPSSPIR

SEQ ID NO: 129153 - protein, 258 aa, Glycine max
  Coding DNA Sequence Number=SeqID_37468
YIMKAIITVLYFNGRVYEDNDGVIFEGRKYVALQICDDEDVETMIESFQQQQQMSVLELYVEEDVAGGSMFHAANSVTSCGRNVSHHESELPRNISNLHDDEDDDDDDYLASNSYVEESFDEDDSDDGISDTDDEVTNIVEPVSIVHPTEGVPQIQNPFWNDAMHYNNINWSHPDEEDICGLDMPTTFNVGQELYVGMDFDSKDAVKNALKQYVMKVHQTFKVVETKSHKYIVCCPNNTEESPCPFYMRAILSKKTDA

SEQ ID NO: 129154 - protein, 341 aa, Glycine max
  Coding DNA Sequence Number=SeqID_37469
  Gene Ontology: Mol. function=motor activity; Cellular component=cell projection
  Homolog annotation: Hit_ID=UPI00016621D1; Match level="QueryCoverage =68%, HitCoverage=40%, E-value=2e-19, Identity=34%"; Hit description =UPI00016621D1 related cluster
GLHVLAFRGQCVLAFAFVGLHVLTFKGLHILAFRGLHVLTFRGLHVLASRGLHVLASRGLHVLAFRGLHVLAFRGLHVLTFRGLHVFTFRGLHVLAFRGLHALTFRGLHVFAFRGSCTFTFRGLHVLASRGLHVLAFRGLHILAFRGLHVLTVGGLHALTFRGLHILSFRGSCTFTFRGLHVLASRGLHVLAFRGLHVLTFRRLHVLTFRGLHVLAVRGLHILAFRGLHVLTFRRAPTVRIQPERKAITQLLCIPGQDFTRAAAKRQVRIVRTNMTTFAQICMTLLLSNILPSDRNADLPLRKGRAHKTPSGPGEVQQGPGVSSSGYGPLSVLQGARTPRQ

SEQ ID NO: 129155 - protein, 172 aa, Glycine max
  Coding DNA Sequence Number=SeqID_37470
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=56%, HitCoverage=10%, E-value=5e-09, Identity=37%"; Hit description =Gag/pol polyprotein, 3'-partial, putative
  Pfam annotation: Domain name=G-patch; Domain location=38-82; Score =25.6; E_value=0.00015; Accession=PF01585.14; Description=G-patch domain
MPYVESAEESLETAFQSFKVVSIASVDSLPRKPCLSGAAMIVAWVMLGHGYEPGMGLGKNNGGRASLVSVRGNHRKFGLGYKPTQSDIRKNISERKNKGQGPRSGQQAKEVPLCHISKSFVSAGLRRKGQVAVICDDDSPRRSDLVQSCPPGFQLGNWQVEERLEVYTTSIM

SEQ ID NO: 129156 - protein, 138 aa, Glycine max
  Coding DNA Sequence Number=SeqID_37471
  Subcellular localization annotation: CTP_CleavageSite=34; ConfidenceScore=5.18e-01
PPQQQQHVPPFQNAAGPSKPYVPPPIQQQQQHLSQQRQQATEAPPQPSLEELVRQMTIQNMQFQQETRASIQSLTNQMGQMATQMNQAQSQNSGKLPSQTVQNPKNVSAITLRSGNQIQVPPPVAAPAPKPLKLHSTP

SEQ ID NO: 129157 - protein, 20 aa, Glycine max
  Coding DNA Sequence Number=SeqID_37472
MEFLNYESSLSIPSTSRGGP

SEQ ID NO: 129158 - protein, 56 aa, Glycine max
  Coding DNA Sequence Number=SeqID_37473
MENDSTLEDDIKVEELEQNKEISMTMPKEFPREWRTQKDLSLDNNWRNLKGCFYAL

SEQ ID NO: 129159 - protein, 158 aa, Glycine max
  Coding DNA Sequence Number=SeqID_37474
  Homolog annotation: Hit_ID=Q6UUU1; Match level="QueryCoverage=44%, HitCoverage=47%, E-value=3e-10, Identity=57%"; Hit description =Putative uncharacterized protein
MSPIGDHYSCKSLSEELSDYYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPASSLTDSLRSVVRLRRAEMAYERGGDFLEDARKI

SEQ ID NO: 129160 - protein, 55 aa, Glycine max
  Coding DNA Sequence Number=SeqID_37475
MTKKKIAPLACKREITRMDAQKSIRLNDQQLNLCSAPITDLQVKLLEPKHPSAIN

SEQ ID NO: 129161 - protein, 139 aa, Glycine max
  Coding DNA Sequence Number=SeqID_37476
MFKIESRTLQDSRGKLKNTSRFKRKVEFKNQESRFKDQASKNQDQDSRLKIQESREDLIKISMKRFFQKLSSTWIFLKTCLPKSFYSLRVHLLGFLTENKRGYISCGSILVEGTSTRFKENKGWYIHYGSSLVKGFLQG

SEQ ID NO: 129162 - protein, 208 aa, Glycine max
  Coding DNA Sequence Number=SeqID_37477
MPHSEIEKDFEAKEVGGSCDCNEIGDNLSVGPSEVGSGQERSEHLKKLILEEEEGDISQAKSVMGEHEGTKNNHGGGKRPYDIEIEFFNKGAKVHREVVHCLFGEHKIEDREVRKRDREGNKGILTNKGAIPSRSVMASFFRRVDGLEDEAEKDGSPKKNKGIKIKKIKGCQPKKSLLAKQGEKVEWRQCLIVDSSGGLLCHWKKGGF

SEQ ID NO: 129163 - protein, 70 aa, Glycine max
  Coding DNA Sequence Number=SeqID_37478
VFCYLSQRALRGRARARLTGALSKGGKMHGVATNEGISTSHVDKSGAFAPTYPPLERKSDLRSSHLCVNQ

SEQ ID NO: 129164 - protein, 86 aa, Glycine max
  Coding DNA Sequence Number=SeqID_37479
HDGSWIKKGARNVGEEGHEREDSSLLSKILERFDGLQTFFSERFDTLELQVNMRFNEMESRMTKVEEDVSYIRSSFDLPPPPPSSS

SEQ ID NO: 129165 - protein, 94 aa, Glycine max
  Coding DNA Sequence Number=SeqID_37480
EFYANLYSSEDPSPKQARVRGHLVKIDADSLNTFLETPVVLEEGETLPTYSRYCSLPTDHREIEAALCIPGRGFILNVEGHPGRILRKDLTTLA

SEQ ID NO: 129166 - protein, 122 aa, Glycine max
  Coding DNA Sequence Number=SeqID_37481
MEIYVSNRLGKIVIIKKGEIVEAKLHDESRMIQRCFDDNKGDDKKLKGQSKNEFKMFKIESRKNKFKMFKIESRTLQDSRIKLPRIKIKIQELREDLIKIQDSRIKRRLNQDKYEKVFSKTE

SEQ ID NO: 129167 - protein, 160 aa, Glycine max
  Coding DNA Sequence Number=SeqID_37482
MWAFHKGLQIDWAHLVRYRMHKALRLNAPLPYPHLVTLFLQHFNIPLDSEPYVPIKRSFLIGASVITSFGYQKEHDGSWVKKGARHVGEEGHDGEDSSLLSKILDRFDGLQTFVSERFDTLELQVDMHFNEMESRITKVEKDVSYIRSSFDLPPPPPLSS

SEQ ID NO: 129168 - protein, 216 aa, Glycine max
  Coding DNA Sequence Number=SeqID_37483
  Gene Ontology: Mol. function=N-acetyltransferase activity; Cellular component=ribosome; Biological process=metabolic process
  Homolog annotation: Hit_ID=Q2L1L3; Match level="QueryCoverage=96%, HitCoverage=96%, E-value=3e-66, Identity=54%"; Hit description =Putative acetyltransferase
  Pfam annotation: Domain name=Acetyltransf_1; Domain location=74-156; Score=46.3; E_value=1.1e-10; Accession=PF00583.15; Description =Acetyltransferase (GNAT) family
DAAVRRNQYGQPIGEALPHWQPAGMPGHTPLQGRFCRLEPLNLERWGDALYQAYQTAEDDRDWTYLADRNTMVVIDRANGRAVGTCAFLRIDPANGVAELGTINWSPLMKRSALGSEAIFLMLRHLFDDLGYRRCEWKCDSLNLPSRQAAERLGFRYEGTFRQAVVVKGRTRDTDWLSIVDGEWPARRAAFAAWLSPDNIGDDGRQARQLQAFRRE

SEQ ID NO: 129169 - protein, 49 aa, Glycine max
  Coding DNA Sequence Number=SeqID_37484
GYIYLGLTENKRGYISCGSVLVEGTSTRFKENKGGKKTRFKRTQAKRDK

SEQ ID NO: 129170 - protein, 118 aa, Glycine max
  Coding DNA Sequence Number=SeqID_37485
KDVAGGSMFHSANSLTSCGNYVSNDDTQPPTNMSNLNLDEDDGHDDYLVSNSYVEESLDEDDSVDGISDTDNEVPEMIPPVRIVHPAEGVQGIQNPFWNDALHYNNINWSHPDEEDIC

SEQ ID NO: 129171 - protein, 117 aa, Glycine max
  Coding DNA Sequence Number=SeqID_37486
MSVFACYQAFCLTDSKKNFYTANHSGISACQRDSNVSLSAAIDEGHRRRRQSLRAIRLFVLQTAKKNVYTDNHSGISARQRDSNVSMTDLVSAEDDVNLRVSMALSAAIDEGRRRRR

SEQ ID NO: 129172 - protein, 259 aa, Glycine max
  Coding DNA Sequence Number=SeqID_37487
  Homolog annotation: Hit_ID=A1FRI9; Match level="QueryCoverage=42%, HitCoverage=36%, E-value=4e-17, Identity=53%"; Hit description =Transcriptional regulator, LysR family
  Subcellular localization annotation: CTP_CleavageSite=56; ConfidenceScore=5.55e-01
MDRPSCWSSPKKRPTPAWKPPRSGAPIRVGSRPSSHQLSQCCSAAFHLWARMPMPRSGAAVHHVVTHVAEILPGPASCADPLRTRPPSLPAEGLTRRDIGAQAKPHYGPPGNQSRCRHPCSFEAEARLGSFARAGGLDTSAASLPSAAASWSPDRHLPVPAPRPQHVELTVAGASVAQATRAFDALRASFMRAADMDAARLRLSVLPTLGTSWLTPRLGTFRARHRQLVHGTGPVGSAAGSWPPVTSMPPSAMARVDGQ

SEQ ID NO: 129173 - protein, 79 aa, Glycine max
  Coding DNA Sequence Number=SeqID_37488
MTSRDQVWSFCTHDTRRYLTVIRTLLSFQTDRAVDSRDQVWSFCTHDTRRYLTVIRTPLPQTQSCPLDKQRPSLVILHP

SEQ ID NO: 129174 - protein, 54 aa, Glycine max
  Coding DNA Sequence Number=SeqID_37489
MQTILVFFMRLRNFLSRNFEVKDMGEYVLRLQFRLIGCETLFQGLELSTVLLGR

SEQ ID NO: 129175 - protein, 415 aa, Glycine max
  Coding DNA Sequence Number=SeqID_37490
  Gene Ontology: Cellular component=viral envelope
  Homolog annotation: Hit_ID=Q84VI1; Match level="QueryCoverage=90%, HitCoverage=54%, E-value=0.0, Identity=90%"; Hit description =Envelope-like protein
MAQKKSTPITPATSRRSKVAIPSKKRKEISSSDSDDDVELDVSTSKRAKKSGRKVPENVPDAPLDNISFHSIGNVEKWKYVYQRRLAVERELGRNALDCKEIMDLIKAAGLLKTVSKLGDCYEGLVREFIVNIPSDISNRKSDEYQKVFVRGKCVKFSPAVINKYLGRPTDGVIDIAVSEHQIAKEITAKQVQHWPKKGKLSAGKLSVKYAILHRIGAANWVPTNHTSTVATGLGKFLYAVGTKSKFNFGNYIFDQTVKHSESFAVKLPIAFPTILCGIMLSQHPNMLNYTDSVMKKESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 129176 - protein, 76 aa, Glycine max
  Coding DNA Sequence Number=SeqID_37491
  Homolog annotation: Hit_ID=UPI0000ECBAF8; Match level="QueryCoverage =61%, HitCoverage=55%, E-value=4e-17, Identity=91%"; Hit description =UPI0000ECBAF8 related cluster
MDAKANNILMASNLATGAYSRPAGMQAWHWPSFYNVVTGKTLALPNLIALQHIPLSPAGVIAKRPAPIALSNSCAA

SEQ ID NO: 129177 - protein, 314 aa, Glycine max
  Coding DNA Sequence Number=SeqID_37492
  Homolog annotation: Hit_ID=Q6WAY4; Match level="QueryCoverage=93%, HitCoverage=50%, E-value=6e-33, Identity=32%"; Hit description =Putative uncharacterized protein
MGTNQIEKRFYQVKIKGLDVTNLKELGRLMGPLQRQAFRKVYRKILDLTTAEVFTEAVVSLAQYFDQPLRCFTFGDFQIVPTVEELEEILGCPLGGRKPYLFSGFLPSLSKIAAMVGDSARELDRMKQTRNGVVGVPRKYLEGKARDMANQEEWVSFADILALLIFGVVLFLNVDGLVDLAMIDAFLAYHHSKESPTVAILADLCDTCDRRCEKNSTWIVCCLPALCVWLVAHLFQQDIRHPCPLQSYRSCVKKRRVDWDQHLAGIGGRTINWFPRWKEGKEGVLFSCRDYPNIPLIGTRGCINYNPTLAIRQL

SEQ ID NO: 129178 - protein, 221 aa, Glycine max
  Coding DNA Sequence Number=SeqID_37493
EESSEEIYPQEEVQPLKFKEECKEVSVSSKRLAKKERHFEIKTNIKVISPLRQPPHFLLCEKTLVSIATPLRLEFIPQVKELLDEGLVRKSLNPCALLVPKIGIIRHQIPKIGGMMNVLSGATLFCKITCAPNIFMICVHRDSLGSDQGVPMNPKRIKIIPEWPTPPTPLIELVRNHVPSWEDAQEMGFQTLPYFMGRCPGTMFFLRVLRKKAQSLKNLRI

SEQ ID NO: 129179 - protein, 89 aa, Glycine max
  Coding DNA Sequence Number=SeqID_37494
  Pfam annotation: Domain name=Retrotrans_gag; Domain location=6-89; Score=5.5; E_value=0.016; Accession=PF03732.8; Description =Retrotransposon gag protein
MADKPRRVTLEDYSSSSVPQFFTSIAQPEKYFPESKTAEGKATISSFHQFPDESLSEALEIFRGLLRKTPTHEFSEPIQINIFIDGLRP

SEQ ID NO: 129180 - protein, 213 aa, Glycine max
  Coding DNA Sequence Number=SeqID_37495
  Gene Ontology: Mol. function=hydrolase activity, acting on glycosyl bonds; Cellular component=periplasmic space; Biological process =metabolic process
  Homolog annotation: Hit_ID=Q1H496; Match level="QueryCoverage=85%, HitCoverage=96%, E-value=8e-74, Identity=72%"; Hit description=Lytic transglycosylase, catalytic
  Pfam annotation: Domain name=SLT; Domain location=90-203; Score=52.7; E_value=1.3e-12; Accession=PF01464.11; Description=Transglycosylase SLT domain
MDGMKKVFFLSFVLVLVGLCAWSAPTMAGNQQEEPLANSVKALMQKSVSDLAAPRLLFDSEQAAQQWLQEMSARLAKRVPDTQYREDFLKSVHYEATRAGLDPQLVLGLIQVESGFKKYAVSSVGARGYMQVMPFWVKSIGTNEHNLFDMRLNLRYGCTILRHYLDIERGDYYRALGRYNGSLGKPEYPNLVVGAWRNHWHYAPSIKMEIASQ

SEQ ID NO: 129181 - protein, 52 aa, Glycine max
  Coding DNA Sequence Number=SeqID_37496
MARSVLLFAPIWEPIGQYLGARLTGALSKGGKMRGVATNVYLWKTSEKLKET

SEQ ID NO: 129182 - protein, 99 aa, Glycine max
  Coding DNA Sequence Number=SeqID_37497
  Subcellular localization annotation: CTP_CleavageSite=51; ConfidenceScore=5.07e-01
MNKFLAPLPGNFFLFGKSPTGNLVPLDSEIEATLRRNRAKRRRKLLQDKTVASIFEEETNFSDLLSPDSLSSRESATQLPKAITMAEEHDQRITLEDYS

SEQ ID NO: 129183 - protein, 112 aa, Glycine max
  Coding DNA Sequence Number=SeqID_37498
GVSSLSSFSIPLPFIFQEAKESIDKEDPRPTSSNGAYIRDILTTCVFAVFHLVLLFVVKEVFGLWKAKSSVGSSLWVPDMHALLGSFNSGNWSDSKVLGSTGLSCCAITRDR

SEQ ID NO: 129184 - protein, 100 aa, Glycine max
  Coding DNA Sequence Number=SeqID_37499
  Homolog annotation: Hit_ID=A5AYU6; Match level="QueryCoverage=69%, HitCoverage=12%, E-value=3e-11, Identity=43%"; Hit description =Putative uncharacterized protein
MGAKHLTRTKERSHVIKQRYRSFQDHDEDQANLCLMTKSHENNKEESVRKKWYIDSGCSKHITGDVSKFTTISPKKSGHVTYGDNNISKISKEVTSKPSL

SEQ ID NO: 129185 - protein, 84 aa, Glycine max
  Coding DNA Sequence Number=SeqID_37500
MEALEEDYGDGNGKNESRQYIEGLMDLEKRINRLETQNANGNDADVAPEFSPLKTFQFGNPSQDTVDPRDGGFGGRLWRWKWEK

SEQ ID NO: 129186 - protein, 69 aa, Glycine max
  Coding DNA Sequence Number=SeqID_37501
MAVGYDVCMIHDLEGELYVHDFEGETAADDDCCKLLEAARRCCSKSMKTGGADSGCHMRCLDILEKTSS

SEQ ID NO: 129187 - protein, 335 aa, Glycine max
  Coding DNA Sequence Number=SeqID_37502
  Subcellular localization annotation: CTP_CleavageSite=48; ConfidenceScore=5.78e-01
TPHGTHQYAQHHPSFSTHTGNASSSAPVQPKAPTQREAPQVPTPNTTRPASNSNTTRNFPPRPFQEFTPLPMTYEDLLPSLIANHLVVVTPGKVQHLIDAGWLTFQEDRPNVRTNSLANHGGGAVNAVESDRPCRSKPLRDVATPRRFIFEALQKGGVIPHSGHQGRPEVGSEGREEQHICMQSTDGSSVMKPKPLVIYFTKGTASQKPGHPLAAKPVPFPYQNSHAVPWRYTPPREKEEEATDVSSLSAKVTNITGLSGVTRSGRVFAPPDLPVQPANVKGKGKVVEEQDGEAPHASNKDIPVKGLPEKKDGKKEVSLEEASEFLRIIQQSEFK

SEQ ID NO: 129188 - protein, 218 aa, Glycine max
  Coding DNA Sequence Number=SeqID_37503
  Homolog annotation: Hit_ID=Q6WAY6; Match level="QueryCoverage=99%, HitCoverage=35%, E-value=2e-13, Identity=27%"; Hit description =Putative uncharacterized protein
MVEEFEEILGCPLGGRKPYLFSGFYPSLARISKIVQISAQELDSGKQVENGVVGIPRKSLEAKARILAGRGEWAPFIDILALLIFEGVLFPNVDGLVDLAAIDAFLAYHDRKESSVVAILADLYDTFDRRCEKSSTRIVCCTLALYVWLVLHLFRQVRHACSLESHRSCTEKGGANWDRLLANKEGASVNWFPRWKEGRTGVLILCGGFPNVPLMGTR

SEQ ID NO: 129189 - protein, 97 aa, Glycine max
  Coding DNA Sequence Number=SeqID_37504
  Subcellular localization annotation: CTP_CleavageSite=81; ConfidenceScore=5.24e-01
LSVLGSPCRPQQGHQAPYQSSFHQEVLCPQAGAGRNTTSALAWPVAGNRHTTTTSRVHLSSSIKSRTHLVAHDPKNLNKTSTSSEGSHTSQNICMRV

SEQ ID NO: 129190 - protein, 42 aa, Glycine max
  Coding DNA Sequence Number=SeqID_37505
MAQPPPCERTLREMAAPDFTYESLCIQYPDEDVPYVKTRTNI

SEQ ID NO: 129191 - protein, 46 aa, Glycine max
  Coding DNA Sequence Number=SeqID_37506
MGRPVRITIFCENAPTIWDQHRLKGIFKPDDPQGLHFEESVRISPS

SEQ ID NO: 129192 - protein, 118 aa, Glycine max
  Coding DNA Sequence Number=SeqID_37507
MEAMKEKMTTMMEAMMSMRKMMEVNTAIVVVASTATDVDPTQPSDFNQVNHPVSDMVQSKHSFPPNGLPPNYTPPNVVHAPDENVDIPYPLGANNPNLVIRRSLNLWGRHMKYLETML

SEQ ID NO: 129193 - protein, 191 aa, Glycine max
  Coding DNA Sequence Number=SeqID_37508
MRLADLEVLPFQNFHEAGARGPRIIDHQNGKLSVGQNPVDSFDHRVDGAVTVLDDIVDDLLLGITLAGLLIHCRGEDDGGHFAFGEQRQNFTLRSVGKIETRQRQREIMSAQQGIGRGHAVAVDHLGLRLFRKARLQQHGQSNGIFNQKDFILHAAQAPHGRLHDVSTKLHSFATARHGIENLGNRRGMNL

SEQ ID NO: 129194 - protein, 68 aa, Glycine max
  Coding DNA Sequence Number=SeqID_37509
MTHYNPYPRKQKRKEGKFTIKEKAKRKERKFPIKEWEKAKRKERKFPIKEWEKAKRRERKFPTKEWEK

SEQ ID NO: 129195 - protein, 42 aa, Glycine max
  Coding DNA Sequence Number=SeqID_37510
HGQFNKRARGDIKMNESRSNSVTKADEVYEILVCLSKVLWFG

SEQ ID NO: 129196 - protein, 286 aa, Glycine max
  Coding DNA Sequence Number=SeqID_37511
  Homolog annotation: Hit_ID=Q6WAY6; Match level="QueryCoverage=75%, HitCoverage=35%, E-value=3e-25, Identity=34%"; Hit description =Putative uncharacterized protein
RQRQAFRKAYGKIWDLSMAEVSTETIASLAQYYDQPLRKPYLFSGFYPSLARISKIVQISTQESDHRKQVKNGVVGVPRKCLEAKARVLAGKGEWAPFMDILALLIFGGVLFPNMDGLVDQTAIDAFLAFHDRKESLVVTILANLYDTFDRRCEKNSTRIVCCTPTLYVWLVSHLFRQEVRHACPLEGHRSCIEKKEASWDRLLASKEGAFVNLFPRWKEGRTGILISCRGFPNVPLMGTRGCINYNPILAIRQLGYPMRGAPLEEDLTPIISRGFNTTNVEALQK

SEQ ID NO: 129197 - protein, 122 aa, Glycine max
  Coding DNA Sequence Number=SeqID_37512
  Gene Ontology: Mol. function=NADH dehydrogenase (ubiquinone) activity; Cellular component=mitochondrial respiratory chain; Biological process=electron transport
  Homolog annotation: Hit_ID=P08834; Match level="QueryCoverage=65%, HitCoverage=27%, E-value=6e-23, Identity=71%"; Hit description=NADH -ubiquinone oxidoreductase chain 1
SASESADEPHAGKLARVVLAGDPAETNRAPFDLPEAEAESVAGYNVEYARDAILNSPLLAEANVPGSRGLILTETRGACWGRALFILHSKLMNVGSGVSALLSKRELGKANSLLGRARGLVK

SEQ ID NO: 129198 - protein, 149 aa, Glycine max
  Coding DNA Sequence Number=SeqID_37513
  Subcellular localization annotation: CTP_CleavageSite=80; ConfidenceScore=5.23e-01
MPPKVSSSFDRGGRSGTKGKDVILALPEPITKKATTSSSGSPTQTGSSTQKGKLEGSLTQIKPESSTQESPKPTTTKQIVADYAWSIQTLLALEDIGLTRVPKLAKKTWAEMASESDDDSEIDLQKQIQKAKQTKTVCNQKPSQSLAQQ

SEQ ID NO: 129199 - protein, 136 aa, Glycine max
  Coding DNA Sequence Number=SeqID_37514
  Homolog annotation: Hit_ID=Q84VI1; Match level="QueryCoverage=70%, HitCoverage=14%, E-value=7e-35, Identity=81%"; Hit description =Envelope-like protein
MLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAVETESDDDSEATP

SEQ ID NO: 129200 - protein, 120 aa, Glycine max
  Coding DNA Sequence Number=SeqID_37515
MALSNLLFPIIQGIWGTDLPINAETFLPMLIRSLPLSFRLLVHNSFKNLAYLEICFIASSRGNGRGICCFCKSELPVKDLPAQKLLGNLLFKFLSSSFSGAFVDEEGTTGAFADEEGATG

SEQ ID NO: 129201 - protein, 310 aa, Glycine max
  Coding DNA Sequence Number=SeqID_37516
RSCICTPDLPIQPTNVKGKTKVVEEQDDKTPHTPNEDIPAKGLPEKRDGYGKKEVSLEEASEFLRIIQQSEFKVIEQLNKTPARVSLLPDCINNSPQLPMTYLLAENPSSPTRRNKARRGRSSNPVVQGSKIDAWMAAFQEDRPNVKTNPLAIMRGGSRLTSLRARTKGRCDSPLGGHKEDSCLLHSGELHNMETCLEVEELLQQMIDQGRLEVDSEGREEQHICMQSTEESSLAKPKPLVIYFTKGAASQKPRHPLAPKHIPFPYQNSHAVPWKYTPPNKEEEETTDISSLSAKVTNITGLSGVTRSGR

SEQ ID NO: 129202 - protein, 197 aa, Glycine max
  Coding DNA Sequence Number=SeqID_37517
MDNEEGVQEQMKADLSALKDQMASISEVMLKLQKTIEDKATATASSTVREAEPVLQPALNPGLDRNTAVFGRRYSPQAYPYGLPPDFTPRATPEDLSQAPTFEGQLPPYEDYPGQDDGEGDTHLGPLLHLKDLSPHELPQPNIVCHIPASPTPVKESVPFAEDKGKIEALEERLRAVEGLGNYPFSDLADLCLVPNI

SEQ ID NO: 129203 - protein, 375 aa, Glycine max
  Coding DNA Sequence Number=SeqID_37518
  Gene Ontology: Mol. function=transferase activity, transferring groups other than amino-acyl groups; Cellular component=cytoplasm; Biological process=protocatechuate catabolic process
  Homolog annotation: Hit_ID=Q7CV85; Match level="QueryCoverage=76%, HitCoverage=71%, E-value=1e-144, Identity=92%"; Hit description=Beta- ketoadipyl CoA thiolase
  Pfam annotation: Domain name=Thiolase_C; Domain location=182-306; Score=193.9; E_value=4.1e-55; Accession=PF02803.9; Description =Thiolase, C-terminal domain
  Pfam annotation: Domain name=Thiolase_N; Domain location=2-175; Score= 82.0; E_value=1.9e-21; Accession=PF00108.14; Description=Thiolase, N -terminal domain
  Pfam module annotation: Pfam domain module=Thiolase_C::Thiolase_N; Domain location=182-306::2-175
MPSLLPPGPSKSGEAELMIAGGVESMSRAPFVLPKAESAFSRNAEIYDTTIGWRFVNPLMKAQYGVDSMPETGDNVAVDYQVSREDQDAFAVRSQQKAADAQANGRLDREIVSVTIPQRKGDPLVVSKDEHPRATSLEALAKLKPVNKREGATVTAGNASGVNDGAAALIIASAEAAKKYGLTPIARILGGAAAGVPPRVMGIGPAPASAKLLARLGLKQEQLDVIELNEAFASQGLATLRQLGIADDDARVNANGGAIALGHPLGMSGARIAGTAALELSLKGKRLALATMCIGVGQGIARLQYRDNGANAAVNRYECPLPHLPWCDSGHSGYSAGDFFALTHPSPLIPVLVTGIQPIRVCAAKQSLSPKTWAG

SEQ ID NO: 129204 - protein, 124 aa, Glycine max
  Coding DNA Sequence Number=SeqID_37519
  Subcellular localization annotation: CTP_CleavageSite=67; ConfidenceScore=5.19e-01
MPQPHGINMDLREHSNRVSLLPRPRLRRIRLGLTFLIQFNPLGSCRNVPFAGVRGRGSRVRFPKEERCAESPPTFICGKRRENRRKLVKMKILSPGVVFTLEEGRQKRGFCSYVPSIEEEIRPT

SEQ ID NO: 129205 - protein, 202 aa, Glycine max
  Coding DNA Sequence Number=SeqID_37520
  Pfam annotation: Domain name=Cornifin; Domain location=20-189; Score=- 39.0; E_value=0.018; Accession=PF02389.6; Description=Cornifin (SPRR) family
  Pfam annotation: Domain name=PT; Domain location=104-139; Score=6.0; E_value=0.17; Accession=PF04886.3; Description=PT repeat
  Pfam annotation: Domain name=PT; Domain location=64-99; Score=5.4; E _value=0.2; Accession=PF04886.3; Description=PT repeat
  Pfam module annotation: Pfam domain module=Cornifin::PT::PT; Domain location=20-189::104-139::64-99
MTGPLDESISCFLIRVDPWVLVPIAFRGLHVLTFRGCTPSPLEDYMSSPSEGYMPSPLEDYTSSPSAGYTSSPSEGYTPLPSEGYTSLPSEDYTSSPSEGYTSSPSEDHTSSPSEGYTSSPSEDHTSSPSEGYTSSPLEDHTSSPSEGYKPSPSEDYTSSPSENHVLMQSYPPRVLDRRLLEAWARATKEGPRVLMNLRVDV

SEQ ID NO: 129206 - protein, 123 aa, Glycine max
  Coding DNA Sequence Number=SeqID_37521
MPFRTCRPFVFIKVRYFELVGKETISFGVRLSSTSGADFGDAWAERVSPSSSSCLGIVVHYWELLLEWLGLNLRGGHGVKSRGKHNIKLAGYTFVPNTVVILLSPGRIKDGCSTGSASLTVRG

SEQ ID NO: 129207 - protein, 97 aa, Glycine max
  Coding DNA Sequence Number=SeqID_37522
MSQNFTDCLTMGVKFLEVVKMDPLLEMVPQLMLALADKSAKAGSRAEVEDVGMPTIGAKEEGTSAALSLEVRASDPTPLDLQKAMIKAGKPKREELD

SEQ ID NO: 129208 - protein, 200 aa, Glycine max
  Coding DNA Sequence Number=SeqID_37523
  Homolog annotation: Hit_ID=Q0ZCD6; Match level="QueryCoverage=70%, HitCoverage=15%, E-value=1e-06, Identity=29%"; Hit description =Integrase
MERSMIDAASGGALGDMTPAKAKNLIEKMASNSQQFSARNDVIVLRGVHEQSGVNEQPEAYAANIYNRPPQQQNQQQQNNYDLSSNRYNPGWRNHPNLRWTSPLQQQQPIPTFQNVAGPSKPYVPPMQQQQQQQQRQQATEAPPQPSLEELVRQMTIQNMQFQQETRASIQSLTNQMRQMATHLNQAQSQNSDKFPSQTV

SEQ ID NO: 129209 - protein, 87 aa, Glycine max
  Coding DNA Sequence Number=SeqID_37524
MDRFNSLQTYVGERFDSLESQVDIQFGEMDYRITKIEGLSSSKRGRLWKQSYHDDSPRCFDDAKAQRVVSRLKDQAFKIPLKDSRIK

SEQ ID NO: 129210 - protein, 85 aa, Glycine max
  Coding DNA Sequence Number=SeqID_37525
MLLSSNVIHICVRVVMVHMTRTCLFAAARVKSCPGMHSSCMIASLSGCIRTVGALQYQGVAQELIKGNYWPLNRECKSRLSIKGR

SEQ ID NO: 129211 - protein, 52 aa, Glycine max
  Coding DNA Sequence Number=SeqID_37526
MNSLPSAVHVSSVIKREASEKIEGAETRVVITERAGQTKSVSYLCFPLISDE

SEQ ID NO: 129212 - protein, 174 aa, Glycine max
  Coding DNA Sequence Number=SeqID_37527
ASLPNKPTYNSKPQETQHKDAQVKVEYEKRLYDQVKVQIAKKNESYAKQANKKRKEVVLEPGDDPGHLRTNVFQEGGNDENHETGQIQAKGPSGEGQSPGEGYTISIGNPCGVYLDLSSFTGSGVYPDLSSFTGSGVIQTFVACIKRSAPTQGTGMAESAGKEDPVELDSSPTL

SEQ ID NO: 129213 - protein, 68 aa, Glycine max
  Coding DNA Sequence Number=SeqID_37528
  Subcellular localization annotation: CTP_CleavageSite=24; ConfidenceScore=5.05e-01
MSLSPLGSHNHSQTHLKLSEQLPLQALVSADLHTTKSLKIVSVGDFVKIFNRSSTFFVHSSSFFGLQP

SEQ ID NO: 129214 - protein, 173 aa, Glycine max
  Coding DNA Sequence Number=SeqID_37529
ERKDIDLVDEEEAQIGVDRSSATSNKAEIYNEEARKKTQKHKPKRVESVNDDAEAFAEALEHTKKRDTGHQSVSLENKTGDSTMLKMGDSTKVVIKQDMKGRKHKYGFNNNKREKTENKRVVDDETGDKHQLDEVLRRQIENKKLMPQSEKNVVVTLLALVTSVSAENYIRRC

SEQ ID NO: 129215 - protein, 213 aa, Glycine max
  Coding DNA Sequence Number=SeqID_37530
  Homolog annotation: Hit_ID=Q84VH5; Match level="QueryCoverage=100%, HitCoverage=29%, E-value=3e-72, Identity=68%"; Hit description =Envelope-like protein
MATSPKETSASGSPSVPSSPHQEQPEFNIQPIQIIPGQASVPEKLVPRRQQGVKIAENPSLATSPREVDTEMDKKIRSIVSSILNDTSVPDAEKDVPTSSTPDVAVPEADEDVPTSSTPNVSVPDVEKDVPTSSGPNAEVLSSPSKERSTEEDDQATEETPAPRAPEPAPGDLIDLEEVESDEEPIANKLAPGIAERLQSRKGKTPIKRSGRI

SEQ ID NO: 129216 - protein, 100 aa, Glycine max
  Coding DNA Sequence Number=SeqID_37531
MNENTIQGSPKKGEIGELHYAITTHGSELEGGGHMIENAIHGAPKKGGGHMNEKAIHGAPKKGENGELHYAITTHGSKLEGGHMNENVIHGAPQRLRMEN

SEQ ID NO: 129217 - protein, 141 aa, Glycine max
  Coding DNA Sequence Number=SeqID_37532
  Homolog annotation: Hit_ID=A5BP71; Match level="QueryCoverage=53%, HitCoverage=19%, E-value=1e-11, Identity=48%"; Hit description =Putative uncharacterized protein
  Pfam annotation: Domain name=zf-CCHC; Domain location=114-131; Score =18.9; E_value=0.0021; Accession=PF00098.14; Description=Zinc knuckle
MKGKYIVQSLLKNLEKIKNKLVRTSFACMTSTPQACDYVSLNYYQYIDVVYTNEHILKAYSAQWWPLGNEAAIPPFNDAWTLIPDPTTIRAKGRPKSTRIRNEMDWVEPSEHRQKCSRCGAEGHNRRRCPMQSERGSCSNH

SEQ ID NO: 129218 - protein, 153 aa, Glycine max
  Coding DNA Sequence Number=SeqID_37533
MKKKLLQTVDERWRQFKSDLMRKWALVANQDGVDDAVCEKYDISKEKWAQFCQTRRDPSWEKLLAEKTKKKLEEATQSKSVDGVINPPSLVRRHVKWKMARTKKTKEMTTEAAKEIAKKIDSFEEHATQGSFVPRGHQDVLTAAIGRPEHPGR

SEQ ID NO: 129219 - protein, 72 aa, Glycine max
  Coding DNA Sequence Number=SeqID_37534
  Subcellular localization annotation: CTP_CleavageSite=49; ConfidenceScore=5.16e-01
MYRMKWPRGNLPQRDPGRIKRPKEPVPLPSMTVTALGALNTSSVSRPSRDGHFSGSDASSSGTTSIPISRKR

SEQ ID NO: 129220 - protein, 143 aa, Glycine max
  Coding DNA Sequence Number=SeqID_37535
MAAQLIHDRVEMECLEGAWETLEGNTRCRFRGTIRFTVTSLVHPDEPVRTLQRTVEWILPTPTPYRLVELVQVIEVMSSEEDPEEDPEELPPEPAVDALDFLEGDEDPLPEVDSPEEVMLASEADSTEYSGPREMATSGGSSS

SEQ ID NO: 129221 - protein, 79 aa, Glycine max
  Coding DNA Sequence Number=SeqID_37536
EVWFSKSALCADFCCEIVQQNFAQVQKNAMHLLAVERVVQKEFWMFATWEDLWGPGVERNEDMGYVGVRELSWRWATGD

SEQ ID NO: 129222 - protein, 87 aa, Glycine max
  Coding DNA Sequence Number=SeqID_37537
  Subcellular localization annotation: CTP_CleavageSite=64; ConfidenceScore=5.47e-01
AMNRLSAVGALSVFIANPRKIHRVFKPFLTTLPLMGFVATCPFCGRAKVRLTGALSKGGKEGISTSHVDKSGVLAPTYPPSKRKSDL

SEQ ID NO: 129223 - protein, 151 aa, Glycine max
  Coding DNA Sequence Number=SeqID_37538
MEKSIGKITKISISQSRGSALDGEEHIGDLRNPIGKITNITFPSQEGPVFGGEEHIGEWRNPFGKITKITFPSQEGPLLTVKNTLENGGFNRDNTKDHISQSRGSALDGEEHIGEWRNPIGKITKITFPSQEGPLLTVNNTLENGKIQSGK

SEQ ID NO: 129224 - protein, 148 aa, Glycine max
  Coding DNA Sequence Number=SeqID_37539
  Subcellular localization annotation: CTP_CleavageSite=58; ConfidenceScore=5.06e-01
AVHVSSTFEFRAEFHDCLSANPQGNPPYSTFVRSTMNIGSFAKRKKEEVEMRVVITARAGRTKSVSYLCFPLISDESPETSQKSKGSRLARSVKFRNVAEIKKRGVQIATRPTWALQKIPPEGCCFWRKQPGSPGRAGRQASPLFCYK

SEQ ID NO: 129225 - protein, 189 aa, Glycine max
  Coding DNA Sequence Number=SeqID_37540
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q67GW6; Match level="QueryCoverage=66%, HitCoverage=30%, E-value=3e-69, Identity=97%"; Hit description =Photosystem II CP43 protein
  Pfam annotation: Domain name=PSII; Domain location=67-189; Score= -156.7; E_value=0.0003; Accession=PF00421.10; Description=Photosystem II protein
MSALGVVGLALNLRAYDFVSQEIRAAEDPEFETFYTKNILLNEGIRAWMAAQDQPHENLIFPEEETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWER

SEQ ID NO: 129226 - protein, 558 aa, Glycine max
  Coding DNA Sequence Number=SeqID_37541
  Gene Ontology: Mol. function=oxidoreductase activity; Cellular component=membrane fraction; Biological process=metabolic process
  Homolog annotation: Hit_ID=A2WB04; Match level="QueryCoverage=58%, HitCoverage=98%, E-value=1e-127, Identity=69%"; Hit description=Zinc- containing alcohol dehydrogenase superfamily
  Pfam annotation: Domain name=ADH_N; Domain location=116-199; Score =53.3; E_value=8.3e-13; Accession=PF08240.3; Description=Alcohol dehydrogenase GroES-like domai
  Pfam annotation: Domain name=ADH_zinc_N; Domain location=230-377; Score=42.7; E_value=1.3e-09; Accession=PF00107.17; Description=Zinc -binding dehydrogenase
  Pfam annotation: Domain name=Nitroreductase; Domain location=423-553; Score=21.8; E_value=6.8e-06; Accession=PF00881.15; Description =Nitroreductase family
  Pfam module annotation: Pfam domain module=ADH_N::ADH_zinc _N::Nitroreductase; Domain location=116-199::230-377::423-553
AARRSRKQAAIEIALQPLNGGADLTGQQRTNRVTSSKRIIDVLAIIGIFTLRVKVLSCNRHFSRRDVWLCCCQHPENIHSPGACCMKAIVYSQNGLPISDENALYELDVAKPQPGARDLLVKISAIAVNPVDTKVRAGAPTDTPRILGWDAVGVVEAVGSDVTLFQPGDEVYYAGDITRAGSYAEYGLVDERIAGLKPRTLSDADAAALPLTSLTAWELLFDRLEIDAADEGTLLIIGAGGGVGSMLTQLARKLTRLTVIGTASRPETADWVRSLGAHHVIDHQRPLGDQLAAIGHKEVRYVASLTHTDSYYPQLIDVLAPQGKLALIDDPETLDAVPLKRKAISLHWELMFTRSLFHTADMQRQHQILQQVSQLIDDQTLQTTAGEHHGSISAANLRKAHALIESGRARGKIETLMTLNDAVARRHTVKAFSAGKTLPQQEIDTLLNLLRNSPSSVNSQPWHFVVASTAEGREKMAQSTSGAFIYNNPKVLNASHVIALCMRTDLDEAHLQNVLAQEEKDGRFAKPEAKAGQDKSRRSYVDMHRYELRVVPQWMEKQ

SEQ ID NO: 129227 - protein, 491 aa, Glycine max
  Coding DNA Sequence Number=SeqID_37542
  Gene Ontology: Mol. function=transporter activity; Cellular component= outer membrane-bounded periplasmic space; Biological process=transport
  Homolog annotation: Hit_ID=Q3K6V4; Match level="QueryCoverage=62%, HitCoverage=85%, E-value=1e-103, Identity=57%"; Hit description =Putative uncharacterized protein
  Pfam annotation: Domain name=Peptidase_M14; Domain location=185-467; Score=-73.3; E_value=0.083; Accession=PF00246.15; Description=Zinc carboxypeptidase
  Pfam annotation: Domain name=SBP_bac_3; Domain location=1-162; Score =5.5; E_value=2.5e-08; Accession=PF00497.11; Description=Bacterial extracellular solute-binding proteins, family 3
  Pfam module annotation: Pfam domain module=Peptidase_M14::SBP_bac_3; Domain location=185-467::1-162
MSMTEKRREQVAFSDMLYITPSALLTPANSTLTADISTLRGKNIGVAQGTIQETYAKTKWAPQGVNVVSYPNQMEIYPDLVAGRLDASLANAVSAEQGFLNTPEGKGYVNKATLVDKALLGNGVGIGLRKGDTANLTLINNALAALHSNGTYDRLAQKKIMSLLPDYTQQRARFLAAVTRQHGALTAYRHPLTAPDGAALYTDVAVIGDPAAPKRMLILSGTHGVEGYYGSDSQIAWLDSFDVAALPPDCALVLVHLLNPWGAAHLRRVNEDNIDLNRNFIDFSQPAPANPHYALWHDLYHGDRAHADRLLAETLQQSGWPALKRVVEAGQYQAADGLFYGGQQPAWSHRTLHSIVEQHLRQAQVILSFDLHTGAGAWGHPMLLAIAEQRYPAHDWGKSLYDEWLTLLFTGAGRDSDTGVTATATGYVSQFLLTSLPDTQLLPLVVECGTYPGEEMHRRVRDDHWLHLQGDPASHAGRAEAAAGGGVLARR

SEQ ID NO: 129228 - protein, 256 aa, Glycine max
  Coding DNA Sequence Number=SeqID_37543
  Homolog annotation: Hit_ID=A6VTU7; Match level="QueryCoverage=100%, HitCoverage=98%, E-value=7e-90, Identity=63%"; Hit description =Putative uncharacterized protein
  Pfam annotation: Domain name=2OG-FeII_Oxy; Domain location=130-238; Score=9.1; E_value=0.019; Accession=PF03171.11; Description=2OG -Fe(II) oxygenase superfamily
MSALIRFDLHPLADADWRRHCRQQLEQHGALVLRQFLQPAALQAIVADGLAQRHLAYHTVSKHNVYLLKPDEAYRADHPRNRDVISTKGCITDDVIAAESPLRQLYNDELFKRFLCDVLDEDALYPYADPLSSINLHYAPDGQELGWHFDNSSFAITLLVQKPRGGGVFEYVKDMRDADAGEMNYDGVAAVLDQRQPVEALEIDAGDLVLFRGRNSLHRVTPTEGDVTRMLAVLAYNTQPGIALSETARMTFYGRL

SEQ ID NO: 129229 - protein, 215 aa, Glycine max
  Coding DNA Sequence Number=SeqID_37544
  Gene Ontology: Mol. function=oxidoreductase activity; Cellular component=extracellular region; Biological process=metabolic process
  Homolog annotation: Hit_ID=Q13K43; Match level="QueryCoverage=96%, HitCoverage=95%, E-value=2e-72, Identity=62%"; Hit description =Putative short-chain dehydrogenase, oxidoreductase
  Pfam annotation: Domain name=KR; Domain location=5-172; Score=-90.4; E_value=0.042; Accession=PF08659.1; Description=KR domain
  Pfam annotation: Domain name=adh_short; Domain location=5-157; Score =0.9; E_value=1.1e-05; Accession=PF00106.16; Description=short chain dehydrogenase
  Pfam module annotation: Pfam domain module=KR::adh_short; Domain location=5-172::5-157
MNKASRALLIGASRGLGFALAENMLQRGYQLAQRYPQQLTVESVDITVPAEVNALHLRLSGQQFDLLLVNAGVKNDDRETLADVSTEEFIRVMVTNALSPLRVLETFRNNVSARGTLAVMSSGQGSLTNNTHGNYEVYRGSKAALNMFMRSFAARHDDARTLLLLAPGWVRTDMGGAGARLSIEESIPNLLNTVESQTGRGGLHYLDYLGRVVPW

SEQ ID NO: 129230 - protein, 869 aa, Glycine max
  Coding DNA Sequence Number=SeqID_37545
  Gene Ontology: Mol. function=sequence-specific DNA binding; Cellular component=intracellular; Biological process=regulation of transcription, DNA-dependent
  Homolog annotation: Hit_ID=A2WG31; Match level="QueryCoverage=26%, HitCoverage=80%, E-value=1e-57, Identity=49%"; Hit description=AraC -type DNA-binding domain-containing protein
  Pfam annotation: Domain name=AraC_binding; Domain location=522-665; Score=92.5; E_value=1.3e-24; Accession=PF02311.10; Description=AraC -like ligand binding domain
  Pfam annotation: Domain name=DUF2000; Domain location=752-869; Score =224.4; E_value=2.7e-64; Accession=PF09391.1; Description=Protein of unknown function (DUF2000)
  Pfam annotation: Domain name=HTH_AraC; Domain location=683-729; Score= 31.8; E_value=2.4e-06; Accession=PF00165.14; Description=Bacterial regulatory helix-turn-helix proteins, araC family
  Pfam annotation: Domain name=LysR_substrate; Domain location=2-216; Score=-2.1; E_value=0.0061; Accession=PF03466.11; Description=LysR substrate binding domain
  Pfam module annotation: Pfam domain module=AraC_binding::DUF2000::HTH_ AraC::LysR_substrate; Domain location=522-665::752-869::683-729::2-216
MPKLTLYSLPALASKWLLPKITAWRAHCPGCDLSLHGTHAPVDFSATPADFVICFGEDRYAQLDKQRLFCDEVLPVASPALIQRYPGESLLSQAPLIHLDWGNEGRFLPDWRSWFQAKGSMEPAAQPAFSFNLTSLAIDAAVAGAGGGSAQPAAEQTLFPRLATAFPQSTRQRGADSVADAAGDVLAGAERFCARRGDPQSGPCPTLGQLAGGAVQPELAADGGGHGAAELSAGAGDAVEHGTHRAADAGGAGTGRAGRYPAGQSRQHWAGAGGGLRHLSTLCQYSARQRTKPGAERRGGKRVPAAFAMAAVVAAAHAGGGAGQRYSAGCLHYAAVPRSAAAGGNAGSIAGAQRARMAADCPTGRHSTVVDDRQSARLIRCVGRAGRGVGVNFRTCIYIAGILGVATVVVDSGLGRLIANALLHLLPLHDSPSFRAGCRFGLSATERGDVAGFCLRHPAAAISGVAHRGGNGAGECACQSRFAAVPAGVCAERAAAVTAGLSVVPAARLCLIRRQRSRIRYETGIESVNAHFCGHAYDPHDHDELLVGVTQQGLQRFNCHRALHTSTPGRAILIEPGAVHDGHAPDAAGFTYVMLYLPQPWVAEMMQRRGLGDVANIQGAFRSTLTDDAQLASAIQQAWFAVHQREGRLARDQSLDHLLTLLSRHLENKPGVQLSDAQRQMHLLRDYLHDFMAQDIGLDDLSRLSGIDRFRLTRQFKQAFGQSPHAYLVRLRLRSARALLAQGVEPVQVAAQRLNVVAFLATGIAAAAPEMMGEPYVDAHGRQYGNMAGQPMLVFAADLAGLQRAHRQGVERELTLIPYVEAMFSTGHDAANRAVFLAEDADNLNLVGIALRGPKKAVDKAIKGLALHG

SEQ ID NO: 129231 - protein, 334 aa, Glycine max
  Coding DNA Sequence Number=SeqID_37546
  Gene Ontology: Mol. function=transcription factor activity; Cellular component=cytoplasm; Biological process=regulation of transcription, DNA-dependent
  Homolog annotation: Hit_ID=A6T867; Match level="QueryCoverage=53%, HitCoverage=58%, E-value=4e-43, Identity=48%"; Hit description =Putative bacterial regulatory protein, LysR
  Pfam annotation: Domain name=HTH_1; Domain location=98-157; Score =65.4; E_value=1.9e-16; Accession=PF00126.18; Description=Bacterial regulatory helix-turn-helix protein, lysR family
  Subcellular localization annotation: CTP_CleavageSite=29; ConfidenceScore=5.16e-01
MVSRAVRTTQLWMDSSAGCCASVSLIVSRCAGNSAAKGSELVCSITLSMLHSPMCRVILPPKAWCLLLQVTILRAVSLFKSIKIMKSINENDFSKIDLNLLIVLLVMYDVRSVTQAANRLYLGQPAVSAALKRLRAMFDDALFVRSSQGMTPTPRAEQLVRQIAPLLQSVHRVIFTADRFDAAHDSRSFTLGMSDWLEHWLMPDLLLQLADSAPNIDIRVVAADPWQAIPLMEQQQADAVVTVGEETSRDLTREHIARAGFRTCAGRRVSPRGADAPRALCHAALLGVTANVAASAAVRDRSAGTGAGMATALCAEYGGGADRHAGLCTFAAVA

SEQ ID NO: 129232 - protein, 170 aa, Glycine max
  Coding DNA Sequence Number=SeqID_37547
  Homolog annotation: Hit_ID=A4SKG3; Match level="QueryCoverage=31%, HitCoverage=73%, E-value=2e-10, Identity=58%"; Hit description =Putative uncharacterized protein
MLFNARQQTVAGGCDAAVTGGQFTAENFQQGTFTAAVVANQADAVAFFQAEIQGMEKRAKGIVEADGMCGKECAHLLTLKLQAQKSLTTSAVNKSADNSGGVRLFPAICISVGIEDGWQVFRVDVTERKFSRMFDIAIPDDMPEDEIAGWLGDIFHEAATEHHLDVKRIE

SEQ ID NO: 129233 - protein, 136 aa, Glycine max
  Coding DNA Sequence Number=SeqID_37548
  Subcellular localization annotation: CTP_CleavageSite=65; ConfidenceScore=5.01e-01
MSKGMFRTCGFLAFLSFFQHFVELFSKEHNCVSQTFISIQVILISSPSSLDTNARSCLLFMFSIQSQTNFSKGLKGTNEFIYSSCCKCLAQPLLQMIFHVKSLRQRSEDLSHQLFDLSPFSQGSASCNFKNVQWKS

SEQ ID NO: 129234 - protein, 43 aa, Glycine max
  Coding DNA Sequence Number=SeqID_37549
MRVQRIRLPQYLLRKRKSRVHSSRESVISLNSNIRLMSVETAL

SEQ ID NO: 129235 - protein, 175 aa, Glycine max
  Coding DNA Sequence Number=SeqID_37550
MPERGEARGNSGGGPQRYGRANRSSDLVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 129236 - protein, 213 aa, Glycine max
  Coding DNA Sequence Number=SeqID_37551
MLAIIAKYQEELGLATAHEHRVADEYAQVYAEKKARGRVIDSLHQEATMWMDRFALTLNGSQELPRLLAKAKAMADTYSAPEEIHGLLGYWKNTITKRATRHPYRTRSKSRTMGDQEETQEQMKADMSALKEQMASMMEAMLGMRQLMEKNAATAAAVSSAAEADPTLLATAHHPSSNIVGRGRDTMGHDGNPHLGYNRAAYPYGLPPNYSPP

SEQ ID NO: 129237 - protein, 110 aa, Glycine max
  Coding DNA Sequence Number=SeqID_37552
FDFGNLLVEDRRTTKNDEERLRIFAKSPTETKIGEELATQLAQESSARTGELSSPMRARLLPPDVDSSNTVMYRKRGLLVTGGMSTGGFAGALFDFFEGLLAVAVPQGPA

SEQ ID NO: 129238 - protein, 64 aa, Glycine max
  Coding DNA Sequence Number=SeqID_37553
MNVVLILMHDNWPSVSRSQIELDELESVSILSMTLAWDEFSFSTFQEAHYSLQDSLDQVPDMPF

SEQ ID NO: 129239 - protein, 179 aa, Glycine max
  Coding DNA Sequence Number=SeqID_37554
  Homolog annotation: Hit_ID=A5C169; Match level="QueryCoverage=70%, HitCoverage=11%, E-value=1e-08, Identity=29%"; Hit description =Putative uncharacterized protein
MVCTNQADMIGRLLACSLAFECRIMHYLIMRILLPRSSNLAQVSEEDLIIMWVFLTGRQINWAHLMRYRMHKALRSNAPLPYPHLITLFLQHFNAPLDSEPFVKVKRSFSIGANVVSSFDYHKERDGSWVKKDAPVQAAEDCSPSPHSQRDDSSSLMHNILERFDGLQTYFGERFDALE

SEQ ID NO: 129240 - protein, 62 aa, Glycine max
  Coding DNA Sequence Number=SeqID_37555
MQLPQEPLNKKPRGLARKSMAETNSVELCGAAIQVPRRIKSSHGPRAQSGGQICLSVRGKGG

SEQ ID NO: 129241 - protein, 116 aa, Glycine max
  Coding DNA Sequence Number=SeqID_37556
MSLATLFGKLQEHEMELMRLNQHEENDKKKKGITLKASSSIQEGSDKEDLNEDLENEVVNLSLMGRNYESDEEKGHGASTCYFKKNSNNIKMIWVPKGSFIKTNTQGPKKVWVPKS

SEQ ID NO: 129242 - protein, 173 aa, Glycine max
  Coding DNA Sequence Number=SeqID_37557
MPISPCRWIAPTRLPVDPKKSNRALEFPALVTGLCQSYRVPVPPARSSHRDIGIAPTRHPVDPKKSNRALGFPALVTGLCSPTGCPFPRQGIAPIRRPVDPKKSNRVLGFPALVTGLCSPTGCPFPRQGTPPARHPVDPKKSNKVLKFPSSNYRPLSVLRSACRPQQGYQAPY

SEQ ID NO: 129243 - protein, 128 aa, Glycine max
  Coding DNA Sequence Number=SeqID_37558
  Subcellular localization annotation: CTP_CleavageSite=72; ConfidenceScore=5.53e-01
MTMQNMQFQQETRASIQSLTNQMGQLATQLNQQQSQNSNRLPSQSFQNPKNVSVVSLRSGKQCQGPQPVAPSSSANEPTQPHSAPEQDDNKNLKKKQHIPLPFPPRAIPNKKMEEAEKEILETFRKVE

SEQ ID NO: 129244 - protein, 113 aa, Glycine max
  Coding DNA Sequence Number=SeqID_37559
MSGLIRDSPQISANPHQLDFAPYASRSYSAQWNVSELFHDMRMLHSSHILEEMEVDEPWLGLWLPLNYQVGFVADLGMAFVDNWVVGTTVTTWVSPSFSPSSFAPVFSFFQVG

SEQ ID NO: 129245 - protein, 177 aa, Glycine max
  Coding DNA Sequence Number=SeqID_37560
MYEYLEEERVPDLESILADFMTYQASSKGSCYGMQQQGTQFQRNQSPVGYHWESCWQPDYDNKVEGVINLDDLLMQFKDTIESMQQAFRRTATQISKLVDDMANTAARQEEERVEIETYQESIFQVTSMHHQMPLQRKCLKSPVLQNTLARPLLAMLEEQRKIWVMLVLRRKRWNKK

SEQ ID NO: 129246 - protein, 46 aa, Glycine max
  Coding DNA Sequence Number=SeqID_37561
MISTKPVDRYTRPEFTENGPLAIDSKQAINHIKRKYELENMESGIL

SEQ ID NO: 129247 - protein, 129 aa, Glycine max
  Coding DNA Sequence Number=SeqID_37562
RGLLAGVAGAGVHAGAGQVGEAVEVVPRDQAPQQADMGFHRLQRPAAEIRGQADGVDHVPQGAVEQPGVIAPRRFAGDAVGAQARQQVAADEAGCPQDGDRRGVHASWPPSIARPGTAVTSLACQPSRA

SEQ ID NO: 129248 - protein, 287 aa, Glycine max
  Coding DNA Sequence Number=SeqID_37563
  Gene Ontology: Mol. function=structural molecule activity; Cellular component=flagellin-based flagellum basal body, distal rod, P ring; Biological process=ciliary or flagellar motility
  Homolog annotation: Hit_ID=Q7WJD1; Match level="QueryCoverage=82%, HitCoverage=76%, E-value=1e-100, Identity=70%"; Hit description =Flagellar P-ring protein precursor
  Pfam annotation: Domain name=FlgI; Domain location=50-287; Score =271.2; E_value=2.1e-78; Accession=PF02119.7; Description=Flagellar P- ring protein
MGWLQTLLPDRFAVLNMKQPTPISALLSLLARVCVAAGLLAGASAAHAERLKDLASIQGVRGNQLIGYGLVVGLDGSGDQVRQTPFTQQSLTNMLSQLGITVPAGSNMQLKNVAAVMVTTTLPAFARPGQTLDVVVSVQINQLNGGRISGGAIVERGVPTTFARDGYIYLELNNTDFGTAQNVVNALNRKFGQGTATALDGRVVQVRTPLEQASQARFLSQVEDLQVTRAPTVAKVIINARTGSVVMNRTVMIEEAAVAHGNLSVIINRQNQVSQPDTLFTKGQTVV

SEQ ID NO: 129249 - protein, 113 aa, Glycine max
  Coding DNA Sequence Number=SeqID_37564
  Subcellular localization annotation: CTP_CleavageSite=43; ConfidenceScore=5.19e-01
MREKPMLDCQGGRPNFPPTQQYLYSANNKLSPYPPPSYPQRPSLNLPQSLSTALPMTNTTFSTNQKHQPRTITLAKDHQPPFLREYDLNAMCACHEEVSGRSIEHCRALKRKV

SEQ ID NO: 129250 - protein, 25 aa, Glycine max
  Coding DNA Sequence Number=SeqID_37565
MGAKYLEVVKRGLHPKNGRSPNEIR

SEQ ID NO: 129251 - protein, 127 aa, Glycine max
  Coding DNA Sequence Number=SeqID_37566
  Gene Ontology: Mol. function=transporter activity; Cellular component= membrane; Biological process=oligopeptide transport
  Homolog annotation: Hit_ID=Q9CAS0; Match level="QueryCoverage=60%, HitCoverage=11%, E-value=3e-14, Identity=45%"; Hit description =Putative peptide transporter; 37139-33250
YIYLGLTENKRGYISCGSVLVEGTSTRFKENKGGYIPCGSLLVKGFLQVQCQMFTLVGHIQFYNNESLDKMKSIGNSLQYLVVAFSIYIGTLLVNVVHQLTRKHGGIDWLNDDINAGRLDYYYFLMA

SEQ ID NO: 129252 - protein, 33 aa, Glycine max
  Coding DNA Sequence Number=SeqID_37567
MVITGTISIAQVDVMDEFIQFEDQDMSQVGNLN

SEQ ID NO: 129253 - protein, 108 aa, Glycine max
  Coding DNA Sequence Number=SeqID_37568
RFSEIPPVIPSTAPIEFSNVRETEKRLKMLQCERYFSQLKYDITIPNGETSQNWTANVVLKFHDDPTVNESEIVIFLRHVRWPVGKREGFGRREKKRNCEAEETEESV

SEQ ID NO: 129254 - protein, 47 aa, Glycine max
  Coding DNA Sequence Number=SeqID_37569
MPPMVVITLARAYVKNFMTIMKEGIEFESRSEGKTILRAIGLRSTPN

SEQ ID NO: 129255 - protein, 106 aa, Glycine max
  Coding DNA Sequence Number=SeqID_37570
  Subcellular localization annotation: CTP_CleavageSite=76; ConfidenceScore=5.63e-01
PTNCPFVHVSSTFEFGAMRSDCLVQFSIFTLFRSPMNCVFVHVSSTFKFGAMRTMRSDCLVQFSILNLFGARMNCVFVLVPSTFEFGAMRSDCLVQFSTLNLFGAP

SEQ ID NO: 129256 - protein, 280 aa, Glycine max
  Coding DNA Sequence Number=SeqID_37571
IPRINYNPALAIRQLGYPMRGAPMEESMSPFLVRDFGAQNFKAIQRIHKAWETPLRKDQELRGIRNGIIGGYHEWLKVHIRGLDWLAKLKVVSEESFEAPEEDEEVQALKSELGKAKLAEEKSKLAATHIRKKCAGLREENATTARALEQEAKRARKEEYGRNKFHEALWVSNSELKLSKRSLSQRLCETETNMLAIIAKYQEELGLATAHEHRVADEYAQATMWMDRFALTLNGSQELPRLLAKAKAMADTYSAPEEIHGLLSYCQHMIDLMAHIFRNR

SEQ ID NO: 129257 - protein, 96 aa, Glycine max
  Coding DNA Sequence Number=SeqID_37572
MLSFSQMQSQLQSQMQSQGLALPPEPEVGSLAAYVSTKESCVNPSRNDPDTGDLDKCGLYIAENPPSLVALRRVYEGSTTVHNISLLHDQVKVGVE

SEQ ID NO: 129258 - protein, 212 aa, Glycine max
  Coding DNA Sequence Number=SeqID_37573
MGLGKDSHENADVVDVRRNPHKYGLGYEPGKPGRRNAPSRLRADRAWPGHVSQCFTSAGIMFEEEVAAIGEEAPQDPPSFLRPCNPNFQLGNWHVTSQSEVYTADSICENRSFEDPNSEGLIIDFDREVSQTINKEEEEDVLSPELERLIAQEERVSQHALLRASDARLAGALSKGGKMRGVATNVYLWKTSEKPKGIGQNENSKFGSCIYV

SEQ ID NO: 129259 - protein, 296 aa, Glycine max
  Coding DNA Sequence Number=SeqID_37574
IAPRNPARLPASTQPAYPETGTGGGVAAAGAHHAQRQYHRCRREPAAAGAPHAGGIRWITVLAARPRGHPRRDSDHRLPADGGVLLPAQRDGAFPRSAPERALPHSGYPGHGGSAGSGTWRSGVRHQLHGRQRSESRFRRTGRGPVRAGVPSRSSAGAQAQGGMGRPGRAPVDHRASHQRQPHAAGWCAGAREPQVELALRSDPPVDVTGHGRGRHRGVSAAEDGHARWGSPHPGDARDRQPGGVTHDRYRPPPRRPALAHCGAIPADADEPVARGGVSSHAVHAPIRSGTLSADR

SEQ ID NO: 129260 - protein, 33 aa, Glycine max
  Coding DNA Sequence Number=SeqID_37575
MASIMSLPHMENGQGAAKTFNDTGGALTLSTKA

SEQ ID NO: 129261 - protein, 61 aa, Glycine max
  Coding DNA Sequence Number=SeqID_37576
MRIKRSFKVVMGPRTRLVVSFKTRKGKQGSKGLSKELIQGSINKNQAKAIVQAINGAKHTK

SEQ ID NO: 129262 - protein, 175 aa, Glycine max
  Coding DNA Sequence Number=SeqID_37577
  Gene Ontology: Mol. function=aminoacyl-tRNA ligase activity; Cellular component=cytoplasm; Biological process=tRNA aminoacylation for protein translation
  Homolog annotation: Hit_ID=Q1H417; Match level="QueryCoverage=71%, HitCoverage=27%, E-value=1e-47, Identity=71%"; Hit description =Cysteinyl-tRNA synthetase
  Pfam annotation: Domain name=tRNA-synt_1e; Domain location=1-173; Score=11.4; E_value=1.2e-15; Accession=PF01406.10; Description=tRNA synthetases class I (C)
MYVCGMTVYDFCHLGHARVMVVFDMVARWFRASGYEVTYVRNITDIDDKIIKRANENNESIQSLTQRFITAMDEDSAKLGIIRPDIEPRATEHVQGMLDMITQLINKGFAYQADNGDVFYKAKAWMICVPANVWMSTGISRIRSTSCYGSPPNPVSLTGSRHGAMAVLAGILNVR

SEQ ID NO: 129263 - protein, 131 aa, Glycine max
  Coding DNA Sequence Number=SeqID_37578
  Gene Ontology: Cellular component=integral to membrane
  Homolog annotation: Hit_ID=A7VFI4; Match level="QueryCoverage=80%, HitCoverage=25%, E-value=3e-10, Identity=30%"; Hit description =Putative uncharacterized protein
  Subcellular localization annotation: CTP_CleavageSite=37; ConfidenceScore=5.11e-01
FSPGSLLTNYQTYQGNPCGVYPDLSSFTGSGVYPDLSSFTGSGVYPDLSSFTGSGVYPDLSSFTGSGVYPDLSSFTGSGVYPDLSSFTGSGVYPDLSSFTGSGVYPDLSSFTGSGVIQTSVACIKRSTPTQ

SEQ ID NO: 129264 - protein, 213 aa, Glycine max
  Coding DNA Sequence Number=SeqID_37579
MTTLTQIWMTLLLSNIQPSDHNSDLPLPKCMPPTRHPLDPDKSNRAWGFPALITGLCQSFGVPVVPSKVIRPPITHVFIEKYCTARQAQGGDPQAPDAPLPPPQADPTGSFDTERYLRHLVRQQEANHRVHVQTHYSLYQLSLSLQSQGFVSFPCPTPDQFRAEVAWPGDWPEAQAGEAPAETPAEALSKADKAREDEEMTGLLDFLGGSGAT

SEQ ID NO: 129265 - protein, 102 aa, Glycine max
  Coding DNA Sequence Number=SeqID_37580
  Pfam annotation: Domain name=Transposase_23; Domain location=37-102; Score=-14.6; E_value=0.047; Accession=PF03017.5; Description =TNP1ENSPM transposase
MQSQGLALPPEPLVGPSGPRVSTKESCVDPSGNDPETGDSERCGLYIEANPTHLVALGKVYEGSTVVHNTPLLHVQVKVGVEEVKDPNAPVPVPTDEVSLMG

SEQ ID NO: 129266 - protein, 362 aa, Glycine max
  Coding DNA Sequence Number=SeqID_37581
  Gene Ontology: Mol. function=RNA-directed DNA polymerase activity; Biological process=regulation of transcription, DNA-dependent
  Homolog annotation: Hit_ID=A7PT07; Match level="QueryCoverage=74%, HitCoverage=17%, E-value=1e-54, Identity=41%"; Hit description =Chromosome chr8 scaffold_29, whole genome shotgun sequence
MEQENYTNKYLQVLGETIKTKVVPKQKSVEEASPSIPIEKPLFKPFKVSEKAKRKIRELRKTKSLVEGVGDNHSELLNKIGSLLKVIPDTSQTSENTSKMVTRSTSKLINVINEDSDQNSDNITELGSVSEKNINPINSKHWKTPSKLYYQRPAAFDLLLEERGENNFKIFSANNIYEWNIDAQMEYNITNTLQHMTMVAMAYQTSHECSKETIIDILVAGFSGQLKGCAVKTDLNEKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKIC

SEQ ID NO: 129267 - protein, 204 aa, Glycine max
  Coding DNA Sequence Number=SeqID_37582
MWMDRFALTLNGSQELPRLLAKAKAMADTYSAPEEIHGLLGYWKNTITKRATRHPYRTRSKSRTMGDQEETQEQMKADMSALKEQMASMMEAMLGMRQLMEKNVATAAAVSSATEADPTLLATARHPPSNIVGRGRNTLGHDGNPHLGYNRAAYPYGLLPNYSPPVLQDDAGHIASPVLEREPPQQPDEVHEDPQDYARRDVEF

SEQ ID NO: 129268 - protein, 18 aa, Glycine max
  Coding DNA Sequence Number=SeqID_37583
MGVVERSGKRIQEKGGIS

SEQ ID NO: 129269 - protein, 27 aa, Glycine max
  Coding DNA Sequence Number=SeqID_37584
DSVEILRRSSSFFTVLQPFFVRSSFFN

SEQ ID NO: 129270 - protein, 93 aa, Glycine max
  Coding DNA Sequence Number=SeqID_37585
  Homolog annotation: Hit_ID=Q2PEW8; Match level="QueryCoverage=87%, HitCoverage=20%, E-value=1e-19, Identity=53%"; Hit description =Putative uncharacterized protein
MVASPHYWGFGVESRGTTSKIPDPFAIEQGNPTKIKNGYEEKWLLNIMVIDTRGAQDKKACTQCRCDHMNLPKDFYNAEYTIPAGGGGEFILM

SEQ ID NO: 129271 - protein, 148 aa, Glycine max
  Coding DNA Sequence Number=SeqID_37586
MGVEFFFFKLFLDDAMVNQDIPQNRTKYWPAQHTVCDEHLPPSTKTPFPEDSNPWSPELSSPSSRAYTAGTWFPEFGGPLGSVHSPSSLFLHEKPSTGGMHIRYVAGFSCEDAGNGGRQGSQPRGPVIRGRSRSRGPSGREGLKVEFK

SEQ ID NO: 129272 - protein, 28 aa, Glycine max
  Coding DNA Sequence Number=SeqID_37587
MGESKKEEEEGKKAPDQGSKENRRNVQK

SEQ ID NO: 129273 - protein, 260 aa, Glycine max
  Coding DNA Sequence Number=SeqID_37588
MEDICKRWTEYLDSTRSRVNHPQSINCDFCGEEHFNDNCHLYSMKNSWWGQELYPYNQYEERTPNLESVFTKFTAYHPSSTANQNSMQNQEIQVGNSYSMENYQWEQELQPYNQYEEERTSNLDNLLMQFKEVTEYTQQAFKSFEIQVGKLAEEVTKFMARREENFIKVEAQEESPVRKHDSKEKDEDKSEEKAQQWEKYSQEERHGEHEKALSAILSLITSTSLAMIWKVLPEYMTFMESLARRQKYKEYVFFVTFMPP

SEQ ID NO: 129274 - protein, 56 aa, Glycine max
  Coding DNA Sequence Number=SeqID_37589
MTKARQKGVRKGKKGRWLPPSSPRRAGLLPPEGTAFCWKILEGPSGPDCYLYTLVY

SEQ ID NO: 129275 - protein, 107 aa, Glycine max
  Coding DNA Sequence Number=SeqID_37590
MVLQDTLYTSCSLQLQFFISILSCLVTALEAAAFPDVETIVWDMPLKQNFQTATAEVSVCGDSKILQVASRFQDVKTSHVTSAFCSPCLHAPTAVKQFTAASFYQLL

SEQ ID NO: 129276 - protein, 110 aa, Glycine max
  Coding DNA Sequence Number=SeqID_37591
MKHRKAHRVVKYLKLKRSDPSIELMQSYPARALDRRLQVDWAKDPREGPRVLMSLRLSSSFFRNLLKEASQGGELSYYRGCVAKLYLLKEVFSKKLFKEVFSRKLLKEAT

SEQ ID NO: 129277 - protein, 197 aa, Glycine max
  Coding DNA Sequence Number=SeqID_37592
NVLGRNILRERKVELYPTELDDFKIELERCNFHKRLTNLVDESIDLAFVKEFYANLYNSDGLSLKQARVRGHLVKVLAEGETLPTYSRYCKLPTDYREIEAVLCIPSRGFILNAEGHLGRILRKDLTTLAQVWSVLSYSNLAPTSHTSDLTMDRAMLIFGLVSRMDMNIEALISGQMTSIAQSSTSRVGFPALITAL

SEQ ID NO: 129278 - protein, 127 aa, Glycine max
  Coding DNA Sequence Number=SeqID_37593
  Homolog annotation: Hit_ID=A2Q1D6; Match level="QueryCoverage=70%, HitCoverage=14%, E-value=1e-09, Identity=40%"; Hit description =Ovarian tumour, otubain, related
MNEDQWMYDSIMSEEVDMNEQNKEEVGVKSKHVDCSNVFNTSQVFATRDDVLNWAQAVAYEIGVVTVIMRSNTNTGIRGKTLFVLIGCERSDQYRSRKKDFVRRDTSSSKCGCPFKLCGKPVVGGQE

SEQ ID NO: 129279 - protein, 264 aa, Glycine max
  Coding DNA Sequence Number=SeqID_37594
  Gene Ontology: Biological process=sporulation
  Homolog annotation: Hit_ID=A8GFF8; Match level="QueryCoverage=98%, HitCoverage=50%, E-value=1e-142, Identity=90%"; Hit description =SpoVR family protein
  Pfam annotation: Domain name=SpoVR; Domain location=1-207; Score =209.9; E_value=6e-60; Accession=PF04293.4; Description=SpoVR like protein
MEKNAPLLESWQREVLRIVRKVSQYFYPQKQTQVMNEGWATFWHYTILNHLYDEGKVSERFMMEFLHSHTNVVYQPPYNSQWYNGINPYALGFAMFQDIKRICQSPTEEDRYWFPDIAGSDWLKTLHFAMREFKDESFISQFLSPKVMRDFRLFTVMDDDRNNYLEIAAIHDEAGYRAIRQQLSAQYNLSNLEPNIQVYNVDLRGDRSLTLRYVPQQRAPLDKSRRDVLKHVHRLWGFDVNLEQQNEDGSVELLDRCPARGPAL

SEQ ID NO: 129280 - protein, 160 aa, Glycine max
  Coding DNA Sequence Number=SeqID_37595
  Homolog annotation: Hit_ID=Q84VH5; Match level="QueryCoverage=59%, HitCoverage=13%, E-value=2e-41, Identity=92%"; Hit description =Envelope-like protein
MWSQHSNILNNIDSVKKRESPLSLHYKLFEGTHVPDIVSTSGKAAATGAVSKDALIAELKDTCKVLEATIKATTEKKMELERLIKRLSDSGINDGEAAEEEEEAEEEEEAAEEEEEAAEEEEVQQRIQNQMMMILMLPHDHQTFIFAVILTSYWSVIFAH

SEQ ID NO: 129281 - protein, 81 aa, Glycine max
  Coding DNA Sequence Number=SeqID_37596
MGEGDGGNVELVGDVGGSSNDPIVESFDLDNLILVEPNDDAQSEEDLDDDGDGDESDDIHGDDPIRGWTWSLKTFVGFLVI

SEQ ID NO: 129282 - protein, 123 aa, Glycine max
  Coding DNA Sequence Number=SeqID_37597
  Subcellular localization annotation: CTP_CleavageSite=12; ConfidenceScore=5.07e-01
MTVTILGALSTSSASRPSRDGHFSGSNASSSGTDEYTDFQEEIVRRRWASLVTPMAKFDPDIVLEFYANAWPTVEGVRDMRSWVRGFCPDYCWETSADHAHQHDHPDQDLDDLAAQQHPAQRS

SEQ ID NO: 129283 - protein, 42 aa, Glycine max
  Coding DNA Sequence Number=SeqID_37598
MKVRDHHRYQPHSTKIAMAIPLHSDQPESREFQIEWHAPKYK

SEQ ID NO: 129284 - protein, 125 aa, Glycine max
  Coding DNA Sequence Number=SeqID_37599
MAPTRHPVDPEKSNRALGFPALVTGLCTVPVPPGKGSHPQRHPVDSEKSNRALGFPVLVTGLCSPTGCPFPPARSRHHDIGIAPARHPADPKKSNRVLELSSSNYESLSVLRSACHLQQGHQAPY

SEQ ID NO: 129285 - protein, 299 aa, Glycine max
  Coding DNA Sequence Number=SeqID_37600
  Homolog annotation: Hit_ID=Q6WAY6; Match level="QueryCoverage=78%, HitCoverage=40%, E-value=4e-09, Identity=25%"; Hit description =Putative uncharacterized protein
MGTKGCISYNPVLAIRQLGYPMRGAPLEEELAPVISRGFFKTNVETLQKVHKAWEVVQKKDRELWGSNNGPIGGYRKWLRAHVQGLDWLPSLRITKREEVEASEEDEEVQALRTKLKQAQTVKERFKSEALKIRKENAELRDINIATTKALEQETKRARREEHGQNKFRGALWGSNSELKLWREERDQSRVDSLILKDELKTETNTLAIISKYQAELNLATAHEHRVADEYAQVYAEKEARGRVIDSLHQEATMWMDRFALTLNESQELPRLLAKAKVMADTLLRPRGDPRTSRLIVSI

SEQ ID NO: 129286 - protein, 112 aa, Glycine max
  Coding DNA Sequence Number=SeqID_37601
  Subcellular localization annotation: CTP_CleavageSite=20; ConfidenceScore=5.24e-01
MEPKSRIDKYKIQQSSQPVVATYPSAGGRRVTRGMRVPRKEYARSRHQRLFEENVGKTGKDAIYELLSERFGSCIYARGRCFPLLLRIPQFGMRKSDLRSSFLSSDSFYFKR

SEQ ID NO: 129287 - protein, 250 aa, Glycine max
  Coding DNA Sequence Number=SeqID_37602
  Homolog annotation: Hit_ID=Q6WAY6; Match level="QueryCoverage=76%, HitCoverage=33%, E-value=2e-19, Identity=34%"; Hit description =Putative uncharacterized protein
MDGLVDLAAIDAFLAYHNHKESPVVTILADLYDTFDRRCEKSNTRIVCCTPALYVWLVSHLFRQEVRHACPLESHCSCTEKGRANWDQLLASKEGASINCFPRWKEGRTEVLISCRGFPNVPLMGTRGCISYNPVLAIRQLGYPMRGAPLEEEIVPKVHKAWEVLQKKDKELRGSNNGPIGGYREWLKAHVQGSDWLPSLRATKREEDEAPEEDEGVQALRTELKQAQTVKERFKSAALKIRKENAELRD

SEQ ID NO: 129288 - protein, 265 aa, Glycine max
  Coding DNA Sequence Number=SeqID_37603
MASRKRKAPSTPTQVRLERSRFTSQEAWERYTDIIVPRKFLPERNVVELYANPYDLEDKSPKQVRVRGHLIKFDEDTLNTFLKTSVIVEEGESLCAYSRFALLRPDPQELAAKLCVPGRGFELNADGKPLKILWKNITTLAQTWSVLSFSNLIPTSHTSDVTLDKAIPIYGIIMKMDMNAGYLISHQISLTTQDDTSRLAFPTLITTLCKARRVQSGSRSLESLSLTINLAYIKKNCWNLDDPIVTFRGPKKARGKRYEALSTAP

SEQ ID NO: 129289 - protein, 30 aa, Glycine max
  Coding DNA Sequence Number=SeqID_37604
MMGDAAKFTHISPKNSGHVTYGDNNKGIVY

SEQ ID NO: 129290 - protein, 119 aa, Glycine max
  Coding DNA Sequence Number=SeqID_37605
IYMSGIFGPDVLDIVSDIVDASILHLTFILPSSIFGQDVLDIVSDIVDPAASMLLAIPALPRTMPRRHELAGGNGRPVGPTEARNQRWKPQGPVGLLQVHWVSLWGEIGIAVAGQNVAK

SEQ ID NO: 129291 - protein, 271 aa, Glycine max
  Coding DNA Sequence Number=SeqID_37606
  Homolog annotation: Hit_ID=Q6WAY6; Match level="QueryCoverage=37%, HitCoverage=20%, E-value=1e-11, Identity=33%"; Hit description =Putative uncharacterized protein
DWDQHLAGIGDRTINWFPRWKEGNEGVLFSCGDYPNIPLIGTRGCINYNPALAIRQLGYPMRGAPMEESLSPFLVRDFGPLRKDKELRGICNGIIGGYHEWLKVHTRGLDWLFKLKIIDEEDFEALEEDEEVQALKTELGKVKLAKEKFKLVATNVRKECAKLREENAATARALEQETKRARKEEHGRDKFRGALWGSNSELKLQREERDQSRVHSMVLKEELAACSRSKRNLSQCLCETETNMLAIFSKYQEELNLATAHKHKVADEYAQ

SEQ ID NO: 129292 - protein, 261 aa, Glycine max
  Coding DNA Sequence Number=SeqID_37607
  Homolog annotation: Hit_ID=Q2HW90; Match level="QueryCoverage=75%, HitCoverage=39%, E-value=1e-24, Identity=36%"; Hit description =Putative uncharacterized protein
MQAFRKAYGNILDLTIAEISTEAVISLTQYYDQPLRCFTFGDFQLVPIVEEFEEILGCPLGGRKPYLFSGFLPCLSKIVVVVRDSARELDRVKQTRNGIVGLPRKYLEGKARDMANQEEWVPFMDVLALLIFGVVLFPNMDGLVDLAAIDAFLAYHHSKESPVVAVLANLFDTFDQRCEKSSTRIICCLPALCVWLVSHLFQQDIRHPCPLRSHRSCVKKRRVDWDQHLAGIGGRTINWFPRWKKGKEEFSSHVGTTQTSR

SEQ ID NO: 129293 - protein, 111 aa, Glycine max
  Coding DNA Sequence Number=SeqID_37608
MGSKWTLRKSRPSKNGPPQKVWEILGASMGYQASIEGSLGPSKMFLQKAVASGGSNLARLGELGGKLLPYFPINMGRSEGERGSALVVLRNHLKLVRKTIFVKKIQAEALP

SEQ ID NO: 129294 - protein, 167 aa, Glycine max
  Coding DNA Sequence Number=SeqID_37609
MRQYYMSTDVTFFEDTPFFSPSVDYSSSLQEVLPIPSPCPLDVSDQNVGVVPSSSPNSPEVVSSPLITDQPRTTQIGFPVPEASPRDSCSSLTSPPLMDPSTFSSHSNSHWPIAIRKDGSTLLKLGPMVRLIGLRLAWWLRATHSQTHHCSFVSCYGCHSSLAPLSA

SEQ ID NO: 129295 - protein, 36 aa, Glycine max
  Coding DNA Sequence Number=SeqID_37610
MSNIQSNLKKIQRGLRIVEHSMQYGKIGGGESCESL

SEQ ID NO: 129296 - protein, 167 aa, Glycine max
  Coding DNA Sequence Number=SeqID_37611
MDPKKSNRALGFPALVTGLCQSYRVPVPPARSCHRDIGIATTKTPSGPGEVQQGPGGSCLQDTQWTRRSPTGSWSCQALITGLCQFYGVPVTYSKGIRPPTNRAFIKKYCIPRQAQGETPQQPGDGQQRATDAPPSPLEFTSAHPKKVKALLTTHGRPIGDQVQSQK

SEQ ID NO: 129297 - protein, 102 aa, Glycine max
  Coding DNA Sequence Number=SeqID_37612
MTRGNPSDLQPFDPEIDRTFHRLVRHHIVPFEHPEHSVIGESEHFVVGNFEHPNFEHYSFEHFDFEHSENMAQPPPCERTLREMAAPDFTYESLCIQYHDED

SEQ ID NO: 129298 - protein, 242 aa, Glycine max
  Coding DNA Sequence Number=SeqID_37613
MGDPISRLSFPENIETFSSLTSYPELRRSEFLIGGYVGARASLLSTIPPFVAMTQELVARGDTLRLSAPRHSVTPSVIDEQRPIWSSTPFPEMSAFSDGDFSSLTNYLELRHVTCTLVSSRGGGPDDTRRYLTVIRTLLSSRGGGPDDTQRYLTVIRTLLSSRGGGPDDKPDDTRRYLTVIRTLVSSRGGGPDDTRRYLTVIRTLVSSRGGGPDDTRRYLTVIRTLLSSRGGGPDDKQRQNL

SEQ ID NO: 129299 - protein, 247 aa, Glycine max
  Coding DNA Sequence Number=SeqID_37614
MALSVVIMGWLRIHTRRVRLALQIEKEDEAVQALKLELGKARLAKEKFKSAATHIRKECTELQEENAVTARALEQETKRARKEEHGRNKFRGALWGSNNDLKLRREERDRSRVHGMILKEELAACARSKRSLAQHLEATEQSMLAIIGQYKEELNQSVTHEQKLAEDFAQVYAEKEARGRVIDALHQEATMWMDRFALTLNGSQDLPRLLAKAKAMAEVCTAPEEIHGLINYCQHMIDLMAHIIRNR

SEQ ID NO: 129300 - protein, 91 aa, Glycine max
  Coding DNA Sequence Number=SeqID_37615
MHVLYVGLVFCHGKPEGPYHLLNCIHGALRLQMHNIGDQNFPSLDYRVKPISCFYEKVHQVKLKYGSNHLAKIGAKDGSCYIVASSTVKHI

SEQ ID NO: 129301 - protein, 53 aa, Glycine max
  Coding DNA Sequence Number=SeqID_37616
MEIYASDRLGKSSCYHQKGGDCRSKLHDESRLIQGVLMITKMMTKSSKVKITS

SEQ ID NO: 129302 - protein, 69 aa, Glycine max
  Coding DNA Sequence Number=SeqID_37617
MEQVSIGHQNWGEFYRLFVAKFLPWLVFWFVLKVVFSIGCVEGMAVTAWVSPSSSPSSFAPVFSFVQAG

SEQ ID NO: 129303 - protein, 45 aa, Glycine max
  Coding DNA Sequence Number=SeqID_37618
MGISGLKEHSNQVTPKGYTPKSPSGPLPPDSGPTPKIILAHRHCS

SEQ ID NO: 129304 - protein, 144 aa, Glycine max
  Coding DNA Sequence Number=SeqID_37619
MLRKRYGSASAWIFFTKIIFLSNFERMRSAKKAEPFSSSLLPLFIAKIGEELATQLAQASKGCFPPEATTFWRKDLEGPTFEGVTETHGLRKNISFRFPPHHGISRIALACFLLISNTSWDFIYCATKDAKYLKAANRRLRVNK

SEQ ID NO: 129305 - protein, 117 aa, Glycine max
  Coding DNA Sequence Number=SeqID_37620
ARLLRYVTGSHWLTIPGLGRDWPSLVLGNVNHEDFDDIKKNLLEKEGDVNHASFDGVEKKSHVCHHQKAGECESLFQDSLKTKPCLKTKCFQDMQGSGNRLPGSVIDYPKTGLRNSC

SEQ ID NO: 129306 - protein, 331 aa, Glycine max
  Coding DNA Sequence Number=SeqID_37621
AQGLKVIQRIHKAWRSPLRKDKELRGIRNGVIGGYHGWLRIHTRGLGWLSKLKVVDEEKFEAPEEDEELGKARLAKKKFKSAATHIRKECTESQEENATTARALEQETKRAHKEEHGREKFRGALWGSNNELKLRREERDRSRVHGMILKEELVACARSNRSLAQHLEATEQSMLAIIGQYKEELNQSMAHKQKLVEDFAQVYAEKEARGRVIDALHQEATMWMDRFALTLNGSQDLPRLLAKAKAMAEEQMKADLSALIDQMASISEVMLKLQKTIEDKATATASSTVREAEPVLQPVLNPGRDRNTAVFGRRYSPQAYPYGLPPDFTPR

SEQ ID NO: 129307 - protein, 129 aa, Glycine max
  Coding DNA Sequence Number=SeqID_37622
MTCGDKFGHSAPFCHSDTVVSDGAQRQNLVILHPLSSRGGEPDDMRRQNMVIPHLFAIRRRSCPMAHRDKLWSFCALLSSRGGEPDDMRRQIMVIPHTFSPYGDNRIQCHAETNYGHFAPFVIQSRRAR

SEQ ID NO: 129308 - protein, 337 aa, Glycine max
  Coding DNA Sequence Number=SeqID_37623
MTKFDPEIVLEFYANAWPTEEGVRDMRSWVRGQWIPFDADAIGQLLGYPLVLEEGQECEYGQGRNRSDGFDEEAIAQLLCIPGQDFARTAAGRRVRIMHTNMTTLTQIWMTLLLSNILPTDHNFDLPLPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGPAGSFDMEQYLRHLVRQEAANHRAHVQTHDCLYQMSLSMQSQGFASFSCSTPDQFRAEVAWPGDWPEAQAGEAPPEAPGDGEEAHEDEEMADLLDFLGGSGAT

SEQ ID NO: 129309 - protein, 150 aa, Glycine max
  Coding DNA Sequence Number=SeqID_37624
MGGRGRAGRGRLRPARHGRCQRDRTGRRAWPGLHGGRQLPHHPALQQLRELRIGRGPAVAATGRRPGRAGGLATRSGTAVARAVARLAGRAQRTGIFSRHGRWRDGPGHARGPAPVPAKPGPGGRRLSHAGAAAETAALNAHPAALPGSG

SEQ ID NO: 129310 - protein, 102 aa, Glycine max
  Coding DNA Sequence Number=SeqID_37625
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=A4GGF2; Match level="QueryCoverage=90%, HitCoverage=68%, E-value=6e-21, Identity=90%"; Hit description=NADH -plastoquinone oxidoreductase subunit 7
MLELWKDIPTENLEIRCFDREKEPEWNEFEYRFISKKPSPTFDANFFIGMEKIAENRTIIQYLPYVTRWDYLATMFTEAITVNGPEQLGNIQVPKKSQVISE

SEQ ID NO: 129311 - protein, 72 aa, Glycine max
  Coding DNA Sequence Number=SeqID_37626
MPIGWTSQKSGADIQEEELTNLRSNLLQGGGDDAILPRKGPVTRAMSKRLQEDWARVIKEGPRVLMNLKVDF

SEQ ID NO: 129312 - protein, 173 aa, Glycine max
  Coding DNA Sequence Number=SeqID_37627
  Homolog annotation: Hit_ID=Q5NRP4; Match level="QueryCoverage=58%, HitCoverage=6%, E-value=5e-07, Identity=32%"; Hit description =Putative gag-pol polyprotein, identical
  Pfam annotation: Domain name=zf-CCHC; Domain location=132-149; Score =22.8; E_value=0.00053; Accession=PF00098.14; Description=Zinc knuckle
MKREKHASYSSHNSCKSLSEELRDYYEGRHRSHLRPHSHRRENERKPQEVNIKLPYFHGKHNVEAYLDWEIRVEQKLKRKSTLKSYGYHSYPKKDQGLGILGAAPSKPNDDKGKTIEKQPPKASMQEKTSSIKCFKCLERGHIISQCSTKKTMIMRSQDIYSSQDEATTSPSS

SEQ ID NO: 129313 - protein, 197 aa, Glycine max
  Coding DNA Sequence Number=SeqID_37628
  Homolog annotation: Hit_ID=Q6WAY4; Match level="QueryCoverage=85%, HitCoverage=30%, E-value=8e-22, Identity=36%"; Hit description =Putative uncharacterized protein
MGTNQNGKRFYQVKVKGLDVTSLKELGRLMGPLQRQAFRKVYGKILDLTAVEVFTEAVISLAHYYDQPLRCFTFGDFQMVPTVEEFEEILGCPLGERKPYLFSGFLPSLSKIAAVVGDSAKELDRMKQTRNDVVGLPRKYLEGKARDMASQEKWGPFADTLALLIFGVVLFPNVDSLVDLAAIDAFLAFHHSKESPV

SEQ ID NO: 129314 - protein, 200 aa, Glycine max
  Coding DNA Sequence Number=SeqID_37629
MERRAWSPVVETKGMNACFTSGSHTTWKPVPQWKDCFSGSWTGGSLKCPKEGRKNHKFACGRKRRRKGTGSTPIYPRAAPKPTPFAYQSNRVVPWKYTPPASSERVATEVDSLSAKVTNITGLSGITRSGRVFASPHSAELPSKGKAPMGQEPTDIATPSKEVDPPVGRGAEKKEGLQGKTVTLEEAQEFLRLIQQSEFK

SEQ ID NO: 129315 - protein, 146 aa, Glycine max
  Coding DNA Sequence Number=SeqID_37630
KHSQSNVYSTLLVAYGTPTKRVEHAISDWVDLEINSGVQHKPENPNESLETTNNNLQIAPSIMHSICCNLPFNGRATRGSWVCLPRKENAQSCHQRLFKENVGKTGKSRALRTLSVNGSGVVFTHGEGCFPCSYVFLNCDKEIRPT

SEQ ID NO: 129316 - protein, 153 aa, Glycine max
  Coding DNA Sequence Number=SeqID_37631
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q4VCL9; Match level="QueryCoverage=99%, HitCoverage=15%, E-value=1e-68, Identity=87%"; Hit description =Plasma membrane H+ ATPase
MAICFHRLSQQGAITKCITTIEEMAGMDVLCSDKIRTLTLNKLSVDKNLIEVFSKGDEKDYVILLAARASRTENQDVIDVAIVGMLADPKEARAGIREVHFLPFNLVDKRTPLTYIDSDGNWHRSSKGAPEQILNLCNYKEDVRKRVHGMINN

SEQ ID NO: 129317 - protein, 130 aa, Glycine max
  Coding DNA Sequence Number=SeqID_37632
  Gene Ontology: Mol. function=RNA-directed DNA polymerase activity; Biological process=RNA-dependent DNA replication
  Homolog annotation: Hit_ID=A5AQZ7; Match level="QueryCoverage=93%, HitCoverage=18%, E-value=1e-09, Identity=25%"; Hit description =Putative uncharacterized protein
MAGAGDDGGDYHQLDRSQRLLLDAMTTQMQCLLNRNNEELYRRIEGLKHQMKWQNIIEGVKLNVPPFKGRSDLDAYLDWEMKIQHVFSCNDYTKEQKRYVPTSYNRTMRQKLQRLSQGRLTVEEYYRRWR

SEQ ID NO: 129318 - protein, 229 aa, Glycine max
  Coding DNA Sequence Number=SeqID_37633
MEINEESSALYKNGNIVVELPVFKLVVVIIWHIESKRSSSGTSSSSAINKKSSGEHLWSLVNFLSHLKHSPFSHRVVIFSGNNHLKGIGGCLVGVGSRGEEGWIVEVVPELMLVLTLMVALEPSQRRSNSARKVLSASGVLVSRQSGLPMPKGVVILEELGYLEDPTHRIQAIESQNLQLHAMLANRQFCGHGILGCSELDLGGGYGSKLFVDDGCSAAKIANLKGQWF

SEQ ID NO: 129319 - protein, 20 aa, Glycine max
  Coding DNA Sequence Number=SeqID_37634
MEKFGEGCKGHGVGKGRVRL

SEQ ID NO: 129320 - protein, 206 aa, Glycine max
  Coding DNA Sequence Number=SeqID_37635
MGFNQLASSSSGKTLEATYCQLLRPFQMYSMLSHVFKKGKMITSFEFRNVIGNAKGQVSPQSLIHGSRKGSNGLNRCIPLTTRSFQNTIKVRYHQLSSFFMSFLREGSARSSDGKFLSSEVRLIGESSNDDPTHLHNNFDTTSDQVSSVHAGDVSLVVAWLTLTWVLSLMWVVPPLRKGFAFTLACILLLWRMISNPLSQILLKIS

SEQ ID NO: 129321 - protein, 94 aa, Glycine max
  Coding DNA Sequence Number=SeqID_37636
MTPYKALHGRRCRTPLCLLETEENLTLGLEVVQETTEKKNDDLGERKRNRTKTVQVEASNPFSVSLTFGNSIGEVRGKNLRNLREPLEMLLSLA

SEQ ID NO: 129322 - protein, 183 aa, Glycine max
  Coding DNA Sequence Number=SeqID_37637
MSCLVIIIPTFLCRSVSWCMPPTRHPLDPDKSNRALGFPVLITGLCQSFGVPVTPSKVIRPPITRAFIEKYYMPRQAQSDAPQAANAPPPPHQADPVGSLGMERYLQHLVRQQAANHWGQGQGFAPFACPTPDQFRAEVAWPGDWPKAQAGEAPAGAPGDPEEACMDEEMTNLLNFLGESGAT

SEQ ID NO: 129323 - protein, 94 aa, Glycine max
  Coding DNA Sequence Number=SeqID_37638
MATPNAPLGQQWDVPGAIPAMGDLLGVDLRHEFSAEAEEQGRRQRARRNPDRQARRVMGLCYELGLGLWVRVRVRVYEFILGRRVYELGLGVMG

SEQ ID NO: 129324 - protein, 69 aa, Glycine max
  Coding DNA Sequence Number=SeqID_37639
  Subcellular localization annotation: CTP_CleavageSite=53; ConfidenceScore=5.63e-01
NGARKMLSNHVSFSAAPLRALFEGTSPSNMSNDSSQCTNLGPITARPSTLMPRCRATSSSVIVHLPHGR

SEQ ID NO: 129325 - protein, 129 aa, Glycine max
  Coding DNA Sequence Number=SeqID_37640
MNITSLMKIPLYDFTKKTWMILVSMRIKSCFITKIAKVMMRVLPYQHHQPRCPVELNLDPIQNDASFPLWLYNFGNTIVEDHASALGNTLNLKTSMFEMGNENPTRVGNDGINSFGSSSIGFHAMEPNI

SEQ ID NO: 129326 - protein, 198 aa, Glycine max
  Coding DNA Sequence Number=SeqID_37641
MVSTVWRWILHENRLDEVTLVSDMPRDIIFQERHLIHTLVSVSPENLVTATVHCLDVEKLNQMYEGRILSTAMKYFWISGLQVDVELKSPFSYMDLSPEKVIIFLFKLFRHSFSTTIHMLIADQIIGIHNKFQKLEEVCPAMEKQITKWTKVLLSSERLLGFSCSAFRTSMFNPGTNSKSGRWYPVGLAQMEQWIALL

SEQ ID NO: 129327 - protein, 576 aa, Glycine max
  Coding DNA Sequence Number=SeqID_37642
KMGPAPDTIDLEGYDDVRAILKPKGSNSKDCRSTVKSHGKVASLTIKKGHMSEDEVDEDYKFFLLTYDPHIDVVSDSDVDGSDDDINIGHNNDHNDHPYREEESLHNNPKLDKGSKQRDETGNQRNKGSDSVGKQTSGSMKAKQNLEAKRVLSKKRLHEDVSGVPKNNAQTNKELDIVDEDYQIFLNSCRDDYIPSELIEKQNLEAKRGLSKKRPHENVSGVPNNNAQTNMELDIVDEDYQIFLNSCRDDYIPSELIEKQNLEAKRGLSKKRPHENVSGVPNNNAQTNMELIVVDEDYQIFLNSCRDDYIPSESIGKQNLEAKRGLSKKRPHENVSGVPNNNAQTNMELIVVDEDYQIFLNSCRDDYIPSELIGKRSNVIQNSLVSDYVLSEVDEDYLQYLNSVLIVDGEVGCRPERNTSKTDNVDGDSNSSEPDVILLEPDQIHENTPFVSSKTYDSSWFETEKNPKDNWQLPAYGNSQFRRRLMNDLQRPYDQEECDRLLLEGVLLNVKTMRAGPKPPEPVASLVSLSKSSASMAIRACRDQIASWNGDMHRCLGTASQTGEFHGLRVQARFQA

SEQ ID NO: 129328 - protein, 95 aa, Glycine max
  Coding DNA Sequence Number=SeqID_37643
  Subcellular localization annotation: CTP_CleavageSite=48; ConfidenceScore=5.11e-01
MVSRGSAEQSQMKITKRRCVESWWIRRSYASRPSLPPLPRCCLLLCRRAVTVSSSSLQLFYSQSLPLCCVRARKGMEQTSDVVHWEKGKIGRKRT

SEQ ID NO: 129329 - protein, 78 aa, Glycine max
  Coding DNA Sequence Number=SeqID_37644
MTKVLQRALLRASEARLTGALSKGGKMRGVATNVYLWKTSEKPKVDKSGAFAPTYPPSKRKSDLRSSSLCVNQVILFT

SEQ ID NO: 129330 - protein, 158 aa, Glycine max
  Coding DNA Sequence Number=SeqID_37645
  Homolog annotation: Hit_ID=A5AWR0; Match level="QueryCoverage=91%, HitCoverage=15%, E-value=5e-13, Identity=32%"; Hit description =Putative uncharacterized protein
MTTGPSFLHWDESCDELLGKLPPDNAHKGAALKLTWLLSILRAPLPNEPTIHQLQCRCRAYIMYMIGGALIPDKSGNRVHLIELCETSSEVGRVMGGCAILLRSWAWYYMPFIASRILRPKTTYSLAKRWSSGRLKHRDTPHGDLIGYGSRIDHMENH

SEQ ID NO: 129331 - protein, 120 aa, Glycine max
  Coding DNA Sequence Number=SeqID_37646
MDDFSAHEDQELFHHNNRQSDDEGAAAPTSPPLQYHQPRCPVELNLDLIKNDASFPLWLYNFGNTLVEDHASALGNTLNLKTSVFEMGNENPTRAGNAGINSFGSSSIGFHAMEPNIQHF

SEQ ID NO: 129332 - protein, 373 aa, Glycine max
  Coding DNA Sequence Number=SeqID_37647
  Subcellular localization annotation: CTP_CleavageSite=23; ConfidenceScore=5.15e-01
MEKAACFPSLSLGAMLSSHSCCMCRLVSPSLLALLTFGILKLRMCAQRACLAERELVTERLADANVLSARSDKGLTGQAGCMLSVLLSEFTFSRVLLSLGSKTTLSDLHKFMLFHLMEKLPFDLPHATYISILRNLKGLGGLNNIYYATLINKLLWDQEFSKTNLKAMKVDLEHSLKEAHLVDLDAINKRKQKSLVNAIFDKDQGLNNFGLRKSNQSQNLGHLSSFLLFQDVSRHDYEHTPSKAFKALSLDVISFTMDSSSAAQLCQDVFPLARTWNSATSSTIYGDQAIAYPPGLYISRATDIKMVADKVSLCLPIWDVAKKNGFKLYYIEDMPTRNMKAEWKGFDSKSECVWMENDDDNEGVQVGLKAGLE

SEQ ID NO: 129333 - protein, 132 aa, Glycine max
  Coding DNA Sequence Number=SeqID_37648
MAIEGFTIGGERKNGGNKNKNIERKGRAQAWNDKRIALRKDRALSARCRLSMCFCWITRLACGSRLARVTDSASSSLTPRLAPMLLYSLSAWRALSARVGLGLLQTSSFSSLPVAFLLNVTSIFVSTTKNSI

SEQ ID NO: 129334 - protein, 113 aa, Glycine max
  Coding DNA Sequence Number=SeqID_37649
MGHKDSCWMLSMLKCVEAMPSKAILMMPKNQESSKFQRFKNEVFKNQGTSTWVVVTENKRWYISCGSVQVEGTSTWLFKENKGGYIPCGSLLVKDFTRLKRNLKDRRSLGYWM

SEQ ID NO: 129335 - protein, 40 aa, Glycine max
  Coding DNA Sequence Number=SeqID_37650
MNENGYPVLESQEELATWTAAKQKEYKQNKQNDAKALLFI

SEQ ID NO: 129336 - protein, 340 aa, Glycine max
  Coding DNA Sequence Number=SeqID_37651
  Gene Ontology: Mol. function=oxidoreductase activity; Cellular component=cytoplasm; Biological process=metabolic process
  Homolog annotation: Hit_ID=Q8LJR2; Match level="QueryCoverage=98%, HitCoverage=97%, E-value=0.0, Identity=89%"; Hit description=Alcohol dehydrogenase 1
  Pfam annotation: Domain name=ADH_N; Domain location=26-132; Score =49.2; E_value=1.5e-11; Accession=PF08240.3; Description=Alcohol dehydrogenase GroES-like domai
  Pfam annotation: Domain name=ADH_zinc_N; Domain location=163-305; Score=130.4; E_value=5.4e-36; Accession=PF00107.17; Description=Zinc- binding dehydrogenase
  Pfam module annotation: Pfam domain module=ADH_N::ADH_zinc_N; Domain location=26-132::163-305
MRAAAVAWEAGKPLSIETIEVAPPQKGEVRLRILFNSLCRSDVYWWDAKGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGI

SEQ ID NO: 129337 - protein, 34 aa, Glycine max
  Coding DNA Sequence Number=SeqID_37652
MAVESDEDSVKLEEVEAKNLGNMEIMEQTVRIMD

SEQ ID NO: 129338 - protein, 258 aa, Glycine max
  Coding DNA Sequence Number=SeqID_37653
MTTFTGDTQTASGTGEFGVLEGTANTIGDIGIHGNRQSNCFFREREVATAIGELRASCNSHWRVRAEGIVIPDGDLGPLYTRKLFQCYCVFTNKVDVHDLLVHDEFGYNSVVFQWTGSKKVIQIKHGISFNALKKKNWRQGKYIALQICDDEDVETMLESFKQQQEMSVLELYIEKDVTGGSMFHYANSLTSCENYLSNDETQPPTNMSNLHLDEDDDDDYLVSNSYVEESLDEDDNVDGISDTDNEVTEFKYIQKFK

SEQ ID NO: 129339 - protein, 80 aa, Glycine max
  Coding DNA Sequence Number=SeqID_37654
MATTKPLITIKEKFLLSAYDYFFRVEVGVSVGLVKYSIEGDKATMYSGRYVTSNDTMRAQRDERSGECVEDEIRECEWTP

SEQ ID NO: 129340 - protein, 29 aa, Glycine max
  Coding DNA Sequence Number=SeqID_37655
MEEKVTSTWEASLRSKEGSFLGKLGRKLP

SEQ ID NO: 129341 - protein, 845 aa, Glycine max
  Coding DNA Sequence Number=SeqID_37656
  Gene Ontology: Mol. function=transferase activity; Cellular component= chloroplast; Biological process=metabolic process
  Homolog annotation: Hit_ID=A7NVI4; Match level="QueryCoverage=99%, HitCoverage=80%, E-value=0.0, Identity=63%"; Hit description =Chromosome chr18 scaffold_1, whole genome shotgun sequence
  Pfam annotation: Domain name=NAD_kinase; Domain location=636-845; Score=33.2; E_value=2.2e-07; Accession=PF01513.12; Description=ATP -NAD kinase
SNDPSQLSWMGPVPGDIAEVEAFCRIFRNSERLHSALMDALCNPLTGECSVSYEVPSDEKPQLEDKIVSVLGCMISLVNKGREDILSGRSSIINSFRAAEVSTTDDKLPPLALFRSEMKRCSESLHVALENYLIPDDDRSLNVWRKLQRLKNVCYDSGFPRGEGCPCHTLFANWNPVYLSAASKDDSESKDTEPAFWTGGQVTEEGLKWLLDKGYKTIIDLRAETVKDNFCQAALQDAISSGRIELVKIPVEVRTAPTMEQVVQFASFVSDCSKRPIYLHSKEGVLRTSAMVSRWRQYMARSSSQIVSNPPVTPYDMLLCNTNGSAKSWDSSMTAERSSLEKDINSLQESLNSTHNSVGTFDRSTSQKKYNGKPQGTTAMSKVSTDNRELSEATAAKEERSFPRNFSKINPLKAQVPPCDIFSKREMSKFLGSQKISPPSYVNYQSRRSECSPQPRNMNVTRLQGGVTVSTSDNLIPKIVGSESSNGSARVDHPSRETQITVSDNWEVVNGSISSSVWTTVNGFSEQEMHYMTNANASNIVKDDFDNVTTNSQRIEDRMVKDRLALNDDDMGSVEGDMCASSTGVVRVQSRKKAEMFLVRTDGFSCTREKVTESSLAFTHPSTQQQMLMWKSMPKNVLLLKKLGEELMEEAKMVASFLYHQEKMNVLVEPDVHDIFARIPGFGFVQTFYSQDTSDLHEKVDFVACLGGDGVILHASNLFRGAVPPIVSFNLGSLGFLTSHDFEDYKQDLRQVIRGNNTRDGVYITLRMRLRCEIFRKGKAMPGKVFDILNEVVVDRGSNPYLSKIECYEHDRLITKVQGDGVIVATPTGSTAYSTAAGGSMVSLC

SEQ ID NO: 129342 - protein, 75 aa, Glycine max
  Coding DNA Sequence Number=SeqID_37657
MDGCERIDERSRGIFYHGPTMGAKCSYQNLELWHVRVDVVEWGPELHMSAWRGAIDRRGDLQNRGLQCSRIVVAL

SEQ ID NO: 129343 - protein, 177 aa, Glycine max
  Coding DNA Sequence Number=SeqID_37658
MVRTRGLPRALGSGTGRGMGQDEHDDDVPRHRRPTASARRQRVQVDVAEEVPQVTKDVPPQVTEDVPDVIADVPHVDEDIPTADVDVADVVADGAEGSPAEHGKGFPGGPHDTSLLTSFVDHERHELKVVSHGRKVDKFGSSAPEIEGLVAGTRLSSLIGCSMVTGDPELIYAFVER

SEQ ID NO: 129344 - protein, 293 aa, Glycine max
  Coding DNA Sequence Number=SeqID_37659
  Gene Ontology: Mol. function=metal ion binding
  Homolog annotation: Hit_ID=A7NVK0; Match level="QueryCoverage=30%, HitCoverage=35%, E-value=3e-18, Identity=55%"; Hit description =Chromosome chr18 scaffold_1, whole genome shotgun sequence
MGPKSTLRLIRTLGPSLAYLAQSTWSFLSNALAGNDVILNDYINNGNTTFKVKEKMTLIAVKKPFDLAVGNTSKDHSHDHWGNVVLKHLYHSLGNDNGGMKWCIREALMSCPKISCAPTMKETLKIVKDGQECSPQLESLFYRLQSEANGHENVVHNGFSSESNGRDTTEGCQRVFRDILASEKFSSLCKVLLENFQGTKPETVFDFSLINSRMKGQAYEQSPTLFLSDVQQGISSEQFIDKELEILVGSMFECQVPPFPSNKVPKGNSEERNAIQRNGCLMVEMYRDANWED

SEQ ID NO: 129345 - protein, 125 aa, Glycine max
  Coding DNA Sequence Number=SeqID_37660
GKGKGDYLTSTADPPSKSNPNPTRNWKLVDQHHELENRSKLYVLFNCKGNLGQHQGNLLNLVNTSEFFKIKASLHPPARIKQKRSHDGMGNQGPLSEGEDSALHVNQNQGNDGRPWKGRPSCDLF

SEQ ID NO: 129346 - protein, 121 aa, Glycine max
  Coding DNA Sequence Number=SeqID_37661
MARTRSLGRAIDRLVGRDRHDDHDVADVPERHRPTASACRLRVHQMTAEGRDMAEDVADMTDDVPKLAAEAPEMRADVEGADGAEGSDADDAAEGFPDRPRDPSVLTSFVEHVAHAVWSGQ

SEQ ID NO: 129347 - protein, 455 aa, Glycine max
  Coding DNA Sequence Number=SeqID_37662
  Gene Ontology: Mol. function=nucleic acid binding
  Homolog annotation: Hit_ID=Q53P91; Match level="QueryCoverage=20%, HitCoverage=9%, E-value=1e-09, Identity=34%"; Hit description =Transposon protein, putative, mutator sub-class
MASKGGSWRSPMVKEELGVLGEGIGFSIAIHSMGSWVMNPTLKWGGKEENVYHDLDMGTWSFLEVVDLIHDLEYFVIDGLKMWWKGFDVNNETLRDLSNDQDSMDLARYALSHKCEIDIYVVFRESDYEEVTEDEVRGELTEGEELFKDQQILVFDHGVDDLFDWDSVMAFDDNDEPSRKQNELRVKSKVSNKGKQKDSGYEDPFVENPSQCDEDPNWMDDDSMTNPPHEEPNTNFKEMHDLETGNETEELYSDVESKDDTTKPGKRFPMFRGKKLSKAFKWTLGMQFTCLQDFKEGMMEYFVLNGYQTENKESWKWFLNELLAGIGDFETHKWVFISDRKKGLVKAFHETDDRIEHRLCAYEEKMNQIKEINNKVYDWLTDEFPKNAWCKHAFTTYSKCDVAQVIGSKIPATGNTVEASGFEAQAVGSKIPTVGNTFEDGGFEAQVTGSEIPTA

SEQ ID NO: 129348 - protein, 71 aa, Glycine max
  Coding DNA Sequence Number=SeqID_37663
MGGAVTLLDIPVTYARQGDLDTYCVVFLSESVVWIQLGYFLGDGTTLHLRVENDSSKVQEVRFFYGAAEPT

SEQ ID NO: 129349 - protein, 206 aa, Glycine max
  Coding DNA Sequence Number=SeqID_37664
MSRGSGDLGDVRWGAIAQNQAWPIPTQPGHSQPVRTCDVPQQASFWQSTNKGTKVHEAGRLIVMAAQLIHDRVVMVCLEGVWETLKGDERCRFRGTVRLTATSLVHPKQPARTLQQLMEWILPTPVEWILVEPVQLIEVSSSEEDLEEDPEELSPEPAMDAPDLPEDDEDQLPDVDSPEDIMPASEADSTEESGPGGTANSDDSSS

SEQ ID NO: 129350 - protein, 76 aa, Glycine max
  Coding DNA Sequence Number=SeqID_37665
  Subcellular localization annotation: CTP_CleavageSite=26; ConfidenceScore=5.09e-01
MKYPKRVHMTLSLRKTRQQVSSSSCRAQATPPHGDQPESQGSFKPRDKSPSTSIFPHEKLRVLTDKVCTISMQYEV

SEQ ID NO: 129351 - protein, 90 aa, Glycine max
  Coding DNA Sequence Number=SeqID_37666
MYIKYGPKYIVKYSQQNMLSNETKPPTYSQNNSKAPEFLKVKEASTRIKPRLLCKQSMGQNTPNDYDDGSNSHKGKLITFKLSFQNYHDM

SEQ ID NO: 129352 - protein, 129 aa, Glycine max
  Coding DNA Sequence Number=SeqID_37667
MDCPLWMLWSMKCNICGVKIKSAEPVERGAGSGICVDGGTVEEEGDGASDGAEVEGASDLLPLAFLGPLKVTVGSSRFQQFFLIYAKLMAGLRLSRDLESDYTPLALHKVVIKAWNPSLDVSCCAMREI

SEQ ID NO: 129353 - protein, 97 aa, Glycine max
  Coding DNA Sequence Number=SeqID_37668
MKDDVLLDEEDIAVEEVVAEGQRATEKGDDACCHTLISSGDLCLMACDLCLVLVRPTWALQKIPPEGCCFWRKQPGSPGRAELAWASWAASISPILL

SEQ ID NO: 129354 - protein, 302 aa, Glycine max
  Coding DNA Sequence Number=SeqID_37669
  Homolog annotation: Hit_ID=Q69V30; Match level="QueryCoverage=68%, HitCoverage=22%, E-value=3e-07, Identity=27%"; Hit description =Hydroxyproline-rich glycoprotein-like
  Subcellular localization annotation: CTP_CleavageSite=62; ConfidenceScore=5.74e-01
MTLSSWQNKLNRKMVTPPNSPPPPTGAASQSRSTLKQTRKAIWLRSLATRPVGAERPLVHVDTMTGKADSPHRKKLRTYLGIIARDKAEFDIPEALDPRTKKKILQTMGERWRQFKSDLTSKWALAADKESVEDTVCEKYDISKKKWAPILSDLQRPPFVGDVRKKTHVIQKQNTAPHEAAQFGSTDTAIDPSSLIRRHMKWKMACTKKTGQMMFEVAKEIVEKIASRGSFVAHGRQDVLTAAIRQPEHPGHVRSARASVMIKKYFGPTPRTSHTSSSMAPEDLEQLMQKIRDQLEESITEK

SEQ ID NO: 129355 - protein, 151 aa, Glycine max
  Coding DNA Sequence Number=SeqID_37670
  Subcellular localization annotation: CTP_CleavageSite=22; ConfidenceScore=5.06e-01
MKMNTKVKVNATVIPAPRKSVKRMMLETMVGFLARLCFTSNSKYQLYDANDSDLKSPSKKPNSASTPSPTACGVKEDFFELTNDKEEEDVIAEHWYEDEHGARPVLEWGLFYIGCVAITDNGCGFYIGLHSTDVEWVGMGAVSTSVISQPM

SEQ ID NO: 129356 - protein, 124 aa, Glycine max
  Coding DNA Sequence Number=SeqID_37671
  Gene Ontology: Mol. function=carbohydrate binding; Cellular component= 6-phosphofructo-2-kinase/fructose-2,6-biphosphatase 1 complex; Biological process=fructose 2,6-bisphosphate metabolic process
  Homolog annotation: Hit_ID=Q93XR7; Match level="QueryCoverage=66%, HitCoverage=11%, E-value=1e-30, Identity=76%"; Hit description =Fructose-6-phosphate 2-kinase/fructose-2,6-bisphosphatase
  Pfam annotation: Domain name=PGAM; Domain location=21-121; Score= -18.3; E_value=0.077; Accession=PF00300.13; Description =Phosphoglycerate mutase family
MFDVSLSVSTWLQDVVHDEKSLYLAQLVSEGRQSEAGELYSKKLAKFVGKCLKSERVTSIWTSTLERTILTATPIIGFPKIQWRALDEINTGVCDAMAYAEIKKNMPEEYEYVCRLVISLLFAS

SEQ ID NO: 129357 - protein, 165 aa, Glycine max
  Coding DNA Sequence Number=SeqID_37672
MKGFRIRAFSIFPLLNPPPLQRGQNWSAAIAAAIEVLGIGVYFIAAGWNMIGGLSKGPGTIVDDWKFDYSSHDARRMVCNDQADMTVSKEDLILMWAFLTGRQNDWAHFLRYRMNKALGANAPLPYPQLVTLFLSHFQIPLDDEPFVQVKRSFAIGAGAVTSFGY

SEQ ID NO: 129358 - protein, 78 aa, Glycine max
  Coding DNA Sequence Number=SeqID_37673
MPLAQSEGKSYGIEDPTVLVLCDLGSIKPDKVGPDVCVGGVRGHVGVGPRWRPSEIHARKRKKAGTKGMEWLPLRRGL

SEQ ID NO: 129359 - protein, 259 aa, Glycine max
  Coding DNA Sequence Number=SeqID_37674
  Subcellular localization annotation: CTP_CleavageSite=34; ConfidenceScore=5.04e-01
DLLTAAIGQPKHPGRVPAAGANVTIKQYFGLAPRNSHSSSFMPPEELEQLTQQIRDQLEELITEKGFAMPPEPEVGPSATHVSTKGSCVDPSPTDPEMGDSVKYGLYIEDNPSLLVKDAEAPVPVPTDEVIFVGQALNTFHAWPTHLVKRPSEQAAVSQQNLQICGILPCSGPDNYLKGIINSVLKGLDDTPQPKSKDGARWIIVKCYRQKGTTECGYYIMHWMSTIILGTFKNNWETTIGSREIEGASHPTGIVLSQS

SEQ ID NO: 129360 - protein, 139 aa, Glycine max
  Coding DNA Sequence Number=SeqID_37675
MEPKFAKQAFTNPSPPCSLPFIWQLLFQEQRCYTIKRIPNIGRHSAVSDLEYLTSSCIPQNKTMALSKQENGAPNNHCRLAATVQTNTIKPTGINVKATSRFAHVPKSRQSGMGTYGACANPNTNLNGSLSEEDTVSEG

SEQ ID NO: 129361 - protein, 109 aa, Glycine max
  Coding DNA Sequence Number=SeqID_37676
MRSFNGDFPPWIRSGRQRRRGEKRRHPLGNKPWKKELHHQECALDKKLEVDALMEEKKDRRGEHEIEGIKEGEKLKFELCLTRLSFIKFIISVTHASIYRLGSFLEKLS

SEQ ID NO: 129362 - protein, 316 aa, Glycine max
  Coding DNA Sequence Number=SeqID_37677
  Homolog annotation: Hit_ID=A5AKA7; Match level="QueryCoverage=45%, HitCoverage=28%, E-value=1e-08, Identity=31%"; Hit description =Putative uncharacterized protein
  Subcellular localization annotation: CTP_CleavageSite=44; ConfidenceScore=5.74e-01
MAESSKKRKGSSASASASSAHRSGATSASTAPIPSSLSSSPLFSSDEQQKRYSNLFSSRSIIDPKFIDMEFFSDETFDCIQAFQNLGTLNYDWKFDFSSHDARQLVCTNNADMTGRLLAGSLAFESRILHYLIVRILLPRSSNLAQVSEEDLIIMWAFHTGRQLDWAHLVRYRMHKALRLNAPLPYPQLVTLFLRHFGIPLDSESYIPIKRSFLIGAAVIASFGYRKEHDGSWVKKGAQPADDEGSLPVEDNFTLLRRLMDKFDGLQTFVGDKFDAMELQVDMRFDAMESRITKVEEDVSFIRTCFDPRPPPPSSS

SEQ ID NO: 129363 - protein, 94 aa, Glycine max
  Coding DNA Sequence Number=SeqID_37678
MALGKVYDSLSTIHNVPYAEDVVRVSVVKVYHSDAQLPFLTSEIQFVRQVVGTFVGWSTHLMKPVSNEDSQKRLPKRVTSAEMDNAMAVVDPLK

SEQ ID NO: 129364 - protein, 19 aa, Glycine max
  Coding DNA Sequence Number=SeqID_37679
MSTSSGRDYFSLTSLKNYI

SEQ ID NO: 129365 - protein, 55 aa, Glycine max
  Coding DNA Sequence Number=SeqID_37680
MELASVHLLGLLTENKRGYISCGSVLVEGTSTRLFKENKGGYIPCGSLLVKGFLQ

SEQ ID NO: 129366 - protein, 76 aa, Glycine max
  Coding DNA Sequence Number=SeqID_37681
MARGLRTSSGSGRIHELALGESSLPRLEPMPRWALPARRVEVGAGAWGASLWTSTGALGCTGAKLEESSVRAKKLE

SEQ ID NO: 129367 - protein, 159 aa, Glycine max
  Coding DNA Sequence Number=SeqID_37682
MAPTRHPLDPDKSNKALGFPALITGLCQSFGVPVAPTKVIRLPITRTFIEKYCPQRQAQGDAPQAAGAPPPPHQAGPAGSFDMEQYLRHLLSLSMQSQGFASFLCPTPDQFRAEVAWPEDWPEAQAGEAPPEAPDDGEEAHEDEEMADLLDFLGGSGAT

SEQ ID NO: 129368 - protein, 68 aa, Glycine max
  Coding DNA Sequence Number=SeqID_37683
VPGDMSRGSGDLGDVRLANCEFCVIYGLWPLVIDYQGLENEVVEASGNRLPVCVIDYTEEWVTGNRLP

SEQ ID NO: 129369 - protein, 117 aa, Glycine max
  Coding DNA Sequence Number=SeqID_37684
VLAEPGIGVQRVVVRAHQHQNADAVAALQPAAFYQLIHRAAQRVAIDLVTFGQLLFRRQVVAAAVLRAQLLFQLRGDLLIAGGMTIALRRGGEQMNYLGQPGRARAAAARYAGAIVD

SEQ ID NO: 129370 - protein, 59 aa, Glycine max
  Coding DNA Sequence Number=SeqID_37685
MKTLKTTVDGKADQAAPQWIEAKSHVQNGGYECGYYVMHWMWNIVSGGLKNDWAMAYLL

SEQ ID NO: 129371 - protein, 81 aa, Glycine max
  Coding DNA Sequence Number=SeqID_37686
MPSIYLFLKICVFIVPELDASLSVERPSFDGLQTLLVLNSPETMDARRRSGAGSFGREVPPISCCGELPRWNFLPGQHLES

SEQ ID NO: 129372 - protein, 174 aa, Glycine max
  Coding DNA Sequence Number=SeqID_37687
DGFPEEIAFKTRGADDSFKDMGRGSRFKKKNLTEAPAAAYDNLRFPLPTGEYKTKRKAGQLIGKPIDRAPKQGMMGASYFHLLGVGAEKSSSYRSLFEPQRDRQWDGTTGFLDSEVAGFLKGARPSVRPRGDPTSLEPGAGDAAWLVEACDAKKTGLECRLQYKTSSAVLFRLA

SEQ ID NO: 129373 - protein, 303 aa, Glycine max
  Coding DNA Sequence Number=SeqID_37688
  Gene Ontology: Mol. function=3-octaprenyl-4-hydroxybenzoate carboxy -lyase activity; Cellular component=plasma membrane; Biological process=ubiquinone biosynthetic process
  Homolog annotation: Hit_ID=Q0TAL3; Match level="QueryCoverage=99%, HitCoverage=60%, E-value=1e-165, Identity=92%"; Hit description=3 -octaprenyl-4-hydroxybenzoate carboxy-lyase
  Pfam annotation: Domain name=UbiD; Domain location=14-303; Score =349.2; E_value=6.8e-102; Accession=PF01977.7; Description=3 -octaprenyl-4-hydroxybenzoate carboxy-lyase
MINCMKYHDLRDFLTLLEKQGELKRITLPVDPYLEMTEIADRTLRAGGPALLFENPKGYSMPVLCNLFGTPRRVALGMGQEDVTALREVGKLLAFLKEPEPPKGFRDLFDKLPQFKQVLNMPTKRLRGAPCQQKVLEGDAVDLTKIPIMQCWPEDAAPLITWGLTVTRGPHKERQNLGIYRQQLIGKNKLIMRWLSHRGGALDFQEWCAAHPGERFPVSVALGADPATILGAVTPVPDTLSEYAFAGLLRGTKTEVVKCISNDLEVPASAEIVLEGYIEQGELAPEGPYGDHTGYYNEVDNFP

SEQ ID NO: 129374 - protein, 178 aa, Glycine max
  Coding DNA Sequence Number=SeqID_37689
MEANAVTVSATRVVAKVNPMPPSGLNQMNHPTSDMVGKDLGSTDGPYYVQIQNKNAFPPYGLPPNYTPPNVAYTPSENANNSTPILIESRQPQTDHAHVSQTMGETHEIPHHNLADFEPCLRYATEEQAVGGIPLQNTLEGHQYHPQPHPLHSTVGKNPHAMAKNGKVGSSRGKAQSH

SEQ ID NO: 129375 - protein, 229 aa, Glycine max
  Coding DNA Sequence Number=SeqID_37690
MAPRKLASKRSRKDKAVEGTSSAPEYDSHRFRSAEHQQRFEAIKGWSFLRERRVQLRDDEYIDFQEEIVRRRWASLVTPMAKFDPNVVLEFYANAWPTEEGVRDMRSWVRGQWIPFDADALSQFLGYPLVLEEGQECEYGQRRNQADGFDEEAIAQLLCIPGQDFARTAAGRRVRFMRTNMTTLTQIWMTLLLSNIQPSDHNSDLPLPKCQLVYAILTWISIHVAQVDR

SEQ ID NO: 129376 - protein, 75 aa, Glycine max
  Coding DNA Sequence Number=SeqID_37691
MKILTMSRRIKNLLEKGENVNHASFDGVEKKSHVCHHQKGGECESLIQDFFKIKPCLTMKGLKSFKAHVIDYQYM

SEQ ID NO: 129377 - protein, 78 aa, Glycine max
  Coding DNA Sequence Number=SeqID_37692
MYRDAILPRKGPVTRAMNKSLQEDWTRVAKEGPRVLMNLRHGGELSYWRGVSSPPLASQGSFLPCFPRKLPSFIVFLA

SEQ ID NO: 129378 - protein, 78 aa, Glycine max
  Coding DNA Sequence Number=SeqID_37693
MSGSGEHQLDRVQRFLLDALNAQMQKLLRENNEELYERIERLENRERHEEERRGENGGGPRPNRIEGVKFNIPPFKAK

SEQ ID NO: 129379 - protein, 50 aa, Glycine max
  Coding DNA Sequence Number=SeqID_37694
  Homolog annotation: Hit_ID=Q2HW89; Match level="QueryCoverage=60%, HitCoverage=3%, E-value=2e-07, Identity=83%"; Hit description =Integrase, catalytic region; Ribonuclease H
MTMITPSSKLTLTKGNKSWAFSGGALVLTNMDGEELPSPVNSDVVKQYYA

SEQ ID NO: 129380 - protein, 100 aa, Glycine max
  Coding DNA Sequence Number=SeqID_37695
MDRYFNNASFTYIHAFHWLHCPLHSFLENQTVIIVIKPKECTLRCPYQMRARARVMGEVEEVQEHIKADMEAMQEQMATMMEAMMSMKKIMEVNAAAVAT

SEQ ID NO: 129381 - protein, 377 aa, Glycine max
  Coding DNA Sequence Number=SeqID_37696
  Gene Ontology: Mol. function=glutamine-tRNA ligase activity; Cellular component=cytoplasm; Biological process=tRNA aminoacylation for protein translation
  Homolog annotation: Hit_ID=Q5PCH8; Match level="QueryCoverage=100%, HitCoverage=67%, E-value=0.0, Identity=83%"; Hit description =Glutaminyl-tRNA synthetase
  Pfam annotation: Domain name=tRNA-synt_1c; Domain location=1-160; Score=81.1; E_value=3.6e-21; Accession=PF00749.12; Description=tRNA synthetases class I (E and Q), catalytic domain
  Pfam annotation: Domain name=tRNA-synt_1c_C; Domain location=162-351; Score=336.6; E_value=4.5e-98; Accession=PF03950.9; Description=tRNA synthetases class I (E and Q), anti-codon binding domain
  Pfam module annotation: Pfam domain module=tRNA-synt_1c::tRNA-synt_1c_ C; Domain location=1-160::162-351
MASSFIVMRDPVLYRIKFAEHHQTGNKWCIYPMYDFTHCISDALEGITHSLCTLEFQDNRRLYDWVLDNITIPVHPRQYEFSRLNLEYAVMSKRKLTQLVSEKIVEGWDDPRMLTVSGLRRRGYSAASIREFCRRIGVTKQDNIVEMASLESCIRDDLNENAPRAMAVLDPLKVVMENLPAGHEEIISMPNHPNKPEMGTREVPFSREVWIDRADFREEANKQYKRLVLGKEVRLRNAYVIRAERVAKDEAGNITCIYATCDVDTLSKDPADGRKVKGVIHWVSAIHALPAEFRLYDRLFSVPNPGAAEDFLTTINPNSLEIKQGFVEPGLRAASALAPYQFEREGYFCADSVYSQPSKLVFNRTVGLRDTWAKIGE

SEQ ID NO: 129382 - protein, 342 aa, Glycine max
  Coding DNA Sequence Number=SeqID_37697
  Homolog annotation: Hit_ID=Q6WAY6; Match level="QueryCoverage=87%, HitCoverage=61%, E-value=3e-33, Identity=30%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPPRGKKTISFIRVSPLFEQNCNCGQGFSKRYLEDKARGMANQGDWVPFMDVLALLIFGVVLFPNVDGLVDLAAIDAFLAYHHSKESPVVAVLADLFDTFDRRIDWDQLLAGIGGRTISWFPRWKEGKEGVLFSCGGYPSIPLIGTRGCINYNPALAIRQLGYPMRGAPMEESMSHFLVRDFGAQNFKAIQRIHKAWETPLRKDQELRGIRNGIIGGYHEWLKVHIRGLDWLAKLKVVSEESFEAPEEDEE

SEQ ID NO: 129383 - protein, 161 aa, Glycine max
  Coding DNA Sequence Number=SeqID_37698
  Subcellular localization annotation: CTP_CleavageSite=52; ConfidenceScore=5.76e-01
AMATPPASPPPSLPPPPADTSASPSTLKRTRKATRLRSLATRPPGAKRPVVNVDPATGKADGPHKKKLRTYLGIVAHDKAEFEIPEASDSRTKKKILQIVGERWRQFKSDLTRKWALAADKDDVDDIVCEKYGISKEKWAQFCQTRRDPSWEDVRKKAQAS

SEQ ID NO: 129384 - protein, 211 aa, Glycine max
  Coding DNA Sequence Number=SeqID_37699
  Gene Ontology: Mol. function=transcription factor activity; Cellular component=intracellular; Biological process=regulation of fatty acid metabolic process
  Homolog annotation: Hit_ID=A7FI94; Match level="QueryCoverage=100%, HitCoverage=99%, E-value=2e-90, Identity=71%"; Hit description=Fatty acid metabolism regulator protein
  Pfam annotation: Domain name=FadR_C; Domain location=72-209; Score =257.6; E_value=2.7e-74; Accession=PF07840.3; Description=FadR C -terminal domain
  Pfam annotation: Domain name=GntR; Domain location=8-71; Score=88.7; E_value=1.8e-23; Accession=PF00392.12; Description=Bacterial regulatory proteins, gntR fam
  Pfam annotation: Domain name=TrmB; Domain location=31-75; Score= -12.5; E_value=0.074; Accession=PF01978.10; Description=Sugar -specific transcriptional regula
  Pfam module annotation: Pfam domain module=FadR_C::GntR::TrmB; Domain location=72-209::8-71::31-75
MVIKAQSPAGFAEEYIIESIWNSRFPPGSILPAERELSELIGVTRTTLREVLQRLARDGWLTIQHGKPTRVNDFWETSGLNILETLARLDHDSVPQLIDNLLALSEEDQAEAYTELDYRVFRGLAFASGNPIYGLILNGLKGLYTRVGRHYFSNPEARELARNFYRQLADLCGKQPTQDQIVDSVRNYGRRSGEIWHSMQKSMPDDLSSKR

SEQ ID NO: 129385 - protein, 110 aa, Glycine max
  Coding DNA Sequence Number=SeqID_37700
MYVTVSLGCSLTFKARRKDGLVNHEDFDDVKKNFLDKGAECGSSIVLMMSKRNHLIAIIKKEENVKQQNSGNSKFKSHDPSNYNCAIDYTNIVIGYQRRVFKKSANSHIV

SEQ ID NO: 129386 - protein, 118 aa, Glycine max
  Coding DNA Sequence Number=SeqID_37701
MATQLIHDRVEMECLEGAWETLERQHERTVEWILPTPTPYRLVEPVQVIEVTSSEEDPEEDLEELPPEPAVDALDFLEGDEDPLHEVDSPEDVMSASEADSTEDSGPREMAASGGSSS

SEQ ID NO: 129387 - protein, 152 aa, Glycine max
  Coding DNA Sequence Number=SeqID_37702
  Homolog annotation: Hit_ID=Q6WAY4; Match level="QueryCoverage=94%, HitCoverage=26%, E-value=5e-13, Identity=32%"; Hit description =Putative uncharacterized protein
MGSSQMPSLKRRFSQVKVKSLGTTSLKELGQLMCQLQRQAFRKAYGKIWDLAMVEVSIEAIASLAQYYDRPLRCFTFGDFQLSPMVEEFEEILGCPLGGRKPYLFLGFYPSLARISKIVQISAQELDHRKQVENGVVGIPRKYLEAKARILA

SEQ ID NO: 129388 - protein, 211 aa, Glycine max
  Coding DNA Sequence Number=SeqID_37703
GAPLRGTIVDDMKFDYSSHDACRMVCINQADMTDRLLVGSVTFDCCIMHYIIVRILMPRSSNLAQASEEDLILTWAFLTGRPINWAHLIRYCMHKALRSIKRSFAIGAGAVTSFGYRKDMDGQWLKKDAQPPQDERTPSPPPQRDDSSALMHEVFSELRGLHTYFVECFDSLDDRIDAIDARFEGMDTRITQLEEDVSYLRRCFDLPPPPS

SEQ ID NO: 129389 - protein, 134 aa, Glycine max
  Coding DNA Sequence Number=SeqID_37704
MPKGTALALPRRVSPWLLEDERQQPCLNFSTSHIGRIRVGSRRQYCAGSRRSACLPLPLLALERQKVAFWPYRPRRALPPHRAHRRQLRSNFLDGPYIGSDIFAGRAVTARRRCLQPAFSAEWTWKARRSSVPQ

SEQ ID NO: 129390 - protein, 105 aa, Glycine max
  Coding DNA Sequence Number=SeqID_37705
MDPWVLVTLTVERTTRPRLERTTRPHHQRVARPRLERTTLPHHQRLPSPLKGLHVLALRGVHVLALRGLHVLTIRGLHALTSRGLHVLALKGLHALTLGTSYPHR

SEQ ID NO: 129391 - protein, 39 aa, Glycine max
  Coding DNA Sequence Number=SeqID_37706
MTKNLPQRCRALLVCNEIMVLDQEPIEGDTIGNGVRKSW

SEQ ID NO: 129392 - protein, 145 aa, Glycine max
  Coding DNA Sequence Number=SeqID_37707
  Pfam annotation: Domain name=zf-CCHC; Domain location=74-91; Score =31.8; E_value=2.4e-06; Accession=PF00098.14; Description=Zinc knuckle
MKLQRLNQNEETDKRKRSIALKASSSMQEEEEYDDEEDFSLFVKKFHKLIKNRRMERSHNFNNGKRYQEVSPTLKCYKCNQLGHIKANCPSNESWPEKNEKKSYKERRSKKAYIAWDDNDSSDGLEKEIILLSKDYESDENISQE

SEQ ID NO: 129393 - protein, 175 aa, Glycine max
  Coding DNA Sequence Number=SeqID_37708
QGLGILGGAPSKPEDDKGKTIEKQPLKANIYSSQDEATTSPSCSEREESKGEESSEEIYPQEEGQPLMVKEECKEVIVSSKRLAKKESHFTIKTNIKETSPLRQPPHFLLCKKTHVSIATPLGLEFIPQEKELLDEGVPMNPKRIKIIPEWLTPPTPLIELVRNHVPSWEDAQEM

SEQ ID NO: 129394 - protein, 348 aa, Glycine max
  Coding DNA Sequence Number=SeqID_37709
  Gene Ontology: Mol. function=motor activity; Cellular component =flagellin-based flagellum basal body; Biological process=ciliary or flagellar motility
  Homolog annotation: Hit_ID=A1JSW7; Match level="QueryCoverage=74%, HitCoverage=74%, E-value=1e-119, Identity=84%"; Hit description =Flagellar motor switch protein FliM
  Pfam annotation: Domain name=FliM; Domain location=1-146; Score =215.1; E_value=1.7e-61; Accession=PF02154.6; Description=Flagellar motor switch protein FliM
  Pfam annotation: Domain name=SpoA; Domain location=282-348; Score =87.7; E_value=3.8e-23; Accession=PF01052.11; Description=Surface presentation of antigens (SPOA) protein
  Pfam module annotation: Pfam domain module=FliM::SpoA; Domain location=1-146::282-348
IQPYHEFARNLPVPTNLNLVHLNPLRGTALFVFAPSLVFIAVDNLFGGDGRFPTKVEGREFTPTEQRVIKRMLRLALDAYGDAWSAIYKIDVEYVRAEMQVKFTNITTSPNDIVVTTPFQVEIGALSGEFNICIPFAMIEPLRELLTNPPLENSRQEDSQWRETLVKQVQHSELELIANFVDIPMRLSKILKLQPGDVLPIDKPDRIIAHVDGVPVLTSQYGTLNGHPMSDPKQPSGAGKESVDDLWADALNEQQSSEKSSATTDGVFKSLEAQDALGSLQDIDLILDIPVKLTVELGRTKMTIKELLRLSQGSVVALDGLAGEPLDILINGYLIAQGEVVVVADKFG

SEQ ID NO: 129395 - protein, 127 aa, Glycine max
  Coding DNA Sequence Number=SeqID_37710
VWRYRHPLDPDKSNRALGFPALITGLCQSFGVPVAPSKAANHRAHVQTHDCLYQMSLSLQSQGFTSFLCPTPDQFRAEVAWPGDWSEARAGEAPAEAPAEAPDEADEAREDEEMADLLDFLGGSGAT

SEQ ID NO: 129396 - protein, 103 aa, Glycine max
  Coding DNA Sequence Number=SeqID_37711
MTNTNCTDNRLGISVRHLTSWVRMTEGAEDEVSLRVSMEIVCADNHLGISARHLNSRVKMTETICTDNRLGISACHLTSRVRMTEIAEDDESLHVSTGSLAPD

SEQ ID NO: 129397 - protein, 117 aa, Glycine max
  Coding DNA Sequence Number=SeqID_37712
  Subcellular localization annotation: CTP_CleavageSite=30; ConfidenceScore=5.00e-01
MYPLLFSVTTTHVDVPSTCTTKDVPSNVLRQSSQAGEGKHKRIQAVSPSGILLEKGEKNEKMNSTSFQGLENQKTSESFWYKEEEEVQRDSRLVKDCNEMIGKVFKIVEMQNKALLL

SEQ ID NO: 129398 - protein, 32 aa, Glycine max
  Coding DNA Sequence Number=SeqID_37713
MGESLFHIKNIKINRENKFTNPHQYLFYETCR

SEQ ID NO: 129399 - protein, 130 aa, Glycine max
  Coding DNA Sequence Number=SeqID_37714
MGDQEETQEQMKADMSALKEKIDSMMEAMLGMRQLMENNMATAAAVSSAAEADPTLPATAHHPPPNAIGREKSTLGYISNPHLGYNWVAYPYGLPPNYTPPVVRDDAGHVTSPILEGEPPRQPDEVHEDH

SEQ ID NO: 129400 - protein, 95 aa, Glycine max
  Coding DNA Sequence Number=SeqID_37715
  Subcellular localization annotation: CTP_CleavageSite=46; ConfidenceScore=5.47e-01
GLSAHPPLSAASTCLARQKNLAGHQYQGRAPSMSARLALSSNPLTLAKREGGAKRNVMNSEIIQSLAQNSIAHHIAYFGKRALKAARGATFAEIP

SEQ ID NO: 129401 - protein, 94 aa, Glycine max
  Coding DNA Sequence Number=SeqID_37716
  Homolog annotation: Hit_ID=A5C2Q1; Match level="QueryCoverage=82%, HitCoverage=15%, E-value=6e-29, Identity=78%"; Hit description =Putative uncharacterized protein
MQPYIAALKFCHLTGNLLIGTSDGCIKAWNVDAKRVVCDLNTTEAFPSVLDIKCSPVEPIFVSAAASGGAGSNYIDNLGFASLTVWNMKTWKAM

SEQ ID NO: 129402 - protein, 39 aa, Glycine max
  Coding DNA Sequence Number=SeqID_37717
MEAMKDQMAAMMEAMMSVKKIMEANAVAIAIAATSVVAK

SEQ ID NO: 129403 - protein, 47 aa, Glycine max
  Coding DNA Sequence Number=SeqID_37718
MTEARQKGGRSLPPSSPRRAQLAQASIVASSRSNSLLEEESGRPKWA

SEQ ID NO: 129404 - protein, 76 aa, Glycine max
  Coding DNA Sequence Number=SeqID_37719
MKENVFSSPSALLLSIFHLVYGFLDYGCGGDPWFSANLSVLKALGLLSTRRLAQRACLTEREVSHPLSELAISLSG

SEQ ID NO: 129405 - protein, 142 aa, Glycine max
  Coding DNA Sequence Number=SeqID_37720
MVILRLLSSRGGGPDEIREPFGPALFHLLSSRGGGPDDMRRQIMVIRTLLLSRHIMVILRPLSFRDSESRGGRRQIMVIPHTFSPSRGDRVWWHAETNYGHFVPCHPGSIVAEGTKRQIMVILRLVSTERNEFDSIRMMCRY

SEQ ID NO: 129406 - protein, 38 aa, Glycine max
  Coding DNA Sequence Number=SeqID_37721
MARPARDLNALSARCGAERNYEGPLAFLSSPVVSPQWP

SEQ ID NO: 129407 - protein, 104 aa, Glycine max
  Coding DNA Sequence Number=SeqID_37722
MTEGCGEGFCLANLPVFPCARGSGFGPWLGLGKPLVENFAPRSTSWFLPVVGLARVGGAGLWPRAKFRIGFVGDLEGRDESKRQGLNLSGSWQQGHFATYNTPS

SEQ ID NO: 129408 - protein, 173 aa, Glycine max
  Coding DNA Sequence Number=SeqID_37723
MEAMKDQMATMMEAMLSMKKIMESNAVAVATTNAAAEVDPTHPSGVNQMSRSVPDAVGQGGEALGSTSDPHVVQSKNSFPPYDLPPNYMPPNVVHMPDENADHSAPVPLESQQPHAHFSQPTLGAREEPQDHALADFEPYPGYATEGLAFGGMPQSNTSRGPQHRPLQPLHFS

SEQ ID NO: 129409 - protein, 54 aa, Glycine max
  Coding DNA Sequence Number=SeqID_37724
MRQVAGGYTQVIIRTKTTSVDPDPCVRWQADIPKYFLSSRDDQVDDAQRTHSTV

SEQ ID NO: 129410 - protein, 86 aa, Glycine max
  Coding DNA Sequence Number=SeqID_37725
MTCGEPFGPTLFLPLSSRGGGPDDMRGNLMDSTPDSTQRLTSSSVPFVIQGQRVRWWVEIPYGHPRLSSIEGNEFDGIGMILVVRC

SEQ ID NO: 129411 - protein, 160 aa, Glycine max
  Coding DNA Sequence Number=SeqID_37726
  Subcellular localization annotation: CTP_CleavageSite=40; ConfidenceScore=5.02e-01
HLSPVINLAYFRKNCWNPDDLTVVIRGARRARPRPVDLPSTSAVVAPPGSIPSIEQFLERVAWPGAQPSLHREDEGPTTQEVAATSERSREVTSDPPIPVVDLSSPQHAIDPSTPILEIPEDLTTPVLTLNTSPPATPVLHLTDEEDVQTQDTQDQSQEF

SEQ ID NO: 129412 - protein, 115 aa, Glycine max
  Coding DNA Sequence Number=SeqID_37727
IIRHQVPKIGGMMNVLSGATLFCKITHAPNIFVICVHRDPLGSDQRVPMNPKRIKVIPEWPTPPSIRKIWGFHDLTNFYKRCRGKEPEYEEPRDLRSNPFQGGGNDAILSRKGIG

SEQ ID NO: 129413 - protein, 132 aa, Glycine max
  Coding DNA Sequence Number=SeqID_37728
VVVSPVKPPPKPDPEVDDPLYLMTLTIPELFLRPYQVIWDATVFKVFNPNFPLYIKHEDLSEIAHGGQCLSISVLQLNLTETCMRVGNSDIYGFLEPQSIQRYGQSQFESESYIKTWMQSSKCNVYLGAYLN

SEQ ID NO: 129414 - protein, 83 aa, Glycine max
  Coding DNA Sequence Number=SeqID_37729
MEDAPVSPRVALPQKGRLRQSPPPLGPHNHLQTHLKLSGRLPLPALVSVDLHTTNSLKLSDSSSRLAEECCAQQMARYANKLA

SEQ ID NO: 129415 - protein, 126 aa, Glycine max
  Coding DNA Sequence Number=SeqID_37730
MYSLDFRIVIIKKGEIVEAIPSKIILMMPKNQESSKFQRIKSQGGFKIQYQDSRFKNNQDQDSRFKNNQDQDSRIKIQDSSKESRLKIQESREDSIKISIKRVFQKLLNSTILFKRKFLPKSFTLW

SEQ ID NO: 129416 - protein, 129 aa, Glycine max
  Coding DNA Sequence Number=SeqID_37731
  Subcellular localization annotation: CTP_CleavageSite=85; ConfidenceScore=5.52e-01
MTLLLSNIAGPATATPISPCKSISWSVSSRHGDRTHKTPSGPGKVQQGPGVSSSGYGPLSVLQGARTPPARDRTCKTPSGPEEVQQEYLQPPARASGPLLIELSSRSTASLGRRRAKHHSSIGMDGSGQ

SEQ ID NO: 129417 - protein, 212 aa, Glycine max
  Coding DNA Sequence Number=SeqID_37732
MERSTIDAASGGALGDMTPAEARNLIEKMASNSQQFSARNDAIVIRGVHEVATNSATSSETKKLEGKLDALVNLVTQLALNQKSVPVARTFALPCNNLEQLSSPKLMLLIFTIDLLNLSSKINHSRKIMTSPATDTTLDGGITLISGWSSPQQQQQQPAPSFQNAAGPSRPYIPPPIQQQQQPQKQPTVEAPPQPSLEKLVRQMTMQNMQFQ

SEQ ID NO: 129418 - protein, 153 aa, Glycine max
  Coding DNA Sequence Number=SeqID_37733
  Homolog annotation: Hit_ID=Q6UUU1; Match level="QueryCoverage=77%, HitCoverage=100%, E-value=7e-22, Identity=47%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALCPAFRFTGVIPLYGAFVSFHALTLSS

SEQ ID NO: 129419 - protein, 88 aa, Glycine max
  Coding DNA Sequence Number=SeqID_37734
KIGGEACHPTHPGELCSPRRARWLPLEATAFWRNLLESPSGPGCYLHPLMQSYPARALDRKLQVDWARDAREGPRVLMSLRVDFGPMG

SEQ ID NO: 129420 - protein, 92 aa, Glycine max
  Coding DNA Sequence Number=SeqID_37735
MWFNFERLDILCSLIEHPSEKLRPLEFLDGDMTKSKGKDPLEGLGGPMTRARARKAKEALQQVLSILFEYKPTFQGEKSKVVSCIMAQMEED

SEQ ID NO: 129421 - protein, 67 aa, Glycine max
  Coding DNA Sequence Number=SeqID_37736
MGLGQNNDGMESLVEFTENRRRFGLGYKPTRADVRSDNDSYEGNDTEDLDVNFEQPVNQAEDEEDED

SEQ ID NO: 129422 - protein, 194 aa, Glycine max
  Coding DNA Sequence Number=SeqID_37737
MIDQGRLVVGDEGKEEQHICMQSADERSFGRPKPLVIYFTMDAASQKPRYPSVAKPGPFPYQNSHAVLWRYAPPNERKEEATDIGLLSAKVTNITGLSGVTHSGRVFAPPDLATQPANVKGKAKMVEEQNDKTTLTLDEDIPTKGLPNKRDGCGKKEVSLEEANEFLRFIQQSEFKVIEQLNKPRPKSLFWNYS

SEQ ID NO: 129423 - protein, 62 aa, Glycine max
  Coding DNA Sequence Number=SeqID_37738
MAPYEALYGRRSRTPLCWVDVNRRLPGYGKLKSSVGSSLGNWSDSDDLDRTGLSCRTITRNQ

SEQ ID NO: 129424 - protein, 204 aa, Glycine max
  Coding DNA Sequence Number=SeqID_37739
MTGRLLAGSLAFESRILHYLIVRILLPRSSNLAHVSEEDLIVMWAFHKGRQIDWAHLVRYRMHKALQLNAPFPYPHLVTLFLQHFNIPLDSEPYVLIKRSFLIGAVVIASFGYHKEHDSSWVKKGAQPIDEEGHLHDGEDVSLLQKILDRFDGLQTFVGKRFDTLELQVDMRFNEMESRIIKVEEDVSYIRTSFDLPPPPPPTS

SEQ ID NO: 129425 - protein, 140 aa, Glycine max
  Coding DNA Sequence Number=SeqID_37740
MLATGNRLLPSGNRLPESKNSLGGYIHLVVQREQGRAHPLWIFACKGFYKVIGNLKNRWLLRDWICNPCKPHPIESDVAPSNARVSTKESCVDPFGQDPDIDTSDRCGLYVNDNHPRLVALERVYEGSSIVHHVPLANDM

SEQ ID NO: 129426 - protein, 153 aa, Glycine max
  Coding DNA Sequence Number=SeqID_37741
  Gene Ontology: Mol. function=chitin binding; Cellular component =extracellular region; Biological process=chitin metabolic process
  Homolog annotation: Hit_ID=UPI00006A17C9; Match level="QueryCoverage =83%, HitCoverage=98%, E-value=1e-08, Identity=31%"; Hit description =UPI00006A17C9 related cluster
  Subcellular localization annotation: CTP_CleavageSite=74; ConfidenceScore=5.15e-01
MLVRMIRTRLFAAAWVKSCPGMHSSCVIASLSGCACTVGPPPILGGGPGTVRMWSTLKMRTRSPLKVRACNPLKARMYSPLEVRVCSPLKVRACSPLLARTCSPLKVKACSPLLARTCSPLKVRACSPTKVRTCSPLMARACNPLKVRTRSVL

SEQ ID NO: 129427 - protein, 301 aa, Glycine max
  Coding DNA Sequence Number=SeqID_37742
  Homolog annotation: Hit_ID=UPI00016621D1; Match level="QueryCoverage =39%, HitCoverage=37%, E-value=2e-08, Identity=31%"; Hit description =UPI00016621D1 related cluster
MPFAFTGLHVLTFRGQHLLAFRGLHALTLRGLHSLAFIGIHVLAFRGLHILACRRLHALAFRRLHALAFRRLHVLTIRGLHATRPRHERTTLSSLKGLHLLTLEGCTPFAFRLHALTFRGLHVLGFTPFEGCTPFAFRGLRPHFEDYTTTRPHLQRTTRPHLQRTTCPLLERPACPRLQRTTRPHVLAFRELHILTLRGLHALAFRGLHILAFRGLHILTFRGLQVLAFRGLHVLTYRGLNVLAFRGLHVLTFRGLHVLAFRGMHALAFTGLHVLTLRGLHLLAFRGLHVLTFIGLHLLAF

SEQ ID NO: 129428 - protein, 239 aa, Glycine max
  Coding DNA Sequence Number=SeqID_37743
DGKSDDMRRYLMVICIFCQLEASELVDTQRLTSSSAPLSSRDGESDDMRRYLMVISTFCQLEASEPANTQRLTSSSAPLSSRDGEFDDMQRYLMVIHTICQQEASDPIDTDGKSDDKRRYIFGQLEASEPVDTQWLTSSSAPLSSRNGKFDDMWRYLMSDDMRRYLMVIRSFCQLEASEPVDTDGKSNDMRRYLMVIHSFIQLEASEPVDTDGKSDDMRRYLVVICTFCQLEASEPFET

SEQ ID NO: 129429 - protein, 100 aa, Glycine max
  Coding DNA Sequence Number=SeqID_37744
MSVEQFIRKVAWPGARPSFVGDNEKTRSNEAAHPGPVLVPADVPFPGMDPSSPQHAIDSSTPILEILEGHTTPVLALDTSPPATSVLHLTDKEDVQAQEF

SEQ ID NO: 129430 - protein, 106 aa, Glycine max
  Coding DNA Sequence Number=SeqID_37745
  Pfam annotation: Domain name=G-patch; Domain location=4-34; Score =5.6; E_value=0.04; Accession=PF01585.14; Description=G-patch domain
MVTSPEMGLGKDNGGITSLISAKGNRGKFGLGYKSTQADIKKGIIGRKSRGQGSRLGQEVKRGPPCHISRSFISAGLGHEGQVVAICEDDLPSGSAGYDHALLVFD

SEQ ID NO: 129431 - protein, 82 aa, Glycine max
  Coding DNA Sequence Number=SeqID_37746
MTRVTFLPSPSKGSLLDILMRSTRIIENMLRETSTPTPHFPLRGWHPTHYLNPTSRENLETTQRSQWFGDYPFVDMTGLCLV

SEQ ID NO: 129432 - protein, 80 aa, Glycine max
  Coding DNA Sequence Number=SeqID_37747
MNENAIHGAPKKGLRMENCTKQSLRMAPNSKNGELHYAITTHCSKLEGGRRMNENTIHGSEKGLRMENCTKQSLRMAPNS

SEQ ID NO: 129433 - protein, 33 aa, Glycine max
  Coding DNA Sequence Number=SeqID_37748
MDNHSGISACQGQYDRNCGAADKSEALAPTYAQ

SEQ ID NO: 129434 - protein, 78 aa, Glycine max
  Coding DNA Sequence Number=SeqID_37749
MMESLSTKQSIARNSSRNLDTLGKLKTLGATPMSTSYYLDKDESGQPVDAKQYRGSALVSMNARSKDNIIRDRKPFCT

SEQ ID NO: 129435 - protein, 141 aa, Glycine max
  Coding DNA Sequence Number=SeqID_37750
MRLQQHLPLVKVKKQRGKNQPQQIYPQEEGQPLMVKEEGEEVLLGTKSLKIGGMMNALSGATLFCKITHAPNIFMICVHRDPLGSDQGVPMNPKRIKVIPEWPTPPSVEGRSPEYEEPRDLRSNPFQGGGNDAILSRMGIG

SEQ ID NO: 129436 - protein, 55 aa, Glycine max
  Coding DNA Sequence Number=SeqID_37751
MDKSLKVREDEWRERERKGTKFMPQMRCLFYPIKISAQNAKYSSHGGIKNTVCQN

SEQ ID NO: 129437 - protein, 211 aa, Glycine max
  Coding DNA Sequence Number=SeqID_37752
MARRKLSSKISRKDAAVAGTSAAPEFDSHRFRSAEHQQRFEAIKGWSFHRERRVQLRDDEYTDFQEEIARRHAVSQFLGYPLVLKEGQECEYGQRRNRADGFDEEAIAQLLCIPGMSPTRHPLDPDKSNRALGFPALIMGLCQLFGVPVTPKKYCTPRQAQGGDPQAPDAPPPPHQADPAGSFDTERYLRHLVRQQAANHRAHVQTHDCLY

SEQ ID NO: 129438 - protein, 131 aa, Glycine max
  Coding DNA Sequence Number=SeqID_37753
MARSGKDDLGDLQESRGERILMPSSRFQDNKVREIDALVKGTQAAMNQKFAPVARVCGLCSSADHHIDLCPSLQQSGVNEQPEAYTANIYNRPPQQQNQQQQNNYDLSSNRYNPGWRNHPNLRWASPPQQQ

SEQ ID NO: 129439 - protein, 313 aa, Glycine max
  Coding DNA Sequence Number=SeqID_37754
  Gene Ontology: Mol. function=motor activity; Cellular component=cell projection
  Homolog annotation: Hit_ID=UPI00016621D1; Match level="QueryCoverage =98%, HitCoverage=38%, E-value=2e-25, Identity=38%"; Hit description =UPI00016621D1 related cluster
GLHTLAFIGLHAPTFKGLHVLTFRGLHVLTLRGLHAITFRGLHILTFRGLHILTFKGLHVLHFRKLHVLPFRGLHVLTFRALHVLTFRGLHVLTFRGQHALAFRGLHVLVFRGLLALAFRGLIALAFRGLHVLPFRGLHVLTFRGLHVLTFRGLHALTFRGLHALTFRGLHVFTFRGLHALTFRGLHVLPFRGLHVLDFRGLHVFTFRGLHVLNLRGLHALTFGGLHVLTFRGIHALTFKGLHVLAFRWLHSLAFRGLHALTFRGLHVLPVKGLHVLTFTGLHALIFRGLHVLPFRGLHVLAIRGLHVLAFRG

SEQ ID NO: 129440 - protein, 152 aa, Glycine max
  Coding DNA Sequence Number=SeqID_37755
MVGQGGEVLGNIGGPHMGHNRNAYPYVLPPNYMPPTMHMPNENANHVVPVTFEGQQPWEHAQCDFDPYPTFTAEGLAFNAMPQPNTTEAPQPHPLQQLCFLVGGPPPAVEGIEKLDLIEERLRAVEGFGDYLFANMAELCLVPDVVIPPKFK

SEQ ID NO: 129441 - protein, 193 aa, Glycine max
  Coding DNA Sequence Number=SeqID_37756
MSALKEQMTSMMDAMLGMRQLMENNVATTAAIKRSTLGHISNPHLGYNRVTYPYGLPPNYMPPVMRDDVGHVPSPILEGEPPRQSDEVHEDHREYAQGDIDFYPPVPVEEPAPNTLPQPNLTGEPRNLPAQPIFLSAEGPPPAAEEKRKLDLIKERLRAIEGFGDYPFTDMADLCLVLDVVIPPKFKVPDNDR

SEQ ID NO: 129442 - protein, 161 aa, Glycine max
  Coding DNA Sequence Number=SeqID_37757
  Homolog annotation: Hit_ID=A7QM92; Match level="QueryCoverage=40%, HitCoverage=19%, E-value=2e-25, Identity=83%"; Hit description =Chromosome chr5 scaffold_124, whole genome shotgun sequence
MALLPSCTETRNKKHETVKVFCKPCKPGQGHEYAQELARLSGGIPLQIIGDDTIIFDCGKNYEQPEVMSPIDTLSKNKVYLCFMKKEKKRSEMHDCYSFCSSFKSIGNANCFDVLPALSVAEKHSCFAPTSLSGNPQTDSDFYRKICPNPEKEGELREVDL

SEQ ID NO: 129443 - protein, 148 aa, Glycine max
  Coding DNA Sequence Number=SeqID_37758
  Homolog annotation: Hit_ID=Q2HW90; Match level="QueryCoverage=47%, HitCoverage=14%, E-value=7e-09, Identity=38%"; Hit description =Putative uncharacterized protein
MGQLQQQAFHKAYGKIWDLARVEVSMEPIASLSQYYDQPLRCFTFEDFQLVPTVKEFEEILGCPLGGRKPYLFSGSIPPRQELPRMSKCSLDGTRGCINYNPVLAIRQLGYPMRGVPSDESITPFIAWGFSDHNARVLQGVRKAWDAA

SEQ ID NO: 129444 - protein, 120 aa, Glycine max
  Coding DNA Sequence Number=SeqID_37759
GASSFLLSVLGPPPDIGGGPTVRAQSEREAITQLLCIPGHDFTRVAAKRQVWIMRTNMTTLTQIWMMLLLSNVLPSDRNADLPYRCISWSLSSRHRDRARKTPSGLEEVQQGLQRISKKA

SEQ ID NO: 129445 - protein, 125 aa, Glycine max
  Coding DNA Sequence Number=SeqID_37760
  Homolog annotation: Hit_ID=Q949K7; Match level="QueryCoverage=32%, HitCoverage=45%, E-value=6e-08, Identity=62%"; Hit description =Putative gag polyprotein
MGEAKKVQEKMKADMEAMKEQMATIMEAMMSMKKIMEANVVIVAATSAVAKVNPMLPSGLKQMNHPTSNMVGKDLGKELFLVPNIITPPKFKVLDFDKYKGTTCPKNHPKMYCRKIRAYAKMRNC

SEQ ID NO: 129446 - protein, 177 aa, Glycine max
  Coding DNA Sequence Number=SeqID_37761
MSSKVILMMPKNQELSKFQRFKNEVSRIKIQDSRIKFQESRFKNNQDQDSRLKIQESREDSIKINSKDQPPENSLSQHIGGYILCGTSRGYIYLGTVLLRTRNGTSLVDQFKWRVHPLGYSKRTREGTSLVDLWLVKDFTRLKEISRIAGCMGTGCRHGLWPKQYKSCVSLLLSYTL

SEQ ID NO: 129447 - protein, 123 aa, Glycine max
  Coding DNA Sequence Number=SeqID_37762
GSQHPLLHGQVKVGDKEVKDAEAPVSVPTDEVILVGQAHNTFLAWLTHLVKRLSQQAAVSPAKPPYRLDHEVDDPLYLMTLTIPQLFLKRLLVMWDATVFGVFNEHFPLYIKHEDLSEIAHGG

SEQ ID NO: 129448 - protein, 128 aa, Glycine max
  Coding DNA Sequence Number=SeqID_37763
  Homolog annotation: Hit_ID=A5BQD6; Match level="QueryCoverage=73%, HitCoverage=5%, E-value=7e-11, Identity=38%"; Hit description =Putative uncharacterized protein
  Pfam annotation: Domain name=zf-CCHC; Domain location=24-41; Score =13.8; E_value=0.012; Accession=PF00098.14; Description=Zinc knuckle
MVAPRGRGRGRNSRRGRSGRGGRPQCTYCKRMGHTQENCYSLHGFPDKVAQVAQTEKSESKFSEKEYQEYLKLKFEKSSSQASSSSVPCYSTACISQSIDGPSPWILDSGVSDHISGTWPGSTDWRRT

SEQ ID NO: 129449 - protein, 107 aa, Glycine max
  Coding DNA Sequence Number=SeqID_37764
VSAITPNKVTEAVQPMNDVVVDDPLRELIKSLVDIYEKPVQLLWDVSKFGIPDVDASLHTMFEHSYTTVVDHPILNAKDRRGQCQDYIEKWLKESHREVYLGAYLNQ

SEQ ID NO: 129450 - protein, 140 aa, Glycine max
  Coding DNA Sequence Number=SeqID_37765
  Homolog annotation: Hit_ID=Q6WAY6; Match level="QueryCoverage=82%, HitCoverage=20%, E-value=3e-15, Identity=39%"; Hit description =Putative uncharacterized protein
MTGASISWFSWWKEGGAGVLCSCEGFPNVPLMGTRGCINYNPMLAIRQLGYPMRGAPSEEIITSFIARGLNEANAKILQKIRKAWNRVGRKDKELRGSSNGVIDGYHKWLKSRTQGITWLPNLKSLSEKEVEIPEESEKV

SEQ ID NO: 129451 - protein, 198 aa, Glycine max
  Coding DNA Sequence Number=SeqID_37766
  Gene Ontology: Mol. function=1-deoxy-D-xylulose-5-phosphate reductoisomerase activity; Cellular component=chloroplast; Biological process=isoprenoid biosynthetic process
  Homolog annotation: Hit_ID=A8GIE2; Match level="QueryCoverage=91%, HitCoverage=45%, E-value=1e-82, Identity=84%"; Hit description=1 -deoxy-D-xylulose 5-phosphate reductoisomerase
  Pfam annotation: Domain name=DXP_redisom_C; Domain location=1-39; Score=54.1; E_value=5e-13; Accession=PF08436.3; Description=1-deoxy -D-xylulose 5-phosphate reductoi
MTPDQACAHPNWSMGRKISVDSATMMNKGLEYIEARWLFNASAEQMEVILHPQSVIHSMVRYADGSVLAQLGTPDMRTPIAHAMAYPQRVNSGVEALDFCRIGSLTFAEPERERYPCLYLAIEAFDAGQAATTALNAANEIAVAAFLQQQIRFTDIAAVNRQVVERLALQEPTSIEAVLDIDRQARAAAEERVRALRG

SEQ ID NO: 129452 - protein, 64 aa, Glycine max
  Coding DNA Sequence Number=SeqID_37767
MASNAQQFSARSDAIVIRGVHEVATNSSSSGETKKLEDSVHTDLCPFVQQSEAIEQPKAYAANI

SEQ ID NO: 129453 - protein, 270 aa, Glycine max
  Coding DNA Sequence Number=SeqID_37768
  Gene Ontology: Mol. function=dihydroorotate dehydrogenase activity; Cellular component=plasma membrane; Biological process='de novo' pyrimidine base biosynthetic process
  Homolog annotation: Hit_ID=A1A9L5; Match level="QueryCoverage=100%, HitCoverage=85%, E-value=1e-121, Identity=77%"; Hit description =Dihydroorotate dehydrogenase
  Pfam annotation: Domain name=DHO_dh; Domain location=1-270; Score =296.9; E_value=3.8e-86; Accession=PF01180.12; Description =Dihydroorotate dehydrogenase
MGLTFPNALGLAAGLDKNAECIDAFGAMGFGFVEVGTVTPRAQPGNDKPRMFRLVAAEGIINRMGFNNLGVDHLVKIKTTPVEQGKDDYLTCMEKVYAHAGYIAINISSPNTPGLRSLQYGEALDDLLSAIKLKQRALQESHLKYVPVAVKIAPDLSEEELIQVADSLVRHEIDGVIATNTTLDRSLVSGLKYADEAGGLSGRPVQSRSTEVIRRLAQELQGRLPIIGVGGIDSLVAAREKMAAGATLVQIYSGFIYKGPGLIKDIVTHL

SEQ ID NO: 129454 - protein, 68 aa, Glycine max
  Coding DNA Sequence Number=SeqID_37769
MEQRKQSRNSNGHNISLGYPIRGHNISETLENEQRKLSRNSNGHNFSHRCPIRGHNISRRSKLNYGSG

SEQ ID NO: 129455 - protein, 96 aa, Glycine max
  Coding DNA Sequence Number=SeqID_37770
MQSSKHDVYLGAYLNGEHWQMVVIAPKEHLVVWFCSLHNRPDNYLKGIINSALKGLDDAPQPKSKAPTRWIVIKYFNDPRPLESERLKALRIQWTL

SEQ ID NO: 129456 - protein, 218 aa, Glycine max
  Coding DNA Sequence Number=SeqID_37771
MTAPHVLSRGGYDLLEKKLLDEKRKKRQEDAMLTENTPLIEDPPSPIERHVKWKMARTKRCGQMTSQAAQEISENCEFESLQEQMTQGSFVPHGCDNILNTAIGRPEHPCRVCVVGLKEEWRNEIIRNLKEEVKNEIEEENKSNAGTIVNPSREEHDGHVIPTMGFIHNVAYADDVVMISVEKVFDDDPLRHLIKSMYDIYEKPVEFMWDGTKFGIPN

SEQ ID NO: 129457 - protein, 83 aa, Glycine max
  Coding DNA Sequence Number=SeqID_37772
MSSSAPLSSRDGESDVMRRYPSGYPYKGFLLILTHEVRRRYPSGYPYKRFSVNLDPRSQVAGGDTKVVIRINTHSLSVRLKAR

SEQ ID NO: 129458 - protein, 101 aa, Glycine max
  Coding DNA Sequence Number=SeqID_37773
MGETNEIPHHNLADFEPCLGYATEGQAVGEMGKLDHIEERLNVVEGSGGYAFANLEKLFPVPNVVTPPKFKVSDFDKYKETTCPKNHLKDVLSEDGGIHKR

SEQ ID NO: 129459 - protein, 101 aa, Glycine max
  Coding DNA Sequence Number=SeqID_37774
MKHGSKLFGGGCMNENAIHGAPKKGREWRIALRNHYAWLQTRGWRMHERKSNSWGSEKGVREWRIALSNHYAWLQTRGWRMHERKRNSGAVGSRVEDGGLH

SEQ ID NO: 129460 - protein, 39 aa, Glycine max
  Coding DNA Sequence Number=SeqID_37775
MALSVRLLKPTQVAFSACPELGRDDDLSVMTLASICVRS

SEQ ID NO: 129461 - protein, 53 aa, Glycine max
  Coding DNA Sequence Number=SeqID_37776
GGEPDDKQRPSLVISAPLYHPEAAGPMTSRDQVWSFCTLVSSRGGGPDDKQRP

SEQ ID NO: 129462 - protein, 105 aa, Glycine max
  Coding DNA Sequence Number=SeqID_37777
  Subcellular localization annotation: CTP_CleavageSite=44; ConfidenceScore=5.05e-01
MGRPFPPASSCRRGIVLGSVCRPQQGHQVPPTNRAFIKKFCVSRQAQGETPQQPGDGWQRATDAPPSPLEFTSAHPQKGLSIAYTTWPTNRRPSPKPKVSKVLGQ

SEQ ID NO: 129463 - protein, 83 aa, Glycine max
  Coding DNA Sequence Number=SeqID_37778
LELSTTTSSLGSESAASDSHILNIASEAVRPKDDGSTRLTFLPSQNSIPVNDSNVLEIRKTKGVKILRRNSALGAASSGGSVA

SEQ ID NO: 129464 - protein, 97 aa, Glycine max
  Coding DNA Sequence Number=SeqID_37779
MGPYMYWEVDLSPYLSAAAIEGMNHHGTRPQVGGIKWQLLQCALRHHVIVGCDVIDDPLKAFYGDVLGYVSFIQDFYQQSSVRLRAREQLQKGDSRR

SEQ ID NO: 129465 - protein, 155 aa, Glycine max
  Coding DNA Sequence Number=SeqID_37780
  Gene Ontology: Biological process=transposition, DNA-mediated
  Homolog annotation: Hit_ID=Q1J7G7; Match level="QueryCoverage=21%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRCGESSMIVDYVNQTLMIQSYPARALDRRLQEDGPEM

SEQ ID NO: 129466 - protein, 38 aa, Glycine max
  Coding DNA Sequence Number=SeqID_37781
MTSLKLKDPASIEAPQASFHQFLFAPTYSSIAMRKSDL

SEQ ID NO: 129467 - protein, 212 aa, Glycine max
  Coding DNA Sequence Number=SeqID_37782
MSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYWKNTITKRATRHPYRTRSKSRTMGDQEETQEQMKADMSALKELMASMMEAMLGMRQLMEKNATTAAAVSSAAEADPTLLATTHHPPSGIVGRGRDTLGHDGNPHLG

SEQ ID NO: 129468 - protein, 360 aa, Glycine max
  Coding DNA Sequence Number=SeqID_37783
  Gene Ontology: Mol. function=transporter activity; Cellular component= cell outer membrane; Biological process=protein transport
  Homolog annotation: Hit_ID=A6TE24; Match level="QueryCoverage=87%, HitCoverage=64%, E-value=1e-122, Identity=72%"; Hit description =Outer membrane channel protein
  Pfam annotation: Domain name=OEP; Domain location=101-295; Score =189.0; E_value=1.1e-53; Accession=PF02321.9; Description=Outer membrane efflux protein
MACADAAGKNGRHSGRYLSAQKQSIYRELDQTTQRFNVGLVAITDVQNARAQYDSVLANEVTARNDLDNAVESLRQITGMDYLSLASLNIDRFKTARPEAVSNLLKQAESRNLNLLSARLSQDLAREQIRSAESGHMPTLDLTASTGLSNSKYGGSRANQSAGTTDSITGSNQVGLSFSLPLYSGGSVTSQVKQAQYNFVAASEQLEGAHRSAIQTVRSSFNNVNASISSIDAYKQSVISAQSSLDASEAGYQVGTRTIVDVLDATTTLFNAKQQLSNARYSYLINQLNIKYALGTLNEQDLQQLNSTLGKEVTTSPEVVAPENSQQAARVDNGPKATSASAAAQARPAAARNSANPFAN

SEQ ID NO: 129469 - protein, 96 aa, Glycine max
  Coding DNA Sequence Number=SeqID_37784
MPQPSPQQESCFANQFVAIKCFIGEYYLIPLLPNGADLFTQDNDSHQIGMILLQWKNKCPASCRCKCLWCFDDDHDEEKQMMQMIQEYKPQHQDDH

SEQ ID NO: 129470 - protein, 52 aa, Glycine max
  Coding DNA Sequence Number=SeqID_37785
METRFDSDWKKVEAFVVSKTVIQGILIVFEGVFDYVTLSNFGPFQIKNWLLA

SEQ ID NO: 129471 - protein, 218 aa, Glycine max
  Coding DNA Sequence Number=SeqID_37786
  Subcellular localization annotation: CTP_CleavageSite=40; ConfidenceScore=5.41e-01
YRSRRSSAPTSRMAAASSYKQGARSRYSCHSSKETHGRPSAERERAPASTSGEGCAMTVTFDDTALRAHVDPALARTESRERVAREGRQVGVVLGSGRPSWWPAPECSIGPRRRRRAVHVRRGDGRPATVVHGGADGAAARRGQRTDLSHRRARPRASGRAVPARHITGRERHRRGDVTAALRGGELLLRRMGGAGAHAPGGELRRVRVAQSAPRADR

SEQ ID NO: 129472 - protein, 139 aa, Glycine max
  Coding DNA Sequence Number=SeqID_37787
  Gene Ontology: Mol. function=peptidase activity
  Homolog annotation: Hit_ID=Q8H6W2; Match level="QueryCoverage=79%, HitCoverage=95%, E-value=5e-10, Identity=41%"; Hit description=Gag -protease polyprotein-like protein
MASANSLFPEGNSINRPPIFNGEGYHYWKTRMQIFIEAIDLNIWEAIEIGPYIPTTVERVTIDGSSSSESITIEKPRDRMEHEMELLRLHQHEENDKKKKGIALKASSSIQEESDQDNDPDDDDDDLSLFVRRFNKFLK

SEQ ID NO: 129473 - protein, 46 aa, Glycine max
  Coding DNA Sequence Number=SeqID_37788
MTKPLIPRQAEYPSFVRKSLISSEGYIHLVVQREQGRVHPLWIFGL

SEQ ID NO: 129474 - protein, 46 aa, Glycine max
  Coding DNA Sequence Number=SeqID_37789
MEIYESDRLGKKVVIIKKREIVEAKLHDESRVIQRCFDDNKDDNKR

SEQ ID NO: 129475 - protein, 109 aa, Glycine max
  Coding DNA Sequence Number=SeqID_37790
QSGNRLLDCIILNSLTREKGDTKEFRQLVLRSFGKGRRETQKEFRRLALGEFFLAKGEGNEKMNSTSFQGLENQKTLESFWYKEEEEVQRDSRLVKDCKRLIGKVFKID

SEQ ID NO: 129476 - protein, 112 aa, Glycine max
  Coding DNA Sequence Number=SeqID_37791
MANGTEDDVSLFVSTGSFAPWLMKGMGNHKQKDVYTDNHLGTSACPLTLRQKDVYTDNHLGISACPLTLQVRMKRLMVPVDDQNDVYTDNHLGISACPLTLRVRMTEIDGAR

SEQ ID NO: 129477 - protein, 42 aa, Glycine max
  Coding DNA Sequence Number=SeqID_37792
RKMQGSCMSKRENKRDYQQQHAIKEKNSRSGFTVIKQVGDPA

SEQ ID NO: 129478 - protein, 44 aa, Glycine max
  Coding DNA Sequence Number=SeqID_37793
MEEIHGEEDEEQGIKINGSGMGMEERLLEMPLQGEDESRRSSPP

SEQ ID NO: 129479 - protein, 61 aa, Glycine max
  Coding DNA Sequence Number=SeqID_37794
MTLKRKVQGLIDAGWLKFEENRVIFKCEPLVCLLKQPALLSVDFQDSSIRDYSSCTLVGVS

SEQ ID NO: 129480 - protein, 151 aa, Glycine max
  Coding DNA Sequence Number=SeqID_37795
  Gene Ontology: Mol. function=oxidoreductase activity; Cellular component=cytosol; Biological process=auxin mediated signaling pathway
  Homolog annotation: Hit_ID=A6T976; Match level="QueryCoverage=100%, HitCoverage=38%, E-value=2e-84, Identity=98%"; Hit description =Putative dehydrogenase
MWWREPETRIFPTLEELGIGFVPYCPTARSFLAGAVNPSQRFDSTDRRHNLPRFQPDALAKNMVLLEFAQSWARRKNTTPVQFALTWVMAQRPWIVPIPGTTQYPHLIENSGAPQVRLTDSELREIDAALARIPLQGGRADPFTESQFDKS

SEQ ID NO: 129481 - protein, 79 aa, Glycine max
  Coding DNA Sequence Number=SeqID_37796
  Subcellular localization annotation: CTP_CleavageSite=43; ConfidenceScore=5.42e-01
MKSCPGMHSSCVIASLSGCARTVGPPPISGGGPGTVWIWSPPKVRTRSPLKARACSLLKARTCSPLKVRTCPSLKMGNM

SEQ ID NO: 129482 - protein, 224 aa, Glycine max
  Coding DNA Sequence Number=SeqID_37797
MKIIISIPLMNCDLARGEQHKDSCYFYSINNFDRRQESVMYEYLEEERALDLKSYQWESFWQPNYYDKAEGVLNLDDANTAARQEEERAEIDTHPESIFKVTSIHHQMTTEEKMSEVSSTPEYSCPATAGYVGGTKKGRLELSVEDQKVSLDLFEVMKHSNMGDACSEEEEVEQEIFPLEKELGDEIDSLVNNEECDDPKDNCVDYVGFEELEKMRPSKSPKQN

SEQ ID NO: 129483 - protein, 21 aa, Glycine max
  Coding DNA Sequence Number=SeqID_37798
MDNKGEMDNVPLPITGEEAPL

SEQ ID NO: 129484 - protein, 82 aa, Glycine max
  Coding DNA Sequence Number=SeqID_37799
MAMFKRARSVFALCPYFRDLHGRKLKGLLVIIPKVVISLLMVSRGIIPFEEHIAAVGTTSNNVLSKRKTLDEGSLLSSKSET

SEQ ID NO: 129485 - protein, 50 aa, Glycine max
  Coding DNA Sequence Number=SeqID_37800
MKEKNERRGDVILPRKGPVTRAMSKRLQEDWARVAEEGPRDLMNLRGSIM

SEQ ID NO: 129486 - protein, 64 aa, Glycine max
  Coding DNA Sequence Number=SeqID_37801
  Subcellular localization annotation: CTP_CleavageSite=18; ConfidenceScore=5.11e-01
MAAAGNRRTAITSRVHLSSSTKRTHLFAHDPRNLNKTSTSSEGSHTSQKEICIYVARYLGYACI

SEQ ID NO: 129487 - protein, 146 aa, Glycine max
  Coding DNA Sequence Number=SeqID_37802
MEANVVAGAVTSTVAKTHEIPHYNLANFEPCLGYATEGQAVGGIPLQNPLEGPQYHPQLHLLHSTTSKNPHAMAEMGKLDHLEERLRSIARGEDYAFANLEELFLVPNIITPSQVQGAGLDKYKGTTCPKNPSKDVLSEDGGIRKR

SEQ ID NO: 129488 - protein, 76 aa, Glycine max
  Coding DNA Sequence Number=SeqID_37803
  Subcellular localization annotation: CTP_CleavageSite=15; ConfidenceScore=5.14e-01
MKGNQQRSPVESPTVATYPSAGGRRVTRGMRVPRKEYARSRHQRLFEENVGKTGKDVIYELLSERFGSCIYARGRY

SEQ ID NO: 129489 - protein, 185 aa, Glycine max
  Coding DNA Sequence Number=SeqID_37804
MGAKHLTRTKQKLHVIKQRHNLHKRLTNLVDGSIDVALVKEFYENLYSSEGPSPKQPRVRGHLVKIDADSFNTFLETPVVLAEGETLPTYSRYCRLPSDPREIEAALCIPGRGFILNTEGHPGRILRKNLMTLAQVWSFLSYSNLAPASHTSDLTVDRARLIFGLVSRMDMNVGALISGQMTSIA

SEQ ID NO: 129490 - protein, 90 aa, Glycine max
  Coding DNA Sequence Number=SeqID_37805
MAGLFLEHPLQLMTLLAHGRAIAGQLYQYAAFVIRVRASFYPSFADETIEHAGERTQIDREHLFQLNRCDTHFAANGTQHFELCRGDIQR

SEQ ID NO: 129491 - protein, 143 aa, Glycine max
  Coding DNA Sequence Number=SeqID_37806
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MSGLLAVKYSKLPIMLLYNFDQHCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 129492 - protein, 71 aa, Glycine max
  Coding DNA Sequence Number=SeqID_37807
MARIAKVVEISEQELDRVKQNRNGAAGVPRKHLEEKAEALTSQGEWATFIDVLALIVFGTVLFPNVDGWWI

SEQ ID NO: 129493 - protein, 60 aa, Glycine max
  Coding DNA Sequence Number=SeqID_37808
MEEKHLGFVSFPFFFLSLISLNFHHSSMLEPHPQLPFTPIYRKKGTWDHGSSPRRAETYS

SEQ ID NO: 129494 - protein, 78 aa, Glycine max
  Coding DNA Sequence Number=SeqID_37809
MGIWCFPSSWTRAELMASSAIESIGRAVHFQEFSIANPNSVHYSGLRHLSYLRISPNTSSKFATFWAMLSNYFFQKFS

SEQ ID NO: 129495 - protein, 213 aa, Glycine max
  Coding DNA Sequence Number=SeqID_37810
  Homolog annotation: Hit_ID=Q6WAY4; Match level="QueryCoverage=86%, HitCoverage=32%, E-value=1e-22, Identity=36%"; Hit description =Putative uncharacterized protein
MGSSQMPSLKKRFYQVKVKSLGTTSLKELGQLMGQLQWQAFRKAYGKILDLAMVEVSTEAIASLTQYYDQPMRCFTFGDFQLSPMVEEFEEILGCPLGGRKPYLFSGFYPSLARISKIVQISAQELDHRKQVENGVVGIPRKYLEAKARILAGKGEWAPFIDILALSIFGGVLFPNVDGLVDLAVIDAFLAYHNHKESPVVAMLADLYDTFDR

SEQ ID NO: 129496 - protein, 284 aa, Glycine max
  Coding DNA Sequence Number=SeqID_37811
  Gene Ontology: Mol. function=oxidoreductase activity; Biological process=electron transport
  Homolog annotation: Hit_ID=UPI00005F9B64; Match level="QueryCoverage =52%, HitCoverage=81%, E-value=3e-70, Identity=85%"; Hit description =COG2249: Putative NADPH-quinone reductase (modulator of drug activity B)
  Pfam annotation: Domain name=DUF1330; Domain location=24-116; Score =112.8; E_value=1e-30; Accession=PF07045.2; Description=Protein of unknown function (DUF1330)
  Pfam annotation: Domain name=Flavodoxin_2; Domain location=150-283; Score=-18.9; E_value=2.5e-06; Accession=PF02525.8; Description =Flavodoxin-like fold
  Pfam module annotation: Pfam domain module=DUF1330::Flavodoxin_2; Domain location=24-116::150-283
MTIKTAVAFLFALSGLSTALAATPAYYIAEFQATDREAIKPYSAQVESTFRPFGGRFIVRGGEPDVKEGFGAQGRLVVIKFESLKNAQDWYNSAAYQKIIPIRHRAGNSRTYIVEGLPELAPRRAAALFLFAFIFLMPVRHAHSREKTDIKTLVIVSHPYPERSVLTKGLQEAAESLEGVTVRNLETLYGYDTRQINGDAERKMMREHSRVVFIFPTHWFNITPMMKAWLNETWGSVGPGLWQGKEMLVVSTAAGGRSTYGPDGRIGVSLADVFLPMKASALHA

SEQ ID NO: 129497 - protein, 66 aa, Glycine max
  Coding DNA Sequence Number=SeqID_37812
MEVKLGRIDGDPVLRETRIWATWEYVSSVGGGQQGMVGLCAHCGCGKTCCAPSPDRHLVPHVMGPP

SEQ ID NO: 129498 - protein, 122 aa, Glycine max
  Coding DNA Sequence Number=SeqID_37813
TSHLPTLADTSAQVFITAAVSPAKPPPKPDPEVDDPLYLMTLTIPELLLRPYQFIQRSGQSQFEFESYIKSWMHSSQRDVYLGANLNGGHWQMVVILPKEHLVVWFCSLDNKPDNYLKGIIN

SEQ ID NO: 129499 - protein, 128 aa, Glycine max
  Coding DNA Sequence Number=SeqID_37814
MLNGMPRGSSMISTRCVGVVSSEKWRSGTLVGVPLPRGIHALAIRGLRVLTFRGVHPLAIRGLHVLTFRGLHALAIRGLHVLTFVGLHVLTFRGLHVLANRGLHALTLRGLHVLANVGLHALTFRGLH

SEQ ID NO: 129500 - protein, 80 aa, Glycine max
  Coding DNA Sequence Number=SeqID_37815
GKCAESPPTFICGKRRKNRRKSVIKNIPSSGVVFTFEEGISTSHVDKSGALAPTYPPSKRKSDLRSSFLRVHQAILFTWK

SEQ ID NO: 129501 - protein, 29 aa, Glycine max
  Coding DNA Sequence Number=SeqID_37816
MTAEGRDMAEDVADMTDDVPELAAEALEC

SEQ ID NO: 129502 - protein, 142 aa, Glycine max
  Coding DNA Sequence Number=SeqID_37817
MVRTRGLGHALARVIGRGRHDEHDAVNVPQRHRPTASARRQRVHITVDEGVPQVTEDVPHMAEDVPQVTEDVPHMVDDVAQRSEDVPQMTANVYSTVAEDLGRDGAEGSHADEGLPGGPCDPSVLTSFAKHVAHAIWTGHVL

SEQ ID NO: 129503 - protein, 160 aa, Glycine max
  Coding DNA Sequence Number=SeqID_37818
MTGRLLAGSLTFDCRIMHYIIVRILLPCSSNLAQASEEDLILIWAFLSGHQINWAHLVRSFAIGAGAVTSFGYCKDRDGQWLKKDELPPQDKRTPSPPPQRDDSSALMNEVISELRGLRTYVGERFDSLDGHFEGMDTRITQLEEDVTYLRRCFDLPPPS

SEQ ID NO: 129504 - protein, 137 aa, Glycine max
  Coding DNA Sequence Number=SeqID_37819
  Homolog annotation: Hit_ID=A4DID9; Match level="QueryCoverage=44%, HitCoverage=86%, E-value=3e-18, Identity=53%"; Hit description =Putative uncharacterized protein
HVWGLTPAQCRKVKEVGDLMTGEPTTEAPVNGGRNYNGPKGKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYP

SEQ ID NO: 129505 - protein, 111 aa, Glycine max
  Coding DNA Sequence Number=SeqID_37820
VHDEFGYNRVVFQWKEKDVAGGSMFHSANSLTSCGNYVSNDDTQPPTNMSNLNLDEDDDHDDDDYLVSNSYVEDSLDEDDSVDGISDTDNEVPEMIPPVRIVHPAEGMILS

SEQ ID NO: 129506 - protein, 89 aa, Glycine max
  Coding DNA Sequence Number=SeqID_37821
MGDFAKIFNRSSSFVVRSSVFNRFDDEFRKGTNTGDPAVDFEQEASRTENEEDEDVGLPPELERIIAQEDQEMRPHHRRDRTRRLRNRQ

SEQ ID NO: 129507 - protein, 120 aa, Glycine max
  Coding DNA Sequence Number=SeqID_37822
  Subcellular localization annotation: CTP_CleavageSite=29; ConfidenceScore=5.22e-01
MSPPPLGPYNHSQTHLKLSGRLPLPALVSADLHTTKSLKLSGTWTFLSLELSTHVEASRKGQTLLRNLISGLNRWLCSCSSSSFQILPRAQSRSVALSGWLTKPEDWLSEREKMSTSKLA

SEQ ID NO: 129508 - protein, 33 aa, Glycine max
  Coding DNA Sequence Number=SeqID_37823
KAIASGGSNLARLGELTSPGRAGWQAPPLFCYK

SEQ ID NO: 129509 - protein, 49 aa, Glycine max
  Coding DNA Sequence Number=SeqID_37824
MALGDMAARPRELLLQPKGSKDKDTNFVQAILLFDRATGKNQGSETEKT

SEQ ID NO: 129510 - protein, 63 aa, Glycine max
  Coding DNA Sequence Number=SeqID_37825
EQQAEWEQQAEWVNAQRQILRPLSFGSSDVGDKRAKTDSAPFVILISRDGEVHWLKGVSLERN

SEQ ID NO: 129511 - protein, 96 aa, Glycine max
  Coding DNA Sequence Number=SeqID_37826
MMCLSGKESMLSEHFVSKRPYRGNTGSNKDRRKSLKVHQSHTGQGLTLSPWVKVYDKLGFWLKACRMVGHDICQGLASGSGIKGMSYIISMIHMQQ

SEQ ID NO: 129512 - protein, 111 aa, Glycine max
  Coding DNA Sequence Number=SeqID_37827
MKNVEERLTTFAIFLYGNVSGSASAKDFLHGNNFSKQIRKREKEMLAAQLAQANQGCFLLESNSLLEDLLRPKWVVAIYTPLKNDPPFSIFYLVRNRNDKLSKSYFVDELD

SEQ ID NO: 129513 - protein, 78 aa, Glycine max
  Coding DNA Sequence Number=SeqID_37828
MVVILPKENLVVWFCSLHNRPDNYLKGIINRQKGSTECGYYMMHWMSTIILGSFRNNWKTYFNDVRPLEVERLKALRI

SEQ ID NO: 129514 - protein, 104 aa, Glycine max
  Coding DNA Sequence Number=SeqID_37829
MSGFTRNSPQISASPYQLDFTLYASGSYNAQWNAVGLLHDKHTLRSSRILRKVEVDEPWLGLWLPLNYQVVFVIGSAVDRLCGRFRDGLCGSPGWWVRRRFVIG

SEQ ID NO: 129515 - protein, 193 aa, Glycine max
  Coding DNA Sequence Number=SeqID_37830
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=6e-21, Identity=30%"; Hit description= UPI00006A17C9 related cluster
  Subcellular localization annotation: CTP_CleavageSite=54; ConfidenceScore=5.24e-01
MARMCSPLKVRTCSPLLVRTCSPLMARTCSPLKAWTCSPLKVTACCPLKVMACSPMKVRTCIPLKAKACSPQMARTYSPLKAMACSLLKVRTYSPLMTKACSPLKVRARSPQKVRTYSPRLARTCSPLMASTCCPLTARMCSPLKVRAHGPQKVRTCSPLLVRTCSPLMARTCSPQTVWVCSPLKVRTCSPLK

SEQ ID NO: 129516 - protein, 122 aa, Glycine max
  Coding DNA Sequence Number=SeqID_37831
MKNFPRIAYRNVSEALRKHFDSIFLHENVENERCLPPRGFLRKISKRTPITKFTPFSYFTEKLRKCFGFDFHLFFSSLSPMLSEICLPKVFGNFTEALRKTRKPQKPFFNNVKELAAQLLPP

SEQ ID NO: 129517 - protein, 37 aa, Glycine max
  Coding DNA Sequence Number=SeqID_37832
MKTEDGSENNVKNKDVEDSVCDVDFTSINKADASRGY

SEQ ID NO: 129518 - protein, 111 aa, Glycine max
  Coding DNA Sequence Number=SeqID_37833
PFVQVKHSFAIGAGVVTSFGYHKDRNGQWLKKDALPPQDERTPSPPPQREDSALLNEVLTELRGLRSYIGERFDSLDTRFAGMDIRLTQVEEDGSFIRTCFDPPPPPPSSS

SEQ ID NO: 129519 - protein, 70 aa, Glycine max
  Coding DNA Sequence Number=SeqID_37834
GSTGPNKDRRKSLKVYQSHTVRGKKVASAQDFGWQSKGEGHFRARIYDKLGFWLKACRTAGHDICQGLAS

SEQ ID NO: 129520 - protein, 161 aa, Glycine max
  Coding DNA Sequence Number=SeqID_37835
  Gene Ontology: Mol. function=hydrogen ion transporting ATP synthase activity, rotational mechanism; Cellular component=proton -transporting ATP synthase complex, coupling factor F(o); Biological process=ATP synthesis coupled proton transport
  Homolog annotation: Hit_ID=P09003; Match level="QueryCoverage=85%, HitCoverage=69%, E-value=1e-56, Identity=82%"; Hit description=ATP synthase protein MI25
  Pfam annotation: Domain name=Mt_ATP-synt_B; Domain location=1-136; Score=108.3; E_value=2.4e-29; Accession=PF05405.5; Description =Mitochondrial ATP synthase B chain precursor (ATP-synt_B)
MIVARCFIGFIIFSRKSLGKTFKVTLDGRIQAIQEESQQFPNPNEVVPPESNEQQRLLRISLRICGTVVESLPMARCAPKCEKTVQALLCRNLNVKSATLPNATSSRRIRLQDDLGTKFHLLVRRRFCPQCISKSRKNRTHSRELGGLKNGSGWGVLLRIK

SEQ ID NO: 129521 - protein, 60 aa, Glycine max
  Coding DNA Sequence Number=SeqID_37836
MTKLGLCVPTDTTVSEWQRGTDNRKVSPRIIMTKLGLCLSSGPPPLDDKRGVRHMTSGSV

SEQ ID NO: 129522 - protein, 219 aa, Glycine max
  Coding DNA Sequence Number=SeqID_37837
  Homolog annotation: Hit_ID=Q84VH5; Match level="QueryCoverage=96%, HitCoverage=32%, E-value=1e-103, Identity=87%"; Hit description =Envelope-like protein
MAQKKSTPITPTTSRWSKVAIPSKKRKEISSSDSDDDVELDVPDIKRAKKSGKKVPGNVPDAPLDNISFHSIGNVERELGRDAWDCKEIMDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAGKLSVKYAILHRIGTANWVPSIILPLLPQ

SEQ ID NO: 129523 - protein, 650 aa, Glycine max
  Coding DNA Sequence Number=SeqID_37838
  Gene Ontology: Mol. function=phosphoprotein phosphatase activity; Cellular component=intracellular
  Homolog annotation: Hit_ID=A7QT58; Match level="QueryCoverage=42%, HitCoverage=24%, E-value=2e-25, Identity=35%"; Hit description =Chromosome chr1 scaffold_166, whole genome shotgun sequence
  Subcellular localization annotation: CTP_CleavageSite=50; ConfidenceScore=5.04e-01
MQGSFVPHGRDDILNTAIGRPKHPGRVHAVGTGVTISQYFGQVSRGSNTSSASISQQKLVDIIGKLKEELRREVEKENKNLKEEWRRQVPDIQLLAARVSTKGSCFEDVANPSGENAGLIMPPTMGLYVEGDHFTHFVALGKVYDRASTICNVPYANDVVKSVVRSGSGAAKTESGKMELDIEGSKFYLCETDALKDEIVDTNEEVSSASTGDFLTSTKPTLLDQPPVSATSMDRSNFHGFISSRVDAVGPGSLPVKSSAKNRAPRLHFTNSDASAVDNPSTLIHNMPKVEYVGTTISRKQKAAEEPSLDVSVSQRQKSSLENTEHNMNEVRTGSGGWLEENTGPGAQFTERNHLMDKFGPEPKKTLNTVSSSCTSSDNLNATSIRNEQAPITSGNVLASLPALLNGAVVNPIMLVNLLRIAEAQQKSTDSTSNMMLHPTSSNSAMGTDSTASIGSSMATGLLQSFVGMVPVSSQSTSTLWNQPFRSSLTMAEAIFTSFCTMSFLSPKGACVAPENFFLWENVLDNWDIRLSTKSQGLLQLMVWGLLDQPLNVSQCVSCICKNVVHHQQSHPFEINTKNEVTLSKKGNRNEEKERVLKQAQPNTRAKRASDAKRAKKPGAKRGVKLEEAETVMRAKPSYALSARSNRSTG

SEQ ID NO: 129524 - protein, 303 aa, Glycine max
  Coding DNA Sequence Number=SeqID_37839
  Gene Ontology: Mol. function=metal ion binding; Cellular component =integral to membrane; Biological process=metabolic process
  Homolog annotation: Hit_ID=Q8VYP5; Match level="QueryCoverage=100%, HitCoverage=97%, E-value=1e-134, Identity=76%"; Hit description =Putative uncharacterized protein At3g60800
  Pfam annotation: Domain name=zf-DHHC; Domain location=108-172; Score =133.1; E_value=7.7e-37; Accession=PF01529.11; Description=DHHC zinc finger domain
MAWNVFKFCTALRGLGSIMILLVLGVVGATYYAVVLTNYGPALYAGGLDSLVALAVLILFHSLLVMLLWSYFSVVFTDPGSVPPNWKPTIDEERGEADPLVGTEFSNLPSDPNPRVRYCRKCNQLKPPRCHHCSVCGRCVLKMDHHCVWVVNCVGALNYKYFLLFLFYTFLETTLVTASLLPHFIAFFSDGEIPGTPGSLATTFLAFGRVSEHVLNLAFALSVLGFLIMHISLVAANTTTIEAYEKKTTPKWRYDLGRRKNFEQVFGMDKKYWFIPAYSDEDIRKMPALQGLDYPSKPDFDSQ

SEQ ID NO: 129525 - protein, 170 aa, Glycine max
  Coding DNA Sequence Number=SeqID_37840
  Gene Ontology: Mol. function=catalytic activity; Biological process =carbohydrate metabolic process
  Homolog annotation: Hit_ID=P39657; Match level="QueryCoverage=85%, HitCoverage=49%, E-value=4e-17, Identity=41%"; Hit description =RuBisCO-associated protein
MPQPHSTTSSTSTTSMESMGLIKGLREALCTTGFVASLAPDAATNETFYLPLYRSIDNSWIGTVVFQCFVDFEPLDPNRPVESLVRQVEKIVGEYDYYDSKILLGYSAIKEDWNKVSPPLFFLALNRLVHSWPRVKGASVKVISDTYAFIPPTWIPKLLSLAVSDAGKYP

SEQ ID NO: 129526 - protein, 340 aa, Glycine max
  Coding DNA Sequence Number=SeqID_37841
MITFKVLAIANHYAKWACLLTWKAQMRDQLFLNEIMGASPINEDDHPVEGHRLPQVEGRPERHTCALDGTSLHMEGGNVGGVTVEGEGRHKGVGGRVMGVDEFEEEDDGLAIFPPADEQGPRPAACAMVKGYSACTSRCMSGERPETKQLRRKAEDSPMTRLARASNSDRGYGQTLMSGSAMVLEKLVDLKDPTRGVKVMAEEGQGLVTYWVKKEGVDDEEVHRFCWSSTRNVRCKLNYELRGSAPPEIQGGKEELTSSNIIFKMIDGGVDAKRVLAEEEVETAEGFELWILLTQREGVVRQIKNQEYASFFKKLKVKTIKRRVKEPLTPSSSFGLQNQS

SEQ ID NO: 129527 - protein, 321 aa, Glycine max
  Coding DNA Sequence Number=SeqID_37842
  Homolog annotation: Hit_ID=Q8RVQ6; Match level="QueryCoverage=68%, HitCoverage=29%, E-value=1e-106, Identity=88%"; Hit description=SEC6
  Pfam annotation: Domain name=Sec6; Domain location=1-321; Score= -198.2; E_value=0.012; Accession=PF06046.4; Description=Exocyst complex component Sec6
MDSSKNLTQQKLKVQGKGYKDKCYEQIRKTVEGRFNKLLNELVFEDLKATLEEARAIGEELGDVYDYVAPCFPPRYEIFQLLVNLYTERFIQMLRLLSDRANELTNVEILKVTGWVVEYQDNLIGLGVDESLAQVCSESGAMDPLMNSYVESMQATTRKWYLNILEADRTQPPKKTEDGKLYTPAAVDLFRILGEQVQIVRDNSTDLMLYRIALAIIQMIDGGVDAKRVVAAEEVETEVSRLHYYGLINVLREGVVRQIKNQGEEPVDLRRSLKLFSDFTQKILTKYPMDTKDMDVSIEFVYELFTRVMRERGATSEKLFG

SEQ ID NO: 129528 - protein, 114 aa, Glycine max
  Coding DNA Sequence Number=SeqID_37843
  Gene Ontology: Mol. function=transcription regulator activity; Cellular component=nucleus; Biological process=regulation of transcription
  Homolog annotation: Hit_ID=A6NAB4; Match level="QueryCoverage=81%, HitCoverage=18%, E-value=3e-15, Identity=44%"; Hit description=Myc2 bHLH protein
MTMVEILGRESFDYLVVNLVLNKNLSMVFGSGENLQNKLLDLTEHPNSKYGDWVLEWGHGCCREPREGEKFGEVRIVADGKVWRKRKRVSQKLHMTFGRKGRGWKREGQKRRME

SEQ ID NO: 129529 - protein, 178 aa, Glycine max
  Coding DNA Sequence Number=SeqID_37844
  Gene Ontology: Mol. function=nutrient reservoir activity; Cellular component=cell wall; Biological process=cell wall modification
  Homolog annotation: Hit_ID=Q708X4; Match level="QueryCoverage=70%, HitCoverage=22%, E-value=7e-40, Identity=60%"; Hit description =Pectin methylesterase
  Pfam annotation: Domain name=PMEI; Domain location=37-172; Score =30.9; E_value=4.7e-06; Accession=PF04043.6; Description=Plant invertasepectin methylesterase inhibitor
PEVVEKLVGLREGIPRKDAKEVIQECKEIYENSLVDGRPPKAGSTFYLELCFSAIAYEPNITHKVTNHCDVIQLSLSVTFRAVKHNYFIMKKLLTKQDLMKHVHDCLEIIDETFNKLRETHNDLELYPNMKTLYQHANDLKILISVAITNQVMCLDGFSHDDTDKHMRETNLKEKARL

SEQ ID NO: 129530 - protein, 81 aa, Glycine max
  Coding DNA Sequence Number=SeqID_37845
  Homolog annotation: Hit_ID=A5B8H9; Match level="QueryCoverage=79%, HitCoverage=4%, E-value=3e-07, Identity=43%"; Hit description =Putative uncharacterized protein
MTQFVKLLLKSQVLMGSEARNEAGSSQENVIQGRERRQPAWMGEFVNGEGLSEEEAEAYMVQDVVGDDPTQFEEAMKHEKW

SEQ ID NO: 129531 - protein, 122 aa, Glycine max
  Coding DNA Sequence Number=SeqID_37846
  Homolog annotation: Hit_ID=A5ALZ8; Match level="QueryCoverage=63%, HitCoverage=11%, E-value=1e-07, Identity=39%"; Hit description =Putative uncharacterized protein
  Subcellular localization annotation: CTP_CleavageSite=59; ConfidenceScore=5.36e-01
MASTAPPQPASLAGQPPLIHIPPLNTYPPPTTSPSSPIAPVTYSHTITEKLYNNNVLLRRKQIKPIIKTQPSPFSLLVDNSPHFLTTEDCDLGRINESYAAWEQQDQLLLSWLQASLRFNPI

SEQ ID NO: 129532 - protein, 235 aa, Glycine max
  Coding DNA Sequence Number=SeqID_37847
  Gene Ontology: Mol. function=O-sialoglycoprotein endopeptidase activity; Cellular component=extracellular region; Biological process=proteolysis
  Homolog annotation: Hit_ID=A7PYD9; Match level="QueryCoverage=65%, HitCoverage=42%, E-value=2e-62, Identity=65%"; Hit description =Chromosome chr15 scaffold_37, whole genome shotgun sequence
  Pfam annotation: Domain name=Peptidase_M22; Domain location=103-232; Score=-1.0; E_value=2.9e-06; Accession=PF00814.16; Description =Glycoprotease family
  Subcellular localization annotation: CTP_CleavageSite=72; ConfidenceScore=5.86e-01
VIVFGKKIVPFRRKTLSALSSASSSLTMVLSLSTLGFSSALSRLNFFPKPPPSLFSALTTFRRNQLPLKSSLAASKRDGDVVVLGIETSCDDTAAAVVRSDGEILSQVVSSQADLLAKYGGVAPKMAEEAHSKVIDQVVQEALDKAYLTEKDLTAVAVTIGPGLSLCLRGGHNLLVLARDLGQYIQLGTTIDDAIGEAYDKTAKWLGLDLRRSGGPAIEKLAMEGNAESVKFSVS

SEQ ID NO: 129533 - protein, 110 aa, Glycine max
  Coding DNA Sequence Number=SeqID_37848
MPSMIYHLCCFALTEGTRLLQVEVLLRTPLSTKHWGHKMHWLMWCLLQKKILRENRRTRSGVIASIEVVRGNLLGIRRVMMPPIGLSFGPFFSRPQPWLNISWGPRMLML

SEQ ID NO: 129534 - protein, 28 aa, Glycine max
  Coding DNA Sequence Number=SeqID_37849
MKHFTDTLISAHRNSYDHDYAKLEINPH

SEQ ID NO: 129535 - protein, 124 aa, Glycine max
  Coding DNA Sequence Number=SeqID_37850
MKVQGWFCDRHKTGVGSDVGIVEFNFGWDGACTVVLVFVSGSGRGDGLGGGEKKVNVKRNATIKPTQVKDRINYNTIMECKFICENRGTSIVPFPMVGAQLSSKVSSSLLAHSIVVDVFVTDFH

SEQ ID NO: 129536 - protein, 185 aa, Glycine max
  Coding DNA Sequence Number=SeqID_37851
  Gene Ontology: Cellular component=integral to membrane
  Homolog annotation: Hit_ID=A7R385; Match level="QueryCoverage=39%, HitCoverage=36%, E-value=5e-19, Identity=64%"; Hit description =Chromosome undetermined scaffold_490, whole genome shotgun sequence
MKASSKITVVLGDCKEQYNNALENLHRAMKVIPPHDLSTIIVMLSVVMVGVSVCDNGFEEHKNPKDYANRSTIQWHRVSVYPQKLRDLVTEHVVPTLRFIYYHSVDLKGENEYLGLGVSLGNVPMYHGTKLKVLDRKVRITELMLKCVSRSLRVVAIVLMVIDSQVKEFFSFQKKAKLTDMKALV

SEQ ID NO: 129537 - protein, 238 aa, Glycine max
  Coding DNA Sequence Number=SeqID_37852
MKTPTHGFTKPIQLNIFTDGLRPQSKQLLDASTRGKIKLKTPEEAMELIKNMAVSDHAILRDRTHIPTKRSLLELSSQDTLLEQNKLLAKQLESLIETLSKLPTQLQVAQPFHSVVMQVRGCSICGGAHESSYCIPQDDSAKISSAELNICFISILISVYILNIHGLGETNSLRIGYSILPLYILLGWAEPKKSQPARIWAKLGSTRLYCLARWMRSGKPNLSILLALTKSKGGSALA

SEQ ID NO: 129538 - protein, 490 aa, Glycine max
  Coding DNA Sequence Number=SeqID_37853
  Gene Ontology: Mol. function=enzyme inhibitor activity; Cellular component=cell wall; Biological process=cell wall modification
  Homolog annotation: Hit_ID=A7PYC8; Match level="QueryCoverage=86%, HitCoverage=87%, E-value=1e-155, Identity=62%"; Hit description =Chromosome chr15 scaffold_37, whole genome shotgun sequence
  Pfam annotation: Domain name=PMEI; Domain location=12-139; Score =23.3; E_value=0.00018; Accession=PF04043.6; Description=Plant invertasepectin methylesterase inhibitor
  Pfam annotation: Domain name=Pectinesterase; Domain location=176-476; Score=677.3; E_value=1.2e-200; Accession=PF01095.10; Description =Pectinesterase
  Pfam module annotation: Pfam domain module=PMEI::Pectinesterase; Domain location=12-139::176-476
MVTYVVTTTLFLFLAMAITTLCLQEIEVLQMAQNHVSQAKNLIGNSLRLHGLGSLSLSDQTSATIALSDCAKLYEESESRLSHMMAQESYYAKEDALTWMSAVMTNHRTCLDGLKEKGYIEAQVLDRNLTMLLKQALVVYSKNNKGKGKGPPEGTISKSDYAGILESWSESSYKPDFTVAQDGSGTHGTIQAAVNALAAMGHNRPARAVIHVKSGVYHEKVEIGQKLHNVMLVGDGIDKTIVTGNRNVVQGSTTLNSATFDVSGDGFWARDMTFENSAGPEKHQAVALKVSSDLSVFYRCSFRAYQDTLYVHSNRQFYRDCYVYGTIDFIFGDATVVLQNCDIFVRKPMSHQSNFITAQGRDDPNKNTGISIQSCRVRPDSEFLTLKESFKTFLGRPWRKYSRTVFLKTDLDGLVHPRGWGEWSGEFALSTLYYGEYLNTGYGASTQNRVNWPGFHVLRSASEATPFTVNQFLQGERWIPATGVPFSSGI

SEQ ID NO: 129539 - protein, 91 aa, Glycine max
  Coding DNA Sequence Number=SeqID_37854
  Gene Ontology: Mol. function=aspartyl esterase activity; Cellular component=extracellular region; Biological process=cell wall organization and biogenesis
  Homolog annotation: Hit_ID=A7PYC6; Match level="QueryCoverage=52%, HitCoverage=9%, E-value=8e-18, Identity=81%"; Hit description =Chromosome chr15 scaffold_37, whole genome shotgun sequence
  Pfam annotation: Domain name=Pectinesterase; Domain location=1-64; Score=-215.4; E_value=2.7e-05; Accession=PF01095.10; Description =Pectinesterase
MKTYLDGFINPQGWMEWSGNFALNTLYYGEYMNNGPGSSTARRVKWPGKRSKGDGVVGVNMKGKCEGGIGKGGRKKIKEVQEAKAEKKTFN

SEQ ID NO: 129540 - protein, 242 aa, Glycine max
  Coding DNA Sequence Number=SeqID_37855
  Homolog annotation: Hit_ID=A5B5G7; Match level="QueryCoverage=87%, HitCoverage=15%, E-value=2e-09, Identity=27%"; Hit description =Putative uncharacterized protein
MMKAYHDRKLVKRNFQTEQQVLLFNSRLKLFLGKLKSKCWIVNGQRLKIYNGGNIERLPPSSTSKTHEDVSRQASDVKEALTRRQHRISDLTLMASKKRRAAPSQSQGAKPAWDSSHFVSEVAWHRYQDNIHLQNILSEWNRRQWHQRLSNLPEKGIDLALVKEFYTNIYDSKDGSLEQCRVRGKLIKFDEQTLNVFLETLVIIPEGESLTTFSQFMHTYPNAQTIVAKLCMSGGHFVLNVE

SEQ ID NO: 129541 - protein, 181 aa, Glycine max
  Coding DNA Sequence Number=SeqID_37856
  Gene Ontology: Mol. function=SNAP receptor activity; Cellular component=endoplasmic reticulum; Biological process=intracellular protein transport
  Homolog annotation: Hit_ID=A7PYC3; Match level="QueryCoverage=62%, HitCoverage=46%, E-value=2e-49, Identity=88%"; Hit description =Chromosome chr15 scaffold_37, whole genome shotgun sequence
MRDTNLELQESGWEELRKEARKIEGDLDVKLSSYAKLGARFTQGGSGYVDSGSPPIGSSRSWKSMEMEIQSLLEKLLDINDSMSRCAASAGPATSVTQKLARHRDILHEFTQEKTSAYALSSQDPIYYLQVIAYSLTLAYAKRLFPDSNSLPTGIGETSTVVSVVEFGSYKGKRGGPGNTS

SEQ ID NO: 129542 - protein, 157 aa, Glycine max
  Coding DNA Sequence Number=SeqID_37857
  Gene Ontology: Mol. function=kinase activity; Cellular component =integral to membrane; Biological process=recognition or rejection of self pollen
  Homolog annotation: Hit_ID=A7P182; Match level="QueryCoverage=65%, HitCoverage=12%, E-value=7e-27, Identity=52%"; Hit description =Chromosome chr19 scaffold_4, whole genome shotgun sequence
  Pfam annotation: Domain name=PAN_2; Domain location=82-150; Score =97.8; E_value=3.4e-26; Accession=PF08276.2; Description=PAN-like domain
MEQLKQKAQGNQVIVEVPFILLLIFIAEKLEGNCLSVANCLFNVGVEEGFFCNGEGFKPKLPKAWSSMDWSHGFIRNKELRCENKNNDGFNKLTLLKTPDTTHSWLDQTIGLEECKVKCLDNCYCMAYTNLDISGQGSGCAMWFGDLIDIRQFAVGG

SEQ ID NO: 129543 - protein, 41 aa, Glycine max
  Coding DNA Sequence Number=SeqID_37858
MEEERVEVGVMEAHEVEGGEKGEPEEEVLEEEEANEEMSPN

SEQ ID NO: 129544 - protein, 152 aa, Glycine max
  Coding DNA Sequence Number=SeqID_37859
  Homolog annotation: Hit_ID=A5C3I5; Match level="QueryCoverage=53%, HitCoverage=6%, E-value=2e-14, Identity=51%"; Hit description =Putative uncharacterized protein
MEECKSVSTLMNQKEKFSKEEGVDNIDEGYYGSLIGCLMYLTTTRPNILFSQNHKTGIFVDNQVVIAIANNPVCHGKTKHFNIKKNIIKNREKMVADTKNRTSMAYYNREERDWGRVCGIGNEENAREGTLQRTAKKEDDNNDDERRQHWRQ

SEQ ID NO: 129545 - protein, 104 aa, Glycine max
  Coding DNA Sequence Number=SeqID_37860
  Homolog annotation: Hit_ID=A5ARS3; Match level="QueryCoverage=95%, HitCoverage=9%, E-value=6e-07, Identity=30%"; Hit description =Putative uncharacterized protein
MEAGSNASIISQDEVQLRKSLQEQLWSAALAYESMLRQKSRVKWIREGDRNSSYFHRIINRRRRNQCRPTLDGIQFNSLDQGQRQSLVARFSEGKIKSAVWASD

SEQ ID NO: 129546 - protein, 27 aa, Glycine max
  Coding DNA Sequence Number=SeqID_37861
MLSCLVNVAQAQSTNATTDPSEVGLKD

SEQ ID NO: 129547 - protein, 72 aa, Glycine max
  Coding DNA Sequence Number=SeqID_37862
MQGVNTSDSTHTTQGVNCVYATHPHVGALSLENARNAPAMFRCGDQLDPRKTPTDQVNPCNRGEPNADQVDP

SEQ ID NO: 129548 - protein, 68 aa, Glycine max
  Coding DNA Sequence Number=SeqID_37863
MTLTAVTTAGRNCDNSIGGDKGCHGSDHDDVVIVTTTTVMLMITTVVIATIMMVVIATMVMVVVTILT

SEQ ID NO: 129549 - protein, 178 aa, Glycine max
  Coding DNA Sequence Number=SeqID_37864
MTTLGTNREGARLEEEAFPLLSLSISRSRLFFREATWALNTKSMRAVLYARLQEEKLMDARRPPPYHPPTTIATTITTQSPSPNPTPPLLPTPQRTTTTSIPFKRLTPEELAVCWEKGLCFHCDEKFSRGHKCSSSLFLLVTEDEELTPQLAPPRSPSPDLLSEPSLAQLSLLALSGH

SEQ ID NO: 129550 - protein, 70 aa, Glycine max
  Coding DNA Sequence Number=SeqID_37865
MASGTACSACEAGWPEWLAGRARGDVLDYKCEVKSHIEMASGQGKYRRWPWLYSWMIKEFPGYHVKETHT

SEQ ID NO: 129551 - protein, 204 aa, Glycine max
  Coding DNA Sequence Number=SeqID_37866
  Gene Ontology: Mol. function=secondary active sulfate transmembrane transporter activity; Cellular component=integral to membrane; Biological process=sulfate transport
  Homolog annotation: Hit_ID=A7X2P1; Match level="QueryCoverage=39%, HitCoverage=12%, E-value=1e-25, Identity=72%"; Hit description =Putative sulfate transporter
MQFFSEKENQETHPGEGNALEKNPHCVAMVLPEKDKPVEDVRHRVKKTMKRELYIKASSKGRPSTIREVKALNIGQLVRISGYIYMEFQLVDGNDDMGVSGDVGLSTYEVQMHQETYEALMLTEEVSPSEQPDLFLQLALTSTFFAGIFQAALGILRLGFIIDFLSKAILIGFMVGSAVIVALQQLKGLHGIKHFTKKMQQLKD

SEQ ID NO: 129552 - protein, 97 aa, Glycine max
  Coding DNA Sequence Number=SeqID_37867
MVSRGIIPFDRHIAAVGTTSNNMLSKRKTLDEGSLLSSKSETQHDHRFTSTPYVPMDPVRSGVANCRNLPFDRRATRGLTGVSSMGGKCAESPPTFI

SEQ ID NO: 129553 - protein, 42 aa, Glycine max
  Coding DNA Sequence Number=SeqID_37868
MRCLHALSNLPSPDSKDLPSLDDEGADNHEVSPRAIGLVVSG

SEQ ID NO: 129554 - protein, 25 aa, Glycine max
  Coding DNA Sequence Number=SeqID_37869
MSNVSPVGYSSTTTKRTTCLQMVGR

SEQ ID NO: 129555 - protein, 58 aa, Glycine max
  Coding DNA Sequence Number=SeqID_37870
MPSLYDRTTKLEETLAQFMQVSMSNQKTTESAIKNLEVQLNLKKLLRKQKVMKKKRHQ

SEQ ID NO: 129556 - protein, 41 aa, Glycine max
  Coding DNA Sequence Number=SeqID_37871
MTGKLIGRSPTLTWLDFVECPKVQDEKLKNLEMDLMVCAMV

SEQ ID NO: 129557 - protein, 195 aa, Glycine max
  Coding DNA Sequence Number=SeqID_37872
  Homolog annotation: Hit_ID=Q9AVH2; Match level="QueryCoverage=77%, HitCoverage=53%, E-value=2e-53, Identity=68%"; Hit description =Putative senescence-associated protein
ILPAARWELRFKASRRANPPHEGHQRHVPLGGRGPLLLGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 129558 - protein, 146 aa, Glycine max
  Coding DNA Sequence Number=SeqID_37873
  Subcellular localization annotation: CTP_CleavageSite=36; ConfidenceScore=5.72e-01
MATPPSSPPPPPPTDSTSHSRSTMKRTRKVTRLRPLATRPVGAKRPLFKSDLTSKWALATDKDGVDDTVCKKYDISKWTQFCQSHKDPSWEVQTIQKQNTAPHVLSRGDYEFVKKKLMDEKKKKQLEEAAKSRSTNTVIDPPSPNR

SEQ ID NO: 129559 - protein, 145 aa, Glycine max
  Coding DNA Sequence Number=SeqID_37874
  Homolog annotation: Hit_ID=Q6UUU1; Match level="QueryCoverage=54%, HitCoverage=53%, E-value=8e-32, Identity=84%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGPRLSHSTPDTQFRVGQFASKLDCMHEPPVQSDRCAFIPVTIVLESNPERHAKAPLGSSHW

SEQ ID NO: 129560 - protein, 29 aa, Glycine max
  Coding DNA Sequence Number=SeqID_37875
MEAVSMGLVAGIDAGTQSLKVLVYDPRKQ

SEQ ID NO: 129561 - protein, 276 aa, Glycine max
  Coding DNA Sequence Number=SeqID_37876
  Gene Ontology: Mol. function=argininosuccinate synthase activity; Cellular component=cytoplasm; Biological process=amino acid biosynthetic process
  Homolog annotation: Hit_ID=Q8Z3H5; Match level="QueryCoverage=100%, HitCoverage=61%, E-value=1e-138, Identity=89%"; Hit description =Argininosuccinate synthase
  Pfam annotation: Domain name=Arginosuc_synth; Domain location=1-247; Score=-173.7; E_value=6.2e-06; Accession=PF00764.10; Description =Arginosuccinate synthase
MSEFMIACGFDYKMSVEKAYSTDSNMLGATHEAKDLEFLNSSVKIVNPIMGVKFWDESVKIAAEEVTVRFEQGHPVALNGKTFSDDVELMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSDNLTYKAERLTMEKGDSMFTAEDRIGQLTMRNLDITDTREKLFGYAQSGLLSASSAIGLPQVENLENRDK

SEQ ID NO: 129562 - protein, 149 aa, Glycine max
  Coding DNA Sequence Number=SeqID_37877
MEFISILDHTPLVVTTEVVVPRDGLKQNIHGCSMFKVCKKLKALKAPLKNLFKQEFRNISNQVELAEAEYNSVLNSLMQNPQYPSLLALANRTRGQTIMLRKAESMKFAQLIKNRYLLQADKCSKFFHALIKRNRHSRVYCCHKARGWA

SEQ ID NO: 129563 - protein, 35 aa, Glycine max
  Coding DNA Sequence Number=SeqID_37878
VSIYDAVATYPSAGGRRVTRGMRVSTKGIRAESPP

SEQ ID NO: 129564 - protein, 124 aa, Glycine max
  Coding DNA Sequence Number=SeqID_37879
MLGIGSTFGRPPVLGWNWLCDSDLVSPTGIERVLTEKDLLADAYSDLEASILDEKEFLLLKVISTFPELSCLICSMVGAGWGIDGVALSITHLSGRVTSSHFIFLGRETLAFVISVINKVVSPL

SEQ ID NO: 129565 - protein, 100 aa, Glycine max
  Coding DNA Sequence Number=SeqID_37880
AYPAGSFDTERYLWHLVRQQAANHRAHMQTHDCLYQLSLSLQSQGFASFPCPTPDQFRAEVAWPGDWPEAQAREAPAEAPGDADEARMDEEMTDLLDFLG

SEQ ID NO: 129566 - protein, 70 aa, Glycine max
  Coding DNA Sequence Number=SeqID_37881
MVRIDVIWEPTSQGCTREDADEFIFCSYNGHNWVSSKIDAALGIVSHNDDFQCGVGPKFRVSLVEHAVAA

SEQ ID NO: 129567 - protein, 182 aa, Glycine max
  Coding DNA Sequence Number=SeqID_37882
MGDQEEIQEHMKVDMSALKEKMASMMDVMLGMRQLMKNNVATAAAVSSAAKADPTLLATRTILSQTCNPHLGYNRVSYPYGLPPDYTPPVMRDDTGHVPSPILEGEFPRQSDEVHEDHREHAQGDIDFYPRSPSRGRHPTHYLSPTSRGSLETSQHSQYSCPQKDHPRQRKRKGNSISSKRD

SEQ ID NO: 129568 - protein, 121 aa, Glycine max
  Coding DNA Sequence Number=SeqID_37883
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=42%, HitCoverage=50%, E-value=4e-24, Identity=100%"; Hit description=LacZ protein
MPSYTGILKKKSIWNDPQDIQKVQILPCPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 129569 - protein, 263 aa, Glycine max
  Coding DNA Sequence Number=SeqID_37884
  Gene Ontology: Mol. function=aspartic-type endopeptidase activity; Cellular component=intrinsic to membrane; Biological process=DNA integration
  Homolog annotation: Hit_ID=A5BDR0; Match level="QueryCoverage=68%, HitCoverage=15%, E-value=2e-40, Identity=44%"; Hit description =Putative uncharacterized protein
MAEDHSSPGVPVAVATGSPGVATRIEFESNPNQQLSSIVLNEFNYLPWSRVLTLAFGGRSKLSFIDEKVSPPDETSLDDESWLSKDELVQSWILNSTSPHLAEIFSYPNSVVQLLTTVRDILKRMWNELEVYRPHILDVAILRKGVEEDIIFQLLASPDPEYEDLRSHILMSPELPEIREFQVLQIQIPQLFLVSFLVSWGTSSFLFMKAPKISILFTPSHVSVANGYVVPVIGKGKLKLFPNDLALYVPSFPDQLLSIQKLT

SEQ ID NO: 129570 - protein, 197 aa, Glycine max
  Coding DNA Sequence Number=SeqID_37885
  Gene Ontology: Mol. function=ribonuclease H activity; Cellular component=cytoplasm; Biological process=RNA catabolic process
  Homolog annotation: Hit_ID=A8GID2; Match level="QueryCoverage=100%, HitCoverage=100%, E-value=1e-100, Identity=94%"; Hit description =Ribonuclease HII
  Pfam annotation: Domain name=RNase_HII; Domain location=14-191; Score= 315.6; E_value=8.9e-92; Accession=PF01351.9; Description=Ribonuclease HII
MIEPFIYPAATLIAGVDEVGRGPLVGAVVTAAVILDPAQPIVGLADSKKLSEKRRLALYDEIVAKALSWSLGRAEPAEIDQLNILHATMLAMQRAVAGLHIAPDMVLIDGNRCPNLPMRSQAVVKGDSRVAEISAASILAKVTRDREMAALDSEFPDYGFAQHKGYPTAFHLERLAALGATEHHRRSFAPVKRALAL

SEQ ID NO: 129571 - protein, 26 aa, Glycine max
  Coding DNA Sequence Number=SeqID_37886
NGCFLNVKGSDDMKSLNVNSCGSNRR

SEQ ID NO: 129572 - protein, 45 aa, Glycine max
  Coding DNA Sequence Number=SeqID_37887
MTIICLCVPPDTTVSEWQKGPPPLDDKRAQNDHNLSLRATGHNCV

SEQ ID NO: 129573 - protein, 34 aa, Glycine max
  Coding DNA Sequence Number=SeqID_37888
MKSLRGKEIALVKCICIYVLGRNRSSGGKIRELG

SEQ ID NO: 129574 - protein, 77 aa, Glycine max
  Coding DNA Sequence Number=SeqID_37889
  Homolog annotation: Hit_ID=Q84VH5; Match level="QueryCoverage=37%, HitCoverage=4%, E-value=8e-07, Identity=96%"; Hit description =Envelope-like protein
MQVLEATIKATTEKKMELERLIKRLSDSGIDEEEAAVEEEAAEEEEEAAENEEEAAEEEEDAAEDTESDDDDSDATP

SEQ ID NO: 129575 - protein, 100 aa, Glycine max
  Coding DNA Sequence Number=SeqID_37890
MEVEETYRGLWLPLHYQVDKGALCCKIPSLVGVLTGSVVDLGMAFADNWVVGKEKEVCYWLSNDIVWVGGKLGRIGMAVTNMGFSLILTLFISPQFSQSS

SEQ ID NO: 129576 - protein, 97 aa, Glycine max
  Coding DNA Sequence Number=SeqID_37891
MEHYLQHLVRQQAANHRGQVQIHECLYRFSLSQQGQGFTPFACPTLEQFGDEVAWPGDWPEAQAGEEPAGSPSEAKEARMDEEMTDLLGFLGGSGVT

SEQ ID NO: 129577 - protein, 87 aa, Glycine max
  Coding DNA Sequence Number=SeqID_37892
MHVLHSHLPHKFFEGRNVWSAWASSILEGRSRLLLLLLRVGPSEATQLLQVAAWKGKGLYGGQQRSTNQKPLRQVQIFDSRPAGLPS

SEQ ID NO: 129578 - protein, 187 aa, Glycine max
  Coding DNA Sequence Number=SeqID_37893
METCLEVEELLQRMIDQGRLEVGIKGKEEPHICMQSTEGSGIAKPKPLVIYFTKSAASQKPGHPLMVKPVPFPYQNSHAVPWRYTPPEKKEEEVTDVSSLSAKVTNITGLSGVTRSGRVFAPPDLPVQPADVKGKGKVVEEQDGEAPHASNKDIPAKGPPEKRDGRKEVSLEEASEFLRIIQQSEFK

SEQ ID NO: 129579 - protein, 339 aa, Glycine max
  Coding DNA Sequence Number=SeqID_37894
MGFVTWWEKYYSGRSVGDTTIMISRLESGFTQPTVENIRSNLQARGKTIMTKKIAETSRADVRPKKPTGVKIQEWKQEEKNHKKDDSTETTTTSKRSKRVVIEFDEEKDASFIPNEEEERPLVRKRKSPETSTKSADQTEAGDSQAQMPKKKKKVKQIEPEPSVTVEGGEPVRKKKKKTKSSKEQGENQPADVQPPSTDVGGAETETTPSIAEMGNLVEQPDLPQEHPTVEVQQNVSVEEIPSCARTSPAPETDAVNVEEQGEGQGIGPSSPQGSNQRSSSEEHFSDEEAIQEAEAGGSDIFPASSTSKLSASIGIAEDTFIQMQDEDPAAALRLLLNT

SEQ ID NO: 129580 - protein, 53 aa, Glycine max
  Coding DNA Sequence Number=SeqID_37895
MSCTAHEHEQGHQFKPEIRFCEGSLDWDSELCMPRVSRERKRPELEAGAGLRA

SEQ ID NO: 129581 - protein, 252 aa, Glycine max
  Coding DNA Sequence Number=SeqID_37896
  Homolog annotation: Hit_ID=A1FWQ3; Match level="QueryCoverage=59%, HitCoverage=14%, E-value=4e-29, Identity=50%"; Hit description =Tetratricopeptide TPR_2 precursor
  Subcellular localization annotation: CTP_CleavageSite=83; ConfidenceScore=5.85e-01
MRNRSPAKIAASSPPVPARTSRNRLPSSRGSRGTSSSASSCSSSCRRACAAAISSSASSRRSGSARMPSAAARSALARASSARAMAIGSSWANSRERSRKRVLSATTSGSASRRSSSSRRSASASSLRRRVGVIGSHGWVAVTRRGREQALGGAGQVGIATQRGRTQGGGRRMQQAVGQAVGKQFQHFIGRLAVGQLLACALQQLGTGGFAERAQLPQRRLVGAGLLGLDEARHLQVDDRLGFGGGLAAATA

SEQ ID NO: 129582 - protein, 86 aa, Glycine max
  Coding DNA Sequence Number=SeqID_37897
MVNIIKNRASGPLSPINRRRLIGQCLSYKRKRHIREGTPLKEHLDELNSVLMELRDIDVKMEDEVLKAMHPIAHLIILYGICIWAT

SEQ ID NO: 129583 - protein, 96 aa, Glycine max
  Coding DNA Sequence Number=SeqID_37898
MTKYVYLDNEGHQKDDPSVKYGIDVATWAEFAKSRQTPTWQWLFVREYGKRLRKFKNTITAPTYYLVGVMIYWKKTYWTKKGRHKNNKQNLLKILH

SEQ ID NO: 129584 - protein, 108 aa, Glycine max
  Coding DNA Sequence Number=SeqID_37899
MDEDQWTYDNTMSQEVDMDYENEQECGVNEPSHVDCLDAFNTSQVFGTRDDVLQWARSVTYENGFVAIIMSQYKCRKKEFVRRDTGSRKCGCPFKLRGKPVHGWEGWM

SEQ ID NO: 129585 - protein, 78 aa, Glycine max
  Coding DNA Sequence Number=SeqID_37900
  Subcellular localization annotation: CTP_CleavageSite=39; ConfidenceScore=5.34e-01
MDHNFLTSPSSQKSLNHPLGMSIKGGAGGAGGGGRISTSGEAGGSNTGGRDSTGAGSILVGMGLGAQPRKIFLTTAEL

SEQ ID NO: 129586 - protein, 235 aa, Glycine max
  Coding DNA Sequence Number=SeqID_37901
MAEVVSEESFEAPEEDEEVQALKSELGKAKLAKEKFKLAATHIRKECAGLREENATTARALEQETKRARKEEYGRNKFRGALWGSNSELKLRREERDQSRAHSMVLKEELVACSRSKKSLSQRLCETETNMLAIIAKYQEELGLATAHEHKIADEYAQVYAEKEARERVIDSLHQEATMWMDRFALTLNGSQELPRLLAKAKAMADTYSVPEEIHGLLGYCQHMIDLMAHIIRNR

SEQ ID NO: 129587 - protein, 94 aa, Glycine max
  Coding DNA Sequence Number=SeqID_37902
  Homolog annotation: Hit_ID=A0PAV3; Match level="QueryCoverage=39%, HitCoverage=17%, E-value=4e-07, Identity=78%"; Hit description =Restriction endonuclease
MVKVDLYVPINVSFSPKVGPGLPGINRDTRIYLFCEVIFRHSCPSCSATDGVAAQLLGRAIGAGLFAITPAGERGMCCKAIKLGNARVFPVTTL

SEQ ID NO: 129588 - protein, 111 aa, Glycine max
  Coding DNA Sequence Number=SeqID_37903
MAQELIKGNYWPLNRERKSWLSIQGQRTLYSPKVWIWSTLKMLTRSPLKARACNPLQARMCSPLMVRTYSPLKVIGTSTQGSTFMRKQEIDSSRGPIIQKDWTRDVGNLCS

SEQ ID NO: 129589 - protein, 98 aa, Glycine max
  Coding DNA Sequence Number=SeqID_37904
AHMGHLRFIILFGRSNQHENIKKGVPTNPKRIKVIPELSTPPTPLIELVRNHVPSWEDAQEMGGENDAILLPKALDRRLQGDWDRDAREGPRVLISLR

SEQ ID NO: 129590 - protein, 131 aa, Glycine max
  Coding DNA Sequence Number=SeqID_37905
  Homolog annotation: Hit_ID=A5ATL8; Match level="QueryCoverage=43%, HitCoverage=45%, E-value=3e-19, Identity=82%"; Hit description =Putative uncharacterized protein
RRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRD

SEQ ID NO: 129591 - protein, 173 aa, Glycine max
  Coding DNA Sequence Number=SeqID_37906
  Homolog annotation: Hit_ID=UPI00006A2D9E; Match level="QueryCoverage =99%, HitCoverage=97%, E-value=2e-11, Identity=15%"; Hit description =UPI00006A2D9E related cluster
MFSHKVDPWVLEPIAFRGLHVLAFRGLHALTLRGLHVLTFRGLRVLAFRGLHALTFRGGLHVLAFRGPHALTSRGLHVLTFKGLHVLAFKGSCTYVFVRLHALTFRGLHVLAFRGLHVPTFRGMHAFAFRGLHVPLFNGLHALALRGRHTLTFRGLHALAIIGLHSLAFKRRH

SEQ ID NO: 129592 - protein, 102 aa, Glycine max
  Coding DNA Sequence Number=SeqID_37907
  Gene Ontology: Mol. function=aminoacyl-tRNA hydrolase activity
  Homolog annotation: Hit_ID=P0AAW3; Match level="QueryCoverage=100%, HitCoverage=48%, E-value=8e-42, Identity=73%"; Hit description =Uncharacterized protein ybhP
MTGKAIHVMCVHLGLREAHRQAQLAMLAEWVNELPDGEPPDWMRFLPAPTDARARTFPVQFPLLRLDRIYVKNASASAPTALPLRTWRHLSDHAPLSAEIHL

SEQ ID NO: 129593 - protein, 105 aa, Glycine max
  Coding DNA Sequence Number=SeqID_37908
MENCTKQSLRMTPNSWVEDRMNENAIHGAPKKGLRMENCTKQSLRMAPELVGGGCMNSVGKKFMGLRKKSLRMENCTKQSLCMVPKLVGGGRMNENTIHGAPKKG

SEQ ID NO: 129594 - protein, 20 aa, Glycine max
  Coding DNA Sequence Number=SeqID_37909
MKIQKKVLREGAQSMKNLGI

SEQ ID NO: 129595 - protein, 69 aa, Glycine max
  Coding DNA Sequence Number=SeqID_37910
MGDQEEVQEQMKADMSALKEQMASMMDAMLGMRQLMENNAATAAAVSSAAEADPTLPATVHHPIPNMLG

SEQ ID NO: 129596 - protein, 333 aa, Glycine max
  Coding DNA Sequence Number=SeqID_37911
MASRKISTKRSRKDATTEGTSAAPEFDSRHFRSAEHQQCFEAIKGWSFHRERRVQLRDDEYTDFQEEIARRRWTSLVTPMAKFDPDIVLEFYANAWPTEEGVRDLRSWECEYSQRRNRADGFDEEAIAQLLCIPGQDFSRTAAGRRVRIMRTNMTTLTQTWMTLLLSNILPSDHNSDLPLQKCQLVYAILTRMSVHVAQLIADAIYLFAALITSLCQSFGVPVTPSKVIRPSITRAFIEKYCTPRQAQGDAPQAADAPPPPHQADPAGSFDTERYLRHLVRQQATNHRAHVQTHDCLYQLSLNLQSQGFTSFPCPTPDQFRAEVAWPGDWPEA

SEQ ID NO: 129597 - protein, 94 aa, Glycine max
  Coding DNA Sequence Number=SeqID_37912
MRAVLPQLTFALKFGNRVGAVVRDNLPWQTISADDLFLNEPDHHTPRDIGVGGRLDPLGKIIYRYEDEAMTIRGLGLNGPDDIYSPHGERPRGG

SEQ ID NO: 129598 - protein, 62 aa, Glycine max
  Coding DNA Sequence Number=SeqID_37913
MERIQKSTSGDNSQGWFHELSTTMHHQKRKTLDEASLLSSESETLHDHRSTSTPYGSPGYTP

SEQ ID NO: 129599 - protein, 81 aa, Glycine max
  Coding DNA Sequence Number=SeqID_37914
MERYLHTWSQQVPNHRGQGQGFAPFTCPTPDQFRAEVAWPGDWLEAQVGEAPAVAPGDAEEARMDEEMTDLLGFLGGSGAT

SEQ ID NO: 129600 - protein, 81 aa, Glycine max
  Coding DNA Sequence Number=SeqID_37915
MKVCMIYISSVCRKWPQGSLPQRDPGRIKRLKEPVPLPKKTTIILGALSTSSASRPSTDGHFSGSDASSSGTTSIPTSRRR

SEQ ID NO: 129601 - protein, 160 aa, Glycine max
  Coding DNA Sequence Number=SeqID_37916
DCYCLTVGTVDEIIIDAPWSYDSCPNCTTTFDPSKGGPACRSCHTSVIDTVPQMEHNRDKGNFLLWDATCIKLFGKTAGECRDELIAAVRFKFRSQLRQSSVLDVSEELHHIQSLIATLGLKPSLSQSSDYDPGNSTCLTPTKRINCQQTSSNFDSDEHT

SEQ ID NO: 129602 - protein, 163 aa, Glycine max
  Coding DNA Sequence Number=SeqID_37917
MVIDQSLFYDLTQLPSEGVPFEGTLDDDWKFDFSVHDARRLVCTNQADMTGRLLADSLALESHILHYLIVRILLSRSSNLAQVSEEDLIVISFLIGAAVVASFGYRKERDGSWVKKGTQPNDDEGQLPVEGDSSLLQSILDRFDGLQTYVGERFDALERQVDT

SEQ ID NO: 129603 - protein, 287 aa, Glycine max
  Coding DNA Sequence Number=SeqID_37918
  Subcellular localization annotation: CTP_CleavageSite=87; ConfidenceScore=5.05e-01
LQRTTQSSPSEDCTSSPFRGLHALAFGRLHALSLRGLHILTFRGLHLSPSEGCTSSLQRTPRRRLQRTARPHLQRTTRLTFKGLHVLAFRGLHVLAFRGLHILAFQRSTRPQPSENYTFLPLERLHDPRFSEDYTSSPSEDCYLPSSEGYTPSPSRGLHHVLTFKEGYCPSPYRGLHSSPSEGYTPSPSEGLHRPPFRGLHVFAYQRDTASLTIQRTTRPHLSRGLHVLALQRDYTSSPSEDYIRPRLSEGYTPIVTFRKGYTSAFQRSATDPPSEDYMSSPSEGYT

SEQ ID NO: 129604 - protein, 48 aa, Glycine max
  Coding DNA Sequence Number=SeqID_37919
  Gene Ontology: Cellular component=anchored to membrane
  Homolog annotation: Hit_ID=Q69F98; Match level="QueryCoverage=100%, HitCoverage=10%, E-value=4e-19, Identity=85%"; Hit description =Phytochelatin synthetase-like protein
GPRGNVQAELLFRKDNATFTSDKGWAFPRRIYFNGDMCLMPPPDAYPF

SEQ ID NO: 129605 - protein, 140 aa, Glycine max
  Coding DNA Sequence Number=SeqID_37920
  Homolog annotation: Hit_ID=Q949K7; Match level="QueryCoverage=30%, HitCoverage=48%, E-value=2e-07, Identity=58%"; Hit description =Putative gag polyprotein
MAEKGKGGSSKRKGSGPLKEVLDFDKYKGTTCLKNHLKMYCQKMGEYAKDEELLIHSFLESLYWGSCYLKICKKGDGSFKEHAQKVEGSSGPSGTPNDGKGDDDRDGRHIIDTLLWKDGGLRTLKALRIWSSPVKGSKLI

SEQ ID NO: 129606 - protein, 112 aa, Glycine max
  Coding DNA Sequence Number=SeqID_37921
MPYLLSKAVNHIKNSFSLDACTSFFLLRLDFKGTVDSRYERIEPEPEGENLEESLPVGRLSDWERGYLRVPTSIGPNSPKQAWHDAHCHFLFSLCARFLPFKRIRRGKRHSS

SEQ ID NO: 129607 - protein, 81 aa, Glycine max
  Coding DNA Sequence Number=SeqID_37922
MQQGQADILIARFPDPSYGVKTDVRNGFGRKKEEEMVFFLSYVKAKAENAQVRNGLGHRNVAHTPNIFSTIPTVRPWTSVL

SEQ ID NO: 129608 - protein, 167 aa, Glycine max
  Coding DNA Sequence Number=SeqID_37923
GLGISRLDHRTLPVVRRPVTPSKVIRPPITRAFIEKYCTQRQIQGDARQAADAPPPHQAGPAGLFDTEQYLRHLVRQQAANHRAHVQAHDCLYQMSLSLQSQGFTSFPCPTPDQFRAEVAWPGDWPEAQAGEAPAGAPAEAPAEADEAREDEEMTDLLDFLGGSGAT

SEQ ID NO: 129609 - protein, 86 aa, Glycine max
  Coding DNA Sequence Number=SeqID_37924
MIQREWRKELAFPVTRNAVDSDSKCPFASSKGCIVIDYTNMVIDYQKATLPEITACNRLHYYGNRLPVVILARKQKPKGFLGEKKF

SEQ ID NO: 129610 - protein, 49 aa, Glycine max
  Coding DNA Sequence Number=SeqID_37925
MTSLVRLARSAHDIMFVHAKQWAIPYISRMQEYTSLMSFKTHYVDLNED

SEQ ID NO: 129611 - protein, 116 aa, Glycine max
  Coding DNA Sequence Number=SeqID_37926
MGSSQTPSLKKRFYQVKLQRQAFRKAYGKIWDLAMVEVSTEAIASLAQYYDQPLRCFTFGDFQLSPMVEEFEEILGCLLGGWRPYLFSGFYPSPQKASRKWGGWNIEKIFGGKSRI

SEQ ID NO: 129612 - protein, 28 aa, Glycine max
  Coding DNA Sequence Number=SeqID_37927
MEKNEETTMEEKRKAKKKRIGEAPSTRE

SEQ ID NO: 129613 - protein, 150 aa, Glycine max
  Coding DNA Sequence Number=SeqID_37928
MRISILALGRKQKGKRSSRSKVGRRQKKKKVPDQRSKESKRRKFPIKDWKKAKKKEKFPIKDRKKTKENIQKGLWTRQYLNNTQLSQANKKRKETTTGSGPLPLITNQNLVRWQLFRPALIKSRKGKSQNTQSQISLHKTLLPKKIPIDP

SEQ ID NO: 129614 - protein, 160 aa, Glycine max
  Coding DNA Sequence Number=SeqID_37929
  Homolog annotation: Hit_ID=Q2PEW8; Match level="QueryCoverage=98%, HitCoverage=39%, E-value=2e-38, Identity=44%"; Hit description =Putative uncharacterized protein
  Pfam annotation: Domain name=SURNod19; Domain location=2-160; Score= -159.5; E_value=2.7e-05; Accession=PF07712.3; Description=Stress up -regulated Nod 19
MVIDTHGAQDKKACTQCRCDHMNLPKDFYNVTRDIHNQKLTTNYKGGLFCCQDNLQCKQVEGFQGSRRMVSLRYKISWVDWDIYQIPVKVYILDSTDKVRSNGSKILHDCLAEYTIPATGGGGDTPHVQKANIPMEKGGYLIYGTTHMHSGVVNATLYGQ

SEQ ID NO: 129615 - protein, 179 aa, Glycine max
  Coding DNA Sequence Number=SeqID_37930
  Subcellular localization annotation: CTP_CleavageSite=27; ConfidenceScore=5.09e-01
MQMTNRGRGSGRRTFNRGTRHGTHSLRAPITANPSPSSIHISTSESMIHVVAQTPNTLPTAQDQPNPTFVRESIPTTPIRDASPSAPDDSVTPEYPTNPNYEHIVNERPFIRAYKGEFQPTYGCCNIISNIIRAKFDELAPSWLNVSVDLRDRWFGEFKKEYTWHPQEERAIRAVFETK

SEQ ID NO: 129616 - protein, 102 aa, Glycine max
  Coding DNA Sequence Number=SeqID_37931
MEKSEKKNHSEKKLKKAYITWDENDMESSEDSENEEINLCLMAKSYESDEEVSLRKKWYIDSGCSKHMTGDASNFTHISPKKSGHDLSIDCLALVNYVTKTI

SEQ ID NO: 129617 - protein, 94 aa, Glycine max
  Coding DNA Sequence Number=SeqID_37932
  Subcellular localization annotation: CTP_CleavageSite=38; ConfidenceScore=5.29e-01
MRRNSPAYSRDTSFLPQPSFFFGRPFTGTSSGCKHATAAGHAAQPRDIGLTTEGYRSIWGDASLVKYTTKGLGLPKLLSFATAYIYAALHSPHC

SEQ ID NO: 129618 - protein, 115 aa, Glycine max
  Coding DNA Sequence Number=SeqID_37933
  Homolog annotation: Hit_ID=A5BP71; Match level="QueryCoverage=65%, HitCoverage=19%, E-value=2e-11, Identity=46%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MVIIVNAEACGYVSLNYYQYIDVVYTNEHIVKAYSAQWWPLGNEAVIPPSNDAWTLIPDPTTIRAKGRPKSTRIRNEIDWVEPSEHRQKCSRCGAEGHNRRRCPMQYERGSCSTR

SEQ ID NO: 129619 - protein, 265 aa, Glycine max
  Coding DNA Sequence Number=SeqID_37934
MLRLIFSLVLQEYNKMKPCKVSYQNIKQKMKFGNQELPITKEFIFLQKPLLLEKAIQLLSCYQDHIKVFIPISKTFALQREGIQSPIYKGFYSREEAEKALELNTTDINKIKRSLEPENPTIIINAGQTKTSQKTYKDTVSPNTPGSTNDLNLDNFKKIQSLLFKVHNNQTQIPGLYIGVHAYFNQKFVCINKTPYCQDKTNCPCKIKFLFRKARLDMDQFKSFGYEDLAISAKSLLDYGCLESILIPPSDRFEGFNPSINEAIN

SEQ ID NO: 129620 - protein, 278 aa, Glycine max
  Coding DNA Sequence Number=SeqID_37935
MGQLQRQAFCKAYGKIWDLARVEVSTESIASLAQYYDHPLRCFTFGDFQLSPMVEEFEEILGCPLGGRKPYLFSGFYPSLARISKKKSPNLGAGIRPPKASRKWGGRNTEKIFGVLFPNVDGLVDLAAIDVFLAYHNHKESPLSMWGWFHTFFSKKGRPVYPLQGYRSCVEKGKANWDQLLASMGGRLLIGSLAKKEGRIKILSSCEGCPNVPLMGTRVTTTRGYSKEFARHGMRREERTESLGEAVMGSSVKASEESDEVQALKAELERAWVVEEKF

SEQ ID NO: 129621 - protein, 123 aa, Glycine max
  Coding DNA Sequence Number=SeqID_37936
MVDYTPSSFADLVFADERIEASLKRGKFNHPTWTNEKTGANEEGEMKEKPILRLSFLHGNFPPAKQCHYSANNNPSPYPPPSYPQRPSLNQPQNPPSTQPMLNTTFSTNQNTNQEMNFAAKSL

SEQ ID NO: 129622 - protein, 141 aa, Glycine max
  Coding DNA Sequence Number=SeqID_37937
MHRSPTGNLVPLDLEIEATLRRNRAERRRKLLQDRTVTSILEEETDFSDSLSPDSPSSRESTTQLPETTIMVDEQHQRITLEDYSSSSVPQFFTSIARPEVQAHNINYPHSLIHLIQGLPNEGAYAHLATFIEICNTFKIV

SEQ ID NO: 129623 - protein, 208 aa, Glycine max
  Coding DNA Sequence Number=SeqID_37938
GGERDDNPTGAPLLAIEVDVGIARQALDRGGEHPADDLVVVADRVARPLFRQGARMPDQTIELAVHHPKLGAPALGRQIVAAVAVLLERAHDLVDHLIVVAQEYPVAMVAVLFLQRFAQHVDALLVAALDVIDKAALKADAHPPMHGDQHQHAGSENGQEQFPGNAYPHCNLVEPVPGSLVSVRLGALSAGTRAKASAGRAIINAIQQ

SEQ ID NO: 129624 - protein, 44 aa, Glycine max
  Coding DNA Sequence Number=SeqID_37939
GQDRLELSSGIETKHEQQKSIKVLRNGCKWGWSHDRLIVALSLR

SEQ ID NO: 129625 - protein, 140 aa, Glycine max
  Coding DNA Sequence Number=SeqID_37940
MVSRGRGERDECLFHLGESHDMETCSAVEELLQQLMDWGQLEVSKGEREEPQICMQSEEKKVPLTPKALVICFTRKGTGSTPVYPRTVSKPTPFAYQSNKAVPWKYTPPAFSERVATEVDSLSTKVTNITGLSGVTRSGR

SEQ ID NO: 129626 - protein, 66 aa, Glycine max
  Coding DNA Sequence Number=SeqID_37941
  Gene Ontology: Mol. function=aspartic-type endopeptidase activity; Biological process=DNA integration
  Homolog annotation: Hit_ID=A5C528; Match level="QueryCoverage=89%, HitCoverage=9%, E-value=2e-11, Identity=52%"; Hit description =Putative uncharacterized protein
MAKNYESDEEISLKNSWYIDSRCSKHMTGDASKFTHISPKKSEHVTYGDNNKGRILGVGKIEGLPI

SEQ ID NO: 129627 - protein, 98 aa, Glycine max
  Coding DNA Sequence Number=SeqID_37942
MNMRFQKPREFENLALPLLFVILLPEIAVLFLLPPEICRKPLRRHPHCHWSNPQNPLHCRKTHIVIAGTHKTPYAAGKPILSSLKPHRTHIVLGRRKP

SEQ ID NO: 129628 - protein, 199 aa, Glycine max
  Coding DNA Sequence Number=SeqID_37943
MVIDQSFLFELTQLSNDGIPFEGTLDDEWKFDFFVSNARRMVCTNQADMTGRLLASSLAFKCRIMHYLIVRILLPRSSNLAHVSKEDLIIMWVFLTGRQIDWAHLRSFSIGANVVSSFGYRKERDGSWVKKDAPVQAVEDHSPSPPPQRDDSSSLMHNILDRLDGLDTFVSERFDSLDSRIDAMDAQFAGMDTHISGIL

SEQ ID NO: 129629 - protein, 49 aa, Glycine max
  Coding DNA Sequence Number=SeqID_37944
WTPYDLSVTDLVLCLPLALDLVAYWSVSYPNFVRGPLLDDMRPFFGPCE

SEQ ID NO: 129630 - protein, 173 aa, Glycine max
  Coding DNA Sequence Number=SeqID_37945
MAPRKLASKRSRKDKAAEGTSSAPKYDSHRFRSAEHQQRFEAIKGWSFLQERPVQLRDDEYTDFQEEIVHRRWASLVTPMAKFDPDIVLEFYANTWPTEEGVRDMRSWVRGQWIPFDADAIGQLLGYPLVLEEGQECEYGQRRNRSDGFDEEAIAQLLCIPGQDFARTAVGRR

SEQ ID NO: 129631 - protein, 318 aa, Glycine max
  Coding DNA Sequence Number=SeqID_37946
MAKFDPDIVLEFYANAWPTQEGVRDMRSWVRGQWIPFDADALSQFLGYPLVLEEGQECEYGQRRNRADGFDEEAIAQLLCIPGQDFAQTAAGRQVWIMHTNMTTLTQIWMTLLLNNIQPSDHNSDLPMSKCQLVYAILTRMSVHVAQLIANAIYLFAGMPPTRHPLDPDNSNRALGFPGLITGLCQSFGVPVAPSKVIQLPITRAFIEKYCTARQAQGGDPQAPDAPPPPPQANPTGSFNMERPMTLYQLSLSLQSQGFASFPCPTPDQFRAEVAWPRDCPEAQAGEAPAEAPDEADEARKDEEMTDLLDFLGGSGAT

SEQ ID NO: 129632 - protein, 246 aa, Glycine max
  Coding DNA Sequence Number=SeqID_37947
MSEVHGTSMVIDQSLFFSLTHLPSQGAPFEGTIVDDWKFDYSSHDARRMVCNDQAEMTGRLLAGSLTFDNRIMHYIIVRILLPWSSNLAQASEEDLILMWAFLTGRQIDWAHLVRYRMHKALRANAPLPYPQLITLFLRHFQIPLDDEPFVQVKRSFAIGAGAVTSFGMHSLLKDERTPSPPPQREDSALMNEVLSELRGLRSYVGDRFDSLDSRFAGMDIRLTQLEEDVGYIRQSFDLPPPPPSS

SEQ ID NO: 129633 - protein, 72 aa, Glycine max
  Coding DNA Sequence Number=SeqID_37948
MVLLVGHSEEICPLPKHLKHFMFLVPVLDEEVEVLCLLPPTLDAADFPCGDVAAGWNELPPSFLDLLAQFWL

SEQ ID NO: 129634 - protein, 204 aa, Glycine max
  Coding DNA Sequence Number=SeqID_37949
MYTGAGFCPGLLQDVLDIISDDRAIAQPTFDLYPAAQIFLDDITLDSCAATPAFLHCLRNGPGTCLKEVQCWTVLYRRNYSARSMTVTRAFIERCTQRRFEAIKGWSFLRAGAPPPSSGSGDIDRAVYAFLPAGNRANHRAHWYGPMIVCTRMSLEHAEPGLRFFFMPYSRPVQGRGCMVPEMADQAGEDPQKLRRWRRSPRGM

SEQ ID NO: 129635 - protein, 81 aa, Glycine max
  Coding DNA Sequence Number=SeqID_37950
MTYMQIVMIMMKVYGRTFPHNCVESKVIGTLPRSPPHPEGHSEIMFRKSRQSTRLRRLTLGTLHQPRSVVHINLVTRRGSS

SEQ ID NO: 129636 - protein, 92 aa, Glycine max
  Coding DNA Sequence Number=SeqID_37951
MAAFREKKVATDLVPQRRSSPPQKIGKVVSNDSSAASTYGAEEGQLTNISSSPDTITKKSTHCELQFLVKCRRDHSQGMNPRSPQEAAIGGI

SEQ ID NO: 129637 - protein, 91 aa, Glycine max
  Coding DNA Sequence Number=SeqID_37952
MSQVESPTIATCPFAGGRRVTRGMRVPRKEYAQSRHQSLFEENVGKTEGKPDKKKILSSGVVFTLEEGDHFKALDLENDPFYLVRNRNDKL

SEQ ID NO: 129638 - protein, 102 aa, Glycine max
  Coding DNA Sequence Number=SeqID_37953
SVLDVEEHIGEGRNPIGKITKITFPSQEGLLLTVNNTLEIGGFNRENNKDYISQSLGSALDDEEHAGEWKNPIGKITKITFPSQEGPFLTVKNTLENGGIQS

SEQ ID NO: 129639 - protein, 67 aa, Glycine max
  Coding DNA Sequence Number=SeqID_37954
MSSSFTEIDRPLASLYDLKSGKFHLVLGFDDAKVESNNKVVSTNIQNSKVKHCFKINARLLQQTFKG

SEQ ID NO: 129640 - protein, 364 aa, Glycine max
  Coding DNA Sequence Number=SeqID_37955
  Homolog annotation: Hit_ID=Q6WAY4; Match level="QueryCoverage=95%, HitCoverage=61%, E-value=1e-16, Identity=25%"; Hit description =Putative uncharacterized protein
LAAIDAFLAYHHSKESPVVAILADLFDTFDRRCEKNSARIVCCLPALCVWLISHLFQQDTRHPCPLQSYCSCAEKGRVDWDQHLAGIGGSAINWFPRWKEGKEGVLFSCGEYPNVPLIRTRGCINYNPALAIRQLGYPMRGAPTERSLSPFLVKDLGTQGLKVIQRIHKAWRSPLKKDKELRGIRNGVIGGYHGWLRIHTRGLDWLSKLKVIDEENFEAPEEDEEVRALKLELGKARFAKEKFKSAATHIRKECTELQEENAATARALEQETKRARKEEYGREKFRGALWGSNNELKLRRKERDRSRVHGMILKEELVACARSKRSLAQHLEATEQSMLAIIGQYKEELNQSMAHEQKLVEDFA

SEQ ID NO: 129641 - protein, 169 aa, Glycine max
  Coding DNA Sequence Number=SeqID_37956
  Homolog annotation: Hit_ID=Q0KIL1; Match level="QueryCoverage=50%, HitCoverage=9%, E-value=2e-08, Identity=39%"; Hit description =Gag/pol polyprotein, 3'-partial, putative
  Pfam annotation: Domain name=G-patch; Domain location=46-90; Score =33.3; E_value=9e-07; Accession=PF01585.14; Description=G-patch domain
MLVSCPSSAPYVEAAEESLETTFQSFEVVSCASVETSPLLPCLSKAALMVARVMLRHGYEPGMGLGKDSHGNANVVDVRGNPHKYGLGYEPGKPGRRNAPSRLRADRAWPGHVSQCFTSAEIMFEEEVAAIGEEAPQDPPSFVRPCHPNFQPGIWHVTSQSEVYTADSM

SEQ ID NO: 129642 - protein, 219 aa, Glycine max
  Coding DNA Sequence Number=SeqID_37957
MTTLTQIWMTLLLSNIQPSNHNSDLPLPKCQLVYAILTRMSIHVAQLIADAIYLFAGMAPTRHPLDPDKSNRALGFPALITGLCQSFGVPVAPSKVIRWPITRAFVEKYCTQRQAQGDVPQAADAPPPHQAGPAGSFDTEQYLRHLMSLSLQSQGFTSFPCPTPDQVRAEVAWPGDWPEARAVEAPAETPAEAPDEADEAREDEEMADLLDFLGGSGAT

SEQ ID NO: 129643 - protein, 27 aa, Glycine max
  Coding DNA Sequence Number=SeqID_37958
MTMSYKDLHEMLPFALHGYRTSVRTST

SEQ ID NO: 129644 - protein, 83 aa, Glycine max
  Coding DNA Sequence Number=SeqID_37959
MAYHASSKANQNSMKNHEIHFGKSYSIENFQGGPELQPYYQNEAERGSNLDNLLMQFKETTKSTQRALQSVEIQRLKLKRKTL

SEQ ID NO: 129645 - protein, 243 aa, Glycine max
  Coding DNA Sequence Number=SeqID_37960
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=91%, HitCoverage=43%, E-value=1e-107, Identity=91%"; Hit description=ATP synthase subunit alpha
  Pfam annotation: Domain name=ATP-synt_ab; Domain location=2-136; Score=166.3; E_value=7.8e-47; Accession=PF00006.16; Description=ATP synthase alphabeta family, nucleotide-binding domain
  Pfam annotation: Domain name=ATP-synt_ab_C; Domain location=148-237; Score=113.2; E_value=7.8e-31; Accession=PF00306.18; Description=ATP synthase alphabeta chain, C terminal domain
  Pfam module annotation: Pfam domain module=ATP-synt_ab::ATP-synt_ab _C; Domain location=2-136::148-237
GSPATLQYLAPYTGAALAEYFMYRERHTLIIYDDLSKQAQAYRQMSLLLRRPPGREAYPGDVFYLHSRLLERAAKLSSQLGEGSMTALPIVETQSGDVSAYIPTNVISITDGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQKSFERSYSRTDGTLFTTGT

SEQ ID NO: 129646 - protein, 90 aa, Glycine max
  Coding DNA Sequence Number=SeqID_37961
MPYVINDHHNTEHQNAPSPSCNLMVHRTKPIARKEALRTEERKEGDNAQMEAFNSQESIDYRISQRSWSKGINHGPRQRAQPNGMIPELG

SEQ ID NO: 129647 - protein, 100 aa, Glycine max
  Coding DNA Sequence Number=SeqID_37962
  Homolog annotation: Hit_ID=A2Q274; Match level="QueryCoverage=86%, HitCoverage=48%, E-value=4e-08, Identity=41%"; Hit description =Ovarian tumour, otubain, putative
MVSRYALNQIAAEFEHVHYASKNPSTCGCVMRTTHGLPCACELSKYVVGCIPLDSIHMFWRRLSFSDQGLFELEVSIKEEMQHYRSFTMYKRDCVALNDD

SEQ ID NO: 129648 - protein, 118 aa, Glycine max
  Coding DNA Sequence Number=SeqID_37963
CKTRGNPGDLQPFDPKIDRTFHRLVRHSVHPGHSVHFEHFEHSVEGDSEYSDFEHSTTNFHTENMAQPPPRERNLWEMVAPDFTYESFCIQYSLRINISASNSITKTQIHNRHNHKET

SEQ ID NO: 129649 - protein, 123 aa, Glycine max
  Coding DNA Sequence Number=SeqID_37964
MVQTSLAGRELSWKSFRHGLKNSSGVERIDEYHARLVKASVRGDTVKFPLFQAHFYLIACEYKIRKARGHVAYQLLIVEHRQSVYYHGNHLPFNHGRCHLSRQIPPPLGVLLKGFVFTFAHVL

SEQ ID NO: 129650 - protein, 90 aa, Glycine max
  Coding DNA Sequence Number=SeqID_37965
  Gene Ontology: Mol. function=protein dimerization activity; Biological process=DNA integration
  Homolog annotation: Hit_ID=A3BRV8; Match level="QueryCoverage=93%, HitCoverage=12%, E-value=2e-22, Identity=56%"; Hit description =Putative uncharacterized protein
MVISEQWSSYKADDINKAKFVKETALDDIWWDKVDYILSFTTPIYDILRKTDTDVVCLHLVYEMWNSMIENVKVIYRHERKGEDIIVMNG

SEQ ID NO: 129651 - protein, 188 aa, Glycine max
  Coding DNA Sequence Number=SeqID_37966
MGKVDEVQEHMKAEMEAMKEQMATMMEAMISMKKIMEANAVAVASTSAVAKVNPMPPSCLNQMNHPTSAMVGKDLGSTDDTYYVQIQNKHAFPPYGLPPNYTPPNVAYTLGEDVNNSTPILIESRQPHHAHVSQPMGDTHEMPHHNLADFEPCLRYAIEGQAVGGIPLQNTLEGPQYHPQPHPLHSTV

SEQ ID NO: 129652 - protein, 46 aa, Glycine max
  Coding DNA Sequence Number=SeqID_37967
DQHRLKGARKPSVFTRKAYTPKIPSGPIPPDSGPTPKTIFTCRHCS

SEQ ID NO: 129653 - protein, 105 aa, Glycine max
  Coding DNA Sequence Number=SeqID_37968
MTFSAGFAYLEGERVNNIVWALERFQIDKNVKAKCKSLIGKKNVWDYVMDNWGTLVDCPSKQQFAESLHKFQIACSPWPMFIDYVNYTWIIPHKEKFITAWTNKG

SEQ ID NO: 129654 - protein, 69 aa, Glycine max
  Coding DNA Sequence Number=SeqID_37969
MTLPKGRIGILLRLLGHYYYFMPMYLSGIKVLISLLLGPSNVFSLDIPDYKKVTDVTLLFTIIIISQQM

SEQ ID NO: 129655 - protein, 84 aa, Glycine max
  Coding DNA Sequence Number=SeqID_37970
MNIEESIHVTFDESNAILSRKNMLDDIAVSLEHMNIHEQDSKGNDKGNNEDPSEEVKSNYELPREWKASRDHPLDNIIDDISKG

SEQ ID NO: 129656 - protein, 84 aa, Glycine max
  Coding DNA Sequence Number=SeqID_37971
MGKLDHLEERLRAIEEDATTEHVQKGAQIFQRIRPKVERPGSPSGTLNDGKKMRTMIVDTLPVFYYEKMVGYTPSSFADLVFAG

SEQ ID NO: 129657 - protein, 75 aa, Glycine max
  Coding DNA Sequence Number=SeqID_37972
YILCGTSRGYIYLGLTENKRGYISCGSVLVEGTSTRFKENKGGNRLFQDHDEDKVNFCLMTKSHENNKEESVRKK

SEQ ID NO: 129658 - protein, 170 aa, Glycine max
  Coding DNA Sequence Number=SeqID_37973
MSLATLFGKLQEHEMELQRLNQNEENDKKKRSIALKASSSIQEENEEEDTGDEEDFSFFVKKFPKYIKKRRIAGVRISIIEENHKMILKSLGVTNATKLVTSRPIVLQMKNGHSCFLINGTQSNIRVKSYCRLNLLRASRFYFERVDIFWDSIRHPSKKLLSWGGCSELP

SEQ ID NO: 129659 - protein, 137 aa, Glycine max
  Coding DNA Sequence Number=SeqID_37974
PKNNEERTMNVEERLKIFAKIEEELATQLAQASQVASSRSNRLLEEESGRPKVPSTLKWSIKGCMPSSNSPRTKLGYDNMMLRDARPLERTYVGERFDSLESQVDIRFGEMVSRITKIESDITYIRDCFDLPPPPST

SEQ ID NO: 129660 - protein, 58 aa, Glycine max
  Coding DNA Sequence Number=SeqID_37975
MPTWAFQDVSPEGGCFWRKQTGSFGRAELAWGELGGKLLPYFPKNRGRSEGERGSALL

SEQ ID NO: 129661 - protein, 105 aa, Glycine max
  Coding DNA Sequence Number=SeqID_37976
KRSFAIGAGAITSFGYRKDRNGQLLKKDAFPPQDERTPSPPPQRDDSALMTEVLSELRGLCTYVGERFDSLDNRFAGMDICLTHLEEDVGYIRQSFDLPPPPPPS

SEQ ID NO: 129662 - protein, 94 aa, Glycine max
  Coding DNA Sequence Number=SeqID_37977
MSRNFTNRLAMGAKYLEVVKRGSHPNNGWSPDEIRGAESYFYAFTHSAFVFLNDKGHNIYCCTFTHSACYHALSLRDSKRKFIRITTRVSPPVT

SEQ ID NO: 129663 - protein, 118 aa, Glycine max
  Coding DNA Sequence Number=SeqID_37978
MTLSIPELFLRPYQVTWDATMFGVFNPDFPLYIKHEDLSEMAHGGQCLNISVLQLWILQKGSTECGYYVMHWMSTVILGSFRNNWEAYFNDPRPLEPERLKALRIQWAQYYLRVRDQT

SEQ ID NO: 129664 - protein, 150 aa, Glycine max
  Coding DNA Sequence Number=SeqID_37979
  Homolog annotation: Hit_ID=Q69F85; Match level="QueryCoverage=37%, HitCoverage=2%, E-value=7e-08, Identity=42%"; Hit description=Gag -pol polyprotein
MAKIKEEVAKLRASRIYNTKIQPPAFQFDDLIWQVRGEAKNNPQARKLGPNWEGQFKVVSSLGSSLLSLDKPQDRRVLGHFSKGSSNPRSALNESHISKGSSNPSSGAKLSSWAKRISTAKRSFNALSAAGAFSQAKRETGAKPNFTYSR

SEQ ID NO: 129665 - protein, 236 aa, Glycine max
  Coding DNA Sequence Number=SeqID_37980
  Homolog annotation: Hit_ID=A5BH93; Match level="QueryCoverage=38%, HitCoverage=10%, E-value=2e-09, Identity=38%"; Hit description =Putative uncharacterized protein
MFCRDPTVGTKCTYQNLELSHIRMDVAKVGSNISDVGQRVAFVKRTRWGACKIKDSDAQVTIVDTCTYNSKPQETQHKDAQAKVEYVKRLYDQVKVHIAKKNEGYAKQANKKRKEVVLEPGDDPGDLRANVFQEGGNDENPKIVQIQGPMTRSRTKHSVDTLQQMVADILSKAQVDKDKSPNGEGRRPKWKRTKPQVEKDEGPSGEGRKTQVKKDEGPKAKALLSISIVAEGPRLI

SEQ ID NO: 129666 - protein, 113 aa, Glycine max
  Coding DNA Sequence Number=SeqID_37981
MVMGDSISRLSFPENTETFSSLTSYPELRRSEFLIGGYVGARALLLSTTPPFAVMTQELVTRGDTLRLSAPRHSVTRSVIDEQRPVWSFAPFPEMSTSSGRDFFKSHKLSRTT

SEQ ID NO: 129667 - protein, 66 aa, Glycine max
  Coding DNA Sequence Number=SeqID_37982
MMAHHLHSEVYTSTGLRGCFGMGKEQVYSIIDAYVIPILVLKFQLKITVKTSAKARGNRKEDWFHP

SEQ ID NO: 129668 - protein, 87 aa, Glycine max
  Coding DNA Sequence Number=SeqID_37983
MWPHPEDSSTSRCRQHAWSLVAVTKAMNVCFISGNYTTWKHAPRWKSYFNGSWTEDSSKCPREEYDQPQVRVPPDSAQADAIFLSKQ

SEQ ID NO: 129669 - protein, 207 aa, Glycine max
  Coding DNA Sequence Number=SeqID_37984
MANQDEWVPFMDVLAMLIFGVVLFPNVDGLVDLAAIDAFLAYHHSKEIPMVAVLVDLFDTFDRRVDWDQHLPGLEAEQSIDFHDGKKEMRLGYPMRGALTEESLSPFLVRDFGAQNFKVIQRVHKAWDSPLRKDKELRGIRNGIIGGYQEWLKVCTRGLDWLAKLKIISEENFEAPEEDEEVRALKTELGKARLAKEKFKLVAIDVR

SEQ ID NO: 129670 - protein, 70 aa, Glycine max
  Coding DNA Sequence Number=SeqID_37985
MRTALPQLTFALKSGNRVTRTGAFRANPVGAVVRDNLPWQTISTDDLFLNEPDHYTPRDTGVGSRLDPPG

SEQ ID NO: 129671 - protein, 61 aa, Glycine max
  Coding DNA Sequence Number=SeqID_37986
MAQVVEGKVEAQHPKFGQTQVVVGGSSMMDKRSSVTRDDLGRNISRDGDGDNIEVTFLSST

SEQ ID NO: 129672 - protein, 160 aa, Glycine max
  Coding DNA Sequence Number=SeqID_37987
MPYDHDDLMPYENPLLKFNSRTKFNNTRHNIKKISIVLGREFQIETAKGLAKKFKQKCLFQEIYSLISEATCLTRSYIKKILKRFGMQECKSGDTPVAKGDNCREFDVCPSMYAFGYSIHSWGIRQIFKQSRNESLENSQKSYEIFEENKVLYAHIEEVR

SEQ ID NO: 129673 - protein, 130 aa, Glycine max
  Coding DNA Sequence Number=SeqID_37988
STLEDPTQAQGEAPQAAGVPPPPHQAGQAGTFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 129674 - protein, 82 aa, Glycine max
  Coding DNA Sequence Number=SeqID_37989
EAIAWGGGDVTPYQTNVPVVIGGVGVHPGQYVFCDASGAVFIPESDIDRVLEDAHQIRRDDSSHRAAIALEEVGGIADGTER

SEQ ID NO: 129675 - protein, 121 aa, Glycine max
  Coding DNA Sequence Number=SeqID_37990
MSSAYVESPSVMPRLSGATLMVARVMLRNRYEPEMGLGRSGDGTTSLVVFAENRGRFMLGYEPTHADKRRIALERKERSLAHLQGRRLQAERVPICHIDKSFVSAGWMCEGQSTMIDKETP

SEQ ID NO: 129676 - protein, 166 aa, Glycine max
  Coding DNA Sequence Number=SeqID_37991
MASRKRRAVPTPGEASSWDSSRFTSEIIWHRYQDNIQLRNILLERNVELTPRMFDEFLQELQRCRWDQVLTRLPEKRIDVALVKEFYSNLYDPEDHSPKFCRVQGQVMWFDAETINDFLDTPVILADVEEYPAYSQYLRTPPDHDAILSTLCTPGGRFVLNVDGAP

SEQ ID NO: 129677 - protein, 46 aa, Glycine max
  Coding DNA Sequence Number=SeqID_37992
MNKSAKRNQKNAKKDDPGAANSSIPWVWLLKGGEKKFLNGWLAQAS

SEQ ID NO: 129678 - protein, 317 aa, Glycine max
  Coding DNA Sequence Number=SeqID_37993
MANQEEWVPFIDILALLIFGVVLFPNMDGLVDLAAIDAFLAYHHSKESPAEQSTGFHDGRKERRDSLLMWGLPKYPVDKNEGGAPAEESLSPFLVRDFGAQSFKVIQRVHKAWESPLRKDKELRGIRNGIIGGYHEWLKVRTRGLDWLSKLKIINEENFEALEEDEEVRALKTELGKARLAKEKFKLVTTDVWKECAGLREENAATARALEQETKRARKEEHGRDKFRGALWGSNSELKLQREERDQSRAHCMVLKEELAACSRSKRNLSQRLCETETNMLAIISKYQEELNLATAHEHKVADEYAQVYAEKEARRK

SEQ ID NO: 129679 - protein, 95 aa, Glycine max
  Coding DNA Sequence Number=SeqID_37994
MRGRSAALVSSVREQEFTMFQNGWKPSPLELMMLKLSQTLSGLICFAGLEYLKQLLVIKEPIFATGQCIPCLKSTGWYTGYPHHTTSRPMVSGIL

SEQ ID NO: 129680 - protein, 110 aa, Glycine max
  Coding DNA Sequence Number=SeqID_37995
  Homolog annotation: Hit_ID=Q2HUU9; Match level="QueryCoverage=84%, HitCoverage=59%, E-value=2e-07, Identity=38%"; Hit description=Helix- turn-helix, Fis-type
MWLSKKCGYVFTWRLLKDRLPTKGNLLRRNVAIQEAVCPLCGQVQEEVGHLLFNCKRKIGLWWESMRWIQAVGPLPASPASHFAQFCDGFGADINDSSWCGWWVALTSAI

SEQ ID NO: 129681 - protein, 16 aa, Glycine max
  Coding DNA Sequence Number=SeqID_37996
MDKSLKVGKDEWREKE

SEQ ID NO: 129682 - protein, 31 aa, Glycine max
  Coding DNA Sequence Number=SeqID_37997
ILLPAPYHCHSAPTNKVRDHHKYQPHDTKLQ

SEQ ID NO: 129683 - protein, 43 aa, Glycine max
  Coding DNA Sequence Number=SeqID_37998
MDTPMSTACYLDKDETGQSVDIKKYRDFKQIPKNHILVQLRES

SEQ ID NO: 129684 - protein, 65 aa, Glycine max
  Coding DNA Sequence Number=SeqID_37999
MVCEQRVIYKENCIQKKCVLGKKAEKKVKDVPAKEKVSLPHKGPQGRSDGMKQRGKTERKPRSLL

SEQ ID NO: 129685 - protein, 106 aa, Glycine max
  Coding DNA Sequence Number=SeqID_38000
NNSLLVDGSLTSTGIMVFVPYGPENHSVSCPFPTVGLRMFDRDEVFLGEFLHLTSRNFPMSIPYIAKGQGELRLWTLLGGVSHHFGGKGASSDVETTYPFMKFSHD

SEQ ID NO: 129686 - protein, 129 aa, Glycine max
  Coding DNA Sequence Number=SeqID_38001
MTPQPLKKLRQENEKLVSSYKATSCVCASTSINMDDYKSLQIEFGKFKRDHYEKCMKFQIELSYLKDLFRKMNKGNSDLSHLLSVQKHTTDKTGLGYNKQTTISKKTKFAYSKKVNPNKVFKNKNIMYF

SEQ ID NO: 129687 - protein, 190 aa, Glycine max
  Coding DNA Sequence Number=SeqID_38002
  Homolog annotation: Hit_ID=A5AZ88; Match level="QueryCoverage=81%, HitCoverage=13%, E-value=1e-07, Identity=31%"; Hit description =Putative uncharacterized protein
MERSMIDATSGGALGDMTPAEARNLIEKMASNSQQFSARNDAIVLRGVYEVATNSTSSAKNKKLEGKIDALVNLVTQLAINQKSAPVARVYGLCSSTDLCSSLQQSGVNEQLDAYVVNIYNRSPQQQNQQQQNNYDLSSNRYNPGWRNHPNLRWASPPQQHQPVPPFQNAAGPRKPYVPPPIQQQQQQQS

SEQ ID NO: 129688 - protein, 117 aa, Glycine max
  Coding DNA Sequence Number=SeqID_38003
  Subcellular localization annotation: CTP_CleavageSite=56; ConfidenceScore=5.33e-01
MRFCATLRSRISKSNSWSQSIHLINLGFDSAFFNRYFRAACVICLGNVQSSGSVVVATYPSAGGRRETRGMRVPRKEYARSRHQRLFEENVGKTGKDAIYELLSERFGSCIYARGRY

SEQ ID NO: 129689 - protein, 123 aa, Glycine max
  Coding DNA Sequence Number=SeqID_38004
MKKLEETLAQFMQVSMSNQKSTESAIKNLEFQVGQLAKQLANRPSSSFGANIEKNPKEECKAVMTKSKMVSMNEGEKRIGEEKQQLVTEPEIDPVVELLSETEEEVEAEDDQQKEIPIIVSEK

SEQ ID NO: 129690 - protein, 119 aa, Glycine max
  Coding DNA Sequence Number=SeqID_38005
MHFSDHVVVVGDLCVVPGQVFADYMEWFFQISHPFMIPTQAGDQPRHAPAPDHEDYMQPDIPQVLVAFDPPRHVVDCLRIARGVPAQMEVLGLDKDGAQSIDDDLEPSHMFKYPCSGFF

SEQ ID NO: 129691 - protein, 94 aa, Glycine max
  Coding DNA Sequence Number=SeqID_38006
EVNHIRYANGVFRLKINPGKNDGTHFDLIRCLFMEVFQGSNWLRNIVRHDENCHCGGKRSIPVSLHCDSEVAIGIAKNNVYNVEKGDTYVRHSD

SEQ ID NO: 129692 - protein, 164 aa, Glycine max
  Coding DNA Sequence Number=SeqID_38007
  Homolog annotation: Hit_ID=Q2HTA0; Match level="QueryCoverage=37%, HitCoverage=9%, E-value=8e-07, Identity=49%"; Hit description=IMP dehydrogenase/GMP reductase, related
  Pfam annotation: Domain name=DUF1723; Domain location=90-139; Score =45.6; E_value=1.8e-10; Accession=PF08330.1; Description=Protein of unknown function (DUF1723)
MKPLSGEGPQHLHIGNRKLHMLLWMLSMWIMKLTRSMNSLKRQLLMNYVHHVTLSSHGRKVEKLGRLAPEIEGLVASTRLSPLIAYSLDTSDRGLISALAKRWKKETCSFYLLVGEVTITLDDVESLLYLPITDAFHSFEAVHVDEVVDLLVDLLEVSSEEAKD

SEQ ID NO: 129693 - protein, 63 aa, Glycine max
  Coding DNA Sequence Number=SeqID_38008
HLNTRDELSLCGLDFVKDFTKIVEISSGLLEYWTNTRGVATNVYLRKTSEKTGKDAIYELFGE

SEQ ID NO: 129694 - protein, 75 aa, Glycine max
  Coding DNA Sequence Number=SeqID_38009
MESKKENRRSSDQINFRRGEKPGGPFGPTLKSYPEPHELIVIHASSTNESGAPRIECLALFAYPPPSNLIRSPMN

SEQ ID NO: 129695 - protein, 273 aa, Glycine max
  Coding DNA Sequence Number=SeqID_38010
  Gene Ontology: Mol. function=dihydrodipicolinate reductase activity; Cellular component=cytoplasm; Biological process=lysine biosynthetic process via diaminopimelate
  Homolog annotation: Hit_ID=A1A780; Match level="QueryCoverage=100%, HitCoverage=100%, E-value=1e-140, Identity=91%"; Hit description =Dihydrodipicolinate reductase
  Pfam annotation: Domain name=DapB_C; Domain location=132-268; Score =276.9; E_value=4.2e-80; Accession=PF05173.5; Description =Dihydrodipicolinate reductase, C-terminus
  Pfam annotation: Domain name=DapB_N; Domain location=6-129; Score =228.0; E_value=2.2e-65; Accession=PF01113.11; Description =Dihydrodipicolinate reductase, N-terminus
  Pfam module annotation: Pfam domain module=DapB_C::DapB_N; Domain location=132-268::6-129
MHDAQIRVAIAGAGGRMGRQLIQAALQMDGVALGAALERDGSSLLGTDAGELAGAGKTGVTVQSSLDAVKDDFDVFIDFTRPEGTLTHLAFCRQHGKGMVIGTTGFDDAGKQAIQDASKEIAIVFAANFSVGVNVMLKLLEKAAKVMGNYTDIEIVEAHHRYKVDAPSGTALAMGEAIAHALDKDLKDCAVYAREGHTGERVPGTIGFATVRAGDIVGEHTAMFADIGERVEITHKASSRMTFANGAVRSALWLKEKENGLFDMRDVLDLNNL

SEQ ID NO: 129696 - protein, 97 aa, Glycine max
  Coding DNA Sequence Number=SeqID_38011
MGAKHLTRAKQRSHVIKQRSPDEIRDGIIMSEVHGTSMVIDQSLFFSLTHLPSQGAPFEGTIVDDWKFDYSSHDARRMVCNDQAEMTGMLVLSFTEF

SEQ ID NO: 129697 - protein, 393 aa, Glycine max
  Coding DNA Sequence Number=SeqID_38012
  Homolog annotation: Hit_ID=A7P7E6; Match level="QueryCoverage=50%, HitCoverage=39%, E-value=3e-24, Identity=33%"; Hit description =Chromosome chr9 scaffold_7, whole genome shotgun sequence
  Pfam annotation: Domain name=DUF1723; Domain location=129-178; Score =52.6; E_value=1.4e-12; Accession=PF08330.1; Description=Protein of unknown function (DUF1723)
GIGKGRGGQDEHHPDDVPWQSRPIASVRRQRVRVAEEDVPAAGVEGLVADDVAAGSVAEGFLGEPRDLSVLTSYADHVAHNIWTGEERPDLKLASHGRKVEKIGRPAPEIERLVTATGLSPLIGCSVVTGDPRLISVLVERWHGEINSFHLPVGELMITLDDVSSLLHLPITGALHSFEPFLLEEAVVLLMELLEVSARAYLLHLVGCTLFAKKSATHVHVVHLEAFRDLGESGRYAWGAAVLVHMYDQLNEASQSSRQQLAGAGYMITFLVFMTASLTMCMMRHPHVSAGGLRRRVISRDYEHWRIGHGQVRWGPIVVTVQPDRVAIPPPPISASLSYEDIDDRRMHYEDHIAVAGDEPRHPPAPQHEEYVEPGIPEVLVGADVGPSQAPAV

SEQ ID NO: 129698 - protein, 155 aa, Glycine max
  Coding DNA Sequence Number=SeqID_38013
  Homolog annotation: Hit_ID=A5AJB0; Match level="QueryCoverage=90%, HitCoverage=13%, E-value=3e-08, Identity=33%"; Hit description =Putative uncharacterized protein
MKKEISSSLKCLCDLGTSINLMPYSVIKKSGMTNLELTNITLHLTDNLVVNPGSFIKFIDISDALMEGVFSSMGMPNPLERVLINEDLDWKLNSEVEEILTFFYSQHGPRSSSFERLEWGNGLKPKPSIEEPLVLDLKPLPYNLKCSFLNPTSFI

SEQ ID NO: 129699 - protein, 75 aa, Glycine max
  Coding DNA Sequence Number=SeqID_38014
MAVMMEAMMRVKKIMEANAVAIAATSVVAKVNPTSPSGINQMNHPTSDMTHEIPRHNLADFEPCLGYAIEGQAVG

SEQ ID NO: 129700 - protein, 93 aa, Glycine max
  Coding DNA Sequence Number=SeqID_38015
MLDLHFKISDDSLILLALSSSPSKLLLLHRAQDRDSLPPYPGLFGELVLTARTFVCFCCKDLVYGTRAHCKVYLGCSLCSPFRVLTRADRVSF

SEQ ID NO: 129701 - protein, 49 aa, Glycine max
  Coding DNA Sequence Number=SeqID_38016
MTWFTPVNPRKSNYRSIHMVASLGCKTSASPFSSLFFRMEIGKHKDEQT

SEQ ID NO: 129702 - protein, 62 aa, Glycine max
  Coding DNA Sequence Number=SeqID_38017
MTLVLLSNHTFSVYRHGEDESRTSSPPYEAMDKILKVGEDEWRERERERRGTKFMPQMMSEL

SEQ ID NO: 129703 - protein, 64 aa, Glycine max
  Coding DNA Sequence Number=SeqID_38018
MVEKRKIREEQAAFTEDPSLYLPPSPISRHEKWKSARTKQYGQMTSQAAKEIADKIDSLEEQSR

SEQ ID NO: 129704 - protein, 146 aa, Glycine max
  Coding DNA Sequence Number=SeqID_38019
  Gene Ontology: Mol. function=NADH dehydrogenase (ubiquinone) activity; Cellular component=mitochondrial respiratory chain; Biological process=electron transport
  Homolog annotation: Hit_ID=P08834; Match level="QueryCoverage=26%, HitCoverage=12%, E-value=3e-11, Identity=87%"; Hit description=NADH -ubiquinone oxidoreductase chain 1
  Subcellular localization annotation: CTP_CleavageSite=53; ConfidenceScore=5.13e-01
MDSPGTSLPQLGTFKEGGTKERCFLSVKSRYRPPPHAPTVRLPRNRKGGPGARASWVGRVWIREGNRSDVPLTQPGNGPEGTAAWGMSASRRKAHFSFLVIGRADLSDQGPGHKGPGTIQVRRTPEVTAMSRNLTHRPKRRANTRT

SEQ ID NO: 129705 - protein, 119 aa, Glycine max
  Coding DNA Sequence Number=SeqID_38020
MASRKRKSIGKYDTRRFSSLDAWTRYTDNVLGRNILPERKVELYHIELHDFKAELERHNFHKRLTNLVDGSIDLALVKEFYANLYSSEDCPPKQSRVKGHLVKIDADSLIEAVLESNKH

SEQ ID NO: 129706 - protein, 220 aa, Glycine max
  Coding DNA Sequence Number=SeqID_38021
  Pfam annotation: Domain name=zf-CCHC; Domain location=53-70; Score =21.2; E_value=0.00094; Accession=PF00098.14; Description=Zinc knuckle
KSTSKSYGSHSYPKKDQGQGILGVTAFKPKDDKGETIEKQAPKASMQEKTSSLKCFKCLGRGHITSQCPTTKTMIMRGQDIYSSQDKATTSPSSSESEEAKGEESSEEIYPQEEGQPLVVKEKCKETLASIATPLGLEFIPQVNKLLDEGVPMNPKRIKVIPEWPTPPTPLIELVRNCVPSWEDAQEMGKDPEYEEPRDLRSNPFQGGGNDAILSRKGIG

SEQ ID NO: 129707 - protein, 634 aa, Glycine max
  Coding DNA Sequence Number=SeqID_38022
MATSKYLTALEAFGSGPNMFIPYIANGKGELGLHFKKGVVNPLLNSSPSRMTVYGESLERLLDDSLEVPNLFGAGLLGDQVYFGVSLPGDIIRAFEDDSCPASLYIGHTVHFDGPCHHSPYEFRFPQNLFDGVVRLDYHLVTLEMGSMYFPSSCMRAELTTSSATEIYRSRGTPGLGQLKTGGVAMVFLKVRKACSPVSSHRKGSLFLSNFLNVGRAVHLQYGNAFVVVGFNPPMNDHETKEFASAYLECTFFKVEAHVIFAEFPKDFFQVCHVLGYALRLDDHVIHIYFNISSDQLFKYSVNQSLHLGYKPVLMAGEALVRSVVARIYIEFIVQTCLVDGSLVAGSLHSIVVLTLIFLDGYNLLGQAGLDRKWSLGPRSLWFQLSRLQIQGVDQLDGGQSALVDEDFEHLEVCNDDGDNHGFVLVNGIDTLKVPIRESGLVRLSFIGKFICNGVDYTSDLLGGFLFLGRLSLVLLLYLVASNPGLEGFVEGSLMGTSKLKASSRIVMRLVVRVSLGASFSLVALMPSLSDFVPESGHFFHLDGEEHGMQCDLWVKILDLDDDAPKFVHEFSKRLVICVSQIGQGSRGQAMRPVGCVLCTKAFNEGVEAIYGSWWESTVPDQCRPLEGHWEDTT

SEQ ID NO: 129708 - protein, 88 aa, Glycine max
  Coding DNA Sequence Number=SeqID_38023
MATGGGLEPLKGVSRLRPDRVQTSKRERYDERLWGCVEGSMEPGIYRSRMELQALIIEYLPRDKEVTTYSNIKRLEITCWFGSPAVKG

SEQ ID NO: 129709 - protein, 264 aa, Glycine max
  Coding DNA Sequence Number=SeqID_38024
MTSSYGPKSEERGQEMISVKRSFFELVGILKDDAYCTSDFKLWWTRVHDVCLKKFALDSDAFELINFSLSNNTEVLVYVEKINDGGIVVSKDDVVALDDEDEGVGNEVVRVEVVVSKSDSSDTEFNEGGSESGSENDNEGVVFEDSEEERATGGYEVEELYSVGSKSDKEDLHKFVRYRKEELSRDFEFKIGMDFCSLQEFKEAIIDHSIMNGREVVFRPNDKVNAKRNIMDAVRLKYGIDITSVVAWKARMIAKAIVDGDAIR

SEQ ID NO: 129710 - protein, 162 aa, Glycine max
  Coding DNA Sequence Number=SeqID_38025
  Homolog annotation: Hit_ID=A7QNS2; Match level="QueryCoverage=20%, HitCoverage=5%, E-value=3e-08, Identity=75%"; Hit description =Chromosome undetermined scaffold_134, whole genome shotgun sequence
MEICVRCLSGDPTERPSVEHILWNLQFAAQVQNSWRRDSSHQSSPSSQDRASYERMLDNKVEFGSPNKQSGGFFNSALVLGRFTVLACKNNSKFLITAFWMVCNRIPEAALMARSYLPSMISVTIWRKDLSKKKQGGARRVAVSVKDTGRVNETKEFQSPEG

SEQ ID NO: 129711 - protein, 137 aa, Glycine max
  Coding DNA Sequence Number=SeqID_38026
MAKPSTQLVAFPFSNEYRFDTEQGTTCKEVYIRSNQMEEMQENIPSSNTHKRKSLSALETAKTEERVRGVRSKVRVLPQLARNKDHLQKKDCVTLTYGETSFRREENKNLSKALNVRMAESDDSDNNLVDPQMMKWL

SEQ ID NO: 129712 - protein, 72 aa, Glycine max
  Coding DNA Sequence Number=SeqID_38027
MFSFINLYGKYPPGFFASMCHEGKKGITINCLPAAAASPPSVSADDTGMKTHQMRVCSVTGQVLNHFSLKTC

SEQ ID NO: 129713 - protein, 217 aa, Glycine max
  Coding DNA Sequence Number=SeqID_38028
  Pfam annotation: Domain name=zf-CCHC; Domain location=108-125; Score =11.9; E_value=0.024; Accession=PF00098.14; Description=Zinc knuckle
MSNEELKLQDPRCRIQCPDILPENTGVAAQCISQDKIFSERMIDLIQHKELQPRNAHCYIIMEAARVLYQVGIEELLFKDNLHVLKRDVVTSCTTSVPSIRISDLVPYKCTRCRATGHNSRRCPLLPLVVPEEQNPEPSRAQGATQGVAQGANQGASEVEGATQGVAQDANQGASEGEGVTQGVAQGANQGAGEGDGPPVGGQTQEVNIVEGTLAGV

SEQ ID NO: 129714 - protein, 262 aa, Glycine max
  Coding DNA Sequence Number=SeqID_38029
MGCERRKEKMRLPKRKRVEVVTDVYSRKTLEKLKEARLGKLKLSPEVMSSPRRADCLAMKLFHGPGEPDASLGELGSRSGSSVSTNEEIKKICHVFILLSSAFVPLDNSLSTCRTCLLLKIGPIPEPYGSGSELLGSRPWIRPNVAFMRASGAPFSACELRWTLEMVVDVEVVVVRLQSAATTGLAPAVNWQRPMINAGNPSACWTSLGPLGVSEIKVMVTMKDVTEQECHPDLSQSGHASVHDPHPPPCYAMYKIMSRGAK

SEQ ID NO: 129715 - protein, 62 aa, Glycine max
  Coding DNA Sequence Number=SeqID_38030
MPLRGRIASPAHQCERCVWELERLVMEMGKSALLTTACGNNKATKSQANQKGNDRIPPQADI

SEQ ID NO: 129716 - protein, 100 aa, Glycine max
  Coding DNA Sequence Number=SeqID_38031
MFRIYLIVAPVSVCMRRSSASELVPLDLEIEATFRRNNAERKEKLLHNKTVASFLEEAHFSESSSSNSPTSRESQTVAEVMAEEQPQQLTLEDYSSTSVP

SEQ ID NO: 129717 - protein, 339 aa, Glycine max
  Coding DNA Sequence Number=SeqID_38032
  Homolog annotation: Hit_ID=Q6WAY6; Match level="QueryCoverage=81%, HitCoverage=55%, E-value=4e-33, Identity=29%"; Hit description =Putative uncharacterized protein
MGTNQNGKRFYQVKVKSLDVTSLKELRRLMGPLQRQAFRKVYGKILDLTIAEVFTEAVISLAQYYDQPLRCFTFGDFQMVPTIEEFEEILGCPLGGRKPYLFFGFLPSLSKIAAVVGDSAKEMDCMRQTRNGVVGLPRKYLEGKARDMAGQVKWGPFADILALLIFGVFLFPNVDGLVDLAAIDAFLAYHHSKESPVVAILADLFDTFDRRWGNAINWFPHWKEGKEGVLFLCGDYPNVPLIGTRGCINYNPALAIRQLGYPMRGAPTKESLSPFLVRDLGAQSLKVIKRVHKAWRKNFEAPEEDEEVRALKLELGKARLAKEKFKLAATHIQKECTEL

SEQ ID NO: 129718 - protein, 192 aa, Glycine max
  Coding DNA Sequence Number=SeqID_38033
  Gene Ontology: Mol. function=oxidoreductase activity; Cellular component=extracellular region; Biological process=hydrogen peroxide catabolic process
  Homolog annotation: Hit_ID=A7PCE4; Match level="QueryCoverage=42%, HitCoverage=24%, E-value=4e-23, Identity=65%"; Hit description =Chromosome chr2 scaffold_11, whole genome shotgun sequence
MAMMTTNDTKVSRESCSPYALLREGTKNLHPWIFKPKRFDNYYFINILEGKGLLVLYNVLIIHDLHGKITEQVRAYASNEKLLFASFAKSMIKMGNINVLTRNEGEIRRNCRPGSPSMEDIEAFSATNRAKLDEAELAKSVPNNICLEIIRTISTSTAHIRSIRKTLTKIDQEGEILPNGTLSVYVTFILKI

SEQ ID NO: 129719 - protein, 207 aa, Glycine max
  Coding DNA Sequence Number=SeqID_38034
  Pfam annotation: Domain name=Transposase_23; Domain location=74-137; Score=-12.8; E_value=0.03; Accession=PF03017.5; Description =TNP1ENSPM transposase
MYFVNQQLYVLKQELKQGIKLELYQIASQYSSPLEPPNIQVVAARVRTKGSCADADTIPSAKEPSNLHVDTMGLYVVHDQCTKLVALGKVYDSMLTIHNVPYADDVVRVSVVKVYHGDAQVLFLTSEIQFVRQVVGTFVGWPTHLVKPVANEDLQMCMPKRVTSAGMDTSVPTVDPLGELVKNLFDVYQKSFEFPWDGAKFGIPNVK

SEQ ID NO: 129720 - protein, 37 aa, Glycine max
  Coding DNA Sequence Number=SeqID_38035
MEGILVTRDGERLRKLIQPSGKGLVVVMPCRVYKGSV

SEQ ID NO: 129721 - protein, 80 aa, Glycine max
  Coding DNA Sequence Number=SeqID_38036
MWMKKKCLKEGSIGEEARSGHFHCHIQTRSRQGDKVEGEVLEGAAQTAEGVEGMRAFDSRVKLKGFFSPFTQILGLIAKN

SEQ ID NO: 129722 - protein, 68 aa, Glycine max
  Coding DNA Sequence Number=SeqID_38037
MVNGYTIPTYVVDNKTVEKPYESWSEEEIKKGLLSRLPLDYTISNGLWENLPLASRVGAQDLLGPQIS

SEQ ID NO: 129723 - protein, 258 aa, Glycine max
  Coding DNA Sequence Number=SeqID_38038
  Subcellular localization annotation: CTP_CleavageSite=25; ConfidenceScore=5.19e-01
MMLMIAFSPATPNYKSSVYGKIAMTSMNQWNTFMKVFTVSVRDAIHAHFVISDALVLMWQFVWTRVWGGGVCFWQVYRIAQPNPDQASSADSSCWTKLDQDCIKTNIQQLDLTITHKLISSSQDGFLFKLWSLQIFTQQNLSNSLELGPFSLELSRHEEASRKGQTHLQNLISGLNRCEWIEAVRLAGRPFAQQKCTAHPSSRFFLALSRGVLRSVDGSLSRQKGEESLPCAAKVLVVVTKACELVQRKNSDEDGEET

SEQ ID NO: 129724 - protein, 86 aa, Glycine max
  Coding DNA Sequence Number=SeqID_38039
TSLLLGGSGGNGSGSRGSGGKNQDMISPIECKPRAKRIFGHTLSRESQALSTQPLHLRLIWSAKLAKAELSQFQFDLNLAKRQPDR

SEQ ID NO: 129725 - protein, 96 aa, Glycine max
  Coding DNA Sequence Number=SeqID_38040
MHYLIAHILLPRSSNLAQAVEDRSPSPHSQRDDSSSLMHNILERFDGLETYVGERFDSLERQVDTRFKEMNSRIAKVEENVTIIRDCLDLPPPPSV

SEQ ID NO: 129726 - protein, 528 aa, Glycine max
  Coding DNA Sequence Number=SeqID_38041
  Gene Ontology: Mol. function=oxidoreductase activity; Cellular component=anchored to membrane; Biological process=electron transport
  Homolog annotation: Hit_ID=Q2PMD5; Match level="QueryCoverage=100%, HitCoverage=100%, E-value=0.0, Identity=78%"; Hit description=FAD -linked oxidoreductase 1
  Pfam annotation: Domain name=BBE; Domain location=464-521; Score =108.6; E_value=2e-29; Accession=PF08031.3; Description=Berberine and berberine like
  Pfam annotation: Domain name=FAD_binding_4; Domain location=75-216; Score=76.9; E_value=6.6e-20; Accession=PF01565.14; Description=FAD binding domain
  Pfam module annotation: Pfam domain module=BBE::FAD_binding_4; Domain location=464-521::75-216
MEFGYCAVFLILLLPISCGASTSLEKKFKKCLLTQLNGNSESIENITFTSSSSLYPQVWDSSAQNLRFVNSSRKPFIILTPLHESEIQAAILCSKQLGLQIRVRSGGHDCEGLSYLSLRKAPFVMVDLINIRSIEINLDDETAWVQAGATLGELYYKISNASEVHGFPAGPVPGIGIGGHISGGGQGMMMRKHGLAADHVVDAYLIDVNGTVHDRKSMGEDVFWAIRGGSATSFGVILAWKIRLVRVPAIVTVSERPLEEGATNLIHRWQYIAHELHEDLFIRVIAQNSGDKSKTFKATFGSIFLGETDRFITLMNESFPELELNVNYCTEISWIQSVLVDAGYDRDDPPEVLLDRTNEFKSYFKVKSDFVKKPIPKSGLEGAWKMLLEEEMFAWLIMEPYGGRMNEISESEIPFPHRKGNLYSIEYVVKWEQNSKETSKKYLQWAKRVYRYMTPYVSKSPRAAFFNFKDLDLGKNKHHNTSYSKASVWGNKYFKGNFRRLAQIKTKFDPQNFFRNEQSIPLLHTHPS

SEQ ID NO: 129727 - protein, 362 aa, Glycine max
  Coding DNA Sequence Number=SeqID_38042
  Gene Ontology: Mol. function=protein heterodimerization activity; Cellular component=nuclear envelope
  Homolog annotation: Hit_ID=A7QQF0; Match level="QueryCoverage=94%, HitCoverage=61%, E-value=5e-49, Identity=38%"; Hit description =Chromosome undetermined scaffold_142, whole genome shotgun sequence
MDLGSESVEENEVNHDGNGNGGSYDDEKIGLGLEGNSDVNGSDQKGTVGEVEVGSAEGVNSKGTPTKGFGLKKWKRIRRNVVKDPNSSVDSGKVLKRGLSGNANLSESQPFLRDVKEKNEGSSNMFGNVVFSDGNVIHGSSSDSRYALGSGFVVGTDSENSEDQSSKSSTAASEPKLRQEKSRSKNVNSKHLANSAQRVQPGKGRTEGSKKPGGGGRVKIEKENSFSSLESDSRSSNFKQGVFSVTSNGKHTSRPNVYDGVNSGEAHTNEHFTEGVEAGYGNENVVEDEYLLQENLGTNLSWDVTEEKSVNNQSSAVEDPIIESVSCLQAVQEALQEAIASFWHNVGHSDKYFTDALNVLPN

SEQ ID NO: 129728 - protein, 183 aa, Glycine max
  Coding DNA Sequence Number=SeqID_38043
MPLANRATFSKIYLGDYQKYPKIVILEEWVDCEMIAPDETSQKRKATSFSTESKGYKKNTTDKSDGKIKLPPKPPKTKDHVKENLGKNYSTFSESRKVIETHLSNGILRDTSWLSYSQDVNVVDLSSSQVHSNPKDGKDEGTHDTPAVSSNAKSINKESNVLDSKMHVSPLEVRKAAEKNEEK

SEQ ID NO: 129729 - protein, 259 aa, Glycine max
  Coding DNA Sequence Number=SeqID_38044
MSTTSHATRTKNIHDLSSRHAIPNTHDECVLPSARSLRVILPRYCLVTLIREGRWHLCYKGLETSSYTLLEGLPQDATVIGACGIRIVPSGKWIKDGSRSAYDIRIRVNFAGFLSGKFLLRSLWLIGRSWSEGRWVGGRADIGRVIGAKDTGTWGCEGFVGSLAMWVLWSRAILRAPQSIWQGYATICLPLNGISEVRLKIGQSVVSGYFMCLPHRLKDMCMTGLGLLALNGYGSEIVDILIRRVCNIGWCNVGRQAIR

SEQ ID NO: 129730 - protein, 179 aa, Glycine max
  Coding DNA Sequence Number=SeqID_38045
MSQSFDMIGAIDDNKETFKLIVRIVDRRDTVHAIFKKDDMESWEVGLKEGKAQVDLAEIPLQSYEFMSFEYITHGNYDPIMLIDVIGVVEEVKFQLPNGNPTRLVLNLKDLRLSSVCLGEPSNVSQSLSIGQYSQDSDFSELDRFLYKSKVLSISNIRDAAGGTNFNTIGNSSKLIMKM

SEQ ID NO: 129731 - protein, 80 aa, Glycine max
  Coding DNA Sequence Number=SeqID_38046
MGSDQVSSFKKRFYHVKVKNLEVASLQKLGCFTFGDFQLAPTIEEFEGILGCPIGGRKPYLFSGYYPSMARIVGVIKISE

SEQ ID NO: 129732 - protein, 247 aa, Glycine max
  Coding DNA Sequence Number=SeqID_38047
MAELRSGFLKKCHRIAVAWRVEDGGAMADMADMAARRKMAEFVLFFWSAVGVGLTRPNPTRMAATTHSANGGDEHGVNDGNEHGGDDPTHTQNIATYTAKQHLIRKSGNVAACKKTPPNVVEELKEYMTIKKSGTTYSTFGSGNMTNIRDFEFGEPIGCDGSEEDEFADSCNAAASAKTKCGTKKGPMDKFCKNPENAINRRKMKMLRQMNIRESMDKNEVLKPLVNMGHSCPFLAIVTSEFHSGIL

SEQ ID NO: 129733 - protein, 339 aa, Glycine max
  Coding DNA Sequence Number=SeqID_38048
  Gene Ontology: Mol. function=voltage-gated chloride channel activity; Cellular component=integral to membrane; Biological process=chloride transport
  Homolog annotation: Hit_ID=A7QQF5; Match level="QueryCoverage=78%, HitCoverage=29%, E-value=1e-65, Identity=49%"; Hit description =Chromosome undetermined scaffold_142, whole genome shotgun sequence
  Pfam annotation: Domain name=CBS; Domain location=102-291; Score =34.1; E_value=5.1e-07; Accession=PF00571.19; Description=CBS domain
MHVEFSISPELVALTLNLNLLGAVGLAIWVPSVTNQVKESQTPDSSKSARGYSPISHAGDDNEDNWRQANDGNDLELSIVGDGTDLEPIDTELLLDNLQVSRAMSKQYLKVLSSLTLKDAMKCMHDSQQKCVLVVDKEDFLEGILTCGDVKRCLSQKSNDTLKSDSGILDNVGFGLTQPQKLALKALCVDNMVGDLFNGSRIGSDIILECGFVSNSTPKASSSDEGMTYRGQERGILTCYPNTSLAMAKELMEAKGIKQLPVVKRGGDHSREMKRRIVGLLHYDALWQFLRHDDGHKRIDEDESRIDEDQTRIEEKRMREFQRVKLKEENGVSVNGVRG

SEQ ID NO: 129734 - protein, 78 aa, Glycine max
  Coding DNA Sequence Number=SeqID_38049
MARSLDKIKSIDGLKETLKLSVRISDLWFIGTLNKSEQAKMVFVDSDIYYLLFRPLCCNFNAIQGDEIHVVCKQDQLK

SEQ ID NO: 129735 - protein, 153 aa, Glycine max
  Coding DNA Sequence Number=SeqID_38050
MDKGFERASSSNIAKEINIMYVEWEVGSCSQVEKDIDCMAADLEGEEDMPINLKDEYWIDDGVESNNEECFEDEFVEGEQGNDVFHAIESGGIDCMQDIADLNLISVPTEELTKCHFPNIKVSYEFYNWYARGKGFAPRKVKILRNSKCEPTY

SEQ ID NO: 129736 - protein, 311 aa, Glycine max
  Coding DNA Sequence Number=SeqID_38051
  Homolog annotation: Hit_ID=A5BSR3; Match level="QueryCoverage=65%, HitCoverage=66%, E-value=8e-17, Identity=30%"; Hit description =Putative uncharacterized protein
  Subcellular localization annotation: CTP_CleavageSite=41; ConfidenceScore=5.74e-01
MASPPASPPLPPPSPSDALASPSAMKRTQKASRLRSLSTRPASAERPVVHVDPATGKSDGPHRKKLRTYLWIVARDKVDVMYENWKEVPTAQKDLIWEDIQDVRKKAQAIQKQNIASHVLSRGGYEYLEQKLLAEKTKKKLEEAAQSGSIDGVIDPPSPVRRHVKWTMACTKKIGEMTTEAAKEIAEKIDYSFEEQATQGSFVPHGRQDVLTAAIGRPEHPGRVRAAGAGVTIKQYFGSAPRMSHSSSSLPPEELQQLTQQIRDQLEESIKEKVTRQLMASFSQMQSQFQSQMQSQGLALPPKHLVGPSGP

SEQ ID NO: 129737 - protein, 64 aa, Glycine max
  Coding DNA Sequence Number=SeqID_38052
MTNANCPQESLHSVSNGNLRGMIEVDGICDNLEELGCEYTSQPTTSETSRPDLLSGGGCGSKGD

SEQ ID NO: 129738 - protein, 39 aa, Glycine max
  Coding DNA Sequence Number=SeqID_38053
MVAPDFTYESLCIQYPDEDVPYVKILISILRSSILSVPP

SEQ ID NO: 129739 - protein, 190 aa, Glycine max
  Coding DNA Sequence Number=SeqID_38054
  Homolog annotation: Hit_ID=A5AIH8; Match level="QueryCoverage=68%, HitCoverage=17%, E-value=8e-35, Identity=54%"; Hit description =Putative uncharacterized protein
YIYLGLTENKRGYISCGSVLVEGTSTRFKENKGGGRSISTEKFLSKEESRIQAPTKPSKEQDKIQTPTKKANANGTVEEPEKYSKLRTSIGKKSAEVSNSGLPGNLVKVTLSNTKVTDASVQWASLPSSISKIGREVMKHRDAAQIAATEAMQEPIAAESLLQCLSRKEEEAKKKKKQRTEREESVGLGF

SEQ ID NO: 129740 - protein, 128 aa, Glycine max
  Coding DNA Sequence Number=SeqID_38055
MLSPMKDKGEDFESYENIKIKAKTLCPMKDKGEDFESYENIKIKARTLSPMKDKSDDFESYENIKARTLSPMKHKAKDVESYESIKQRTLSPAKLKAKNVESYENIKQKTLSPAKLKAKNVESYEACQ

SEQ ID NO: 129741 - protein, 126 aa, Glycine max
  Coding DNA Sequence Number=SeqID_38056
MNVTTERDSKRVREEWPQVLMGREKANTRRGNKAYSRHNSRGMFRLEFKGRGLVVRSWAPQVEVELGVGRGGCRGANGCVATVHGAAREQARDGVEMNVAVAVEQREEDEFVSEEEVEKRLREVIV

SEQ ID NO: 129742 - protein, 64 aa, Glycine max
  Coding DNA Sequence Number=SeqID_38057
  Homolog annotation: Hit_ID=A7QF78; Match level="QueryCoverage=42%, HitCoverage=6%, E-value=7e-07, Identity=92%"; Hit description =Chromosome undetermined scaffold_87, whole genome shotgun sequence
MGHLAWADAFVVTTDSVNMISEACSTGLIHRFYTDCGADSCLNQHKMFGTLCINNNKIILVHTS

SEQ ID NO: 129743 - protein, 84 aa, Glycine max
  Coding DNA Sequence Number=SeqID_38058
  Subcellular localization annotation: CTP_CleavageSite=59; ConfidenceScore=5.38e-01
MNFRDKFSSYRTTKATKKSKAKYSKTNKNRTTLRKLRLHWTFSDDGGRQLDRCKSAVAVVMSGVYGCGAGRIADNEGEYKLREG

SEQ ID NO: 129744 - protein, 255 aa, Glycine max
  Coding DNA Sequence Number=SeqID_38059
  Subcellular localization annotation: CTP_CleavageSite=22; ConfidenceScore=5.34e-01
MTATAGGNANNNPMTIMYPKSRSTVYKSLVPLYFTHGVTTLLQKTNAFLCCLLGFHQSFAQKMIRVDDLVRCYYCGGKILVLKFVVLKVKIVLKKGVHDIGLKELTLDSDALELTNLALSNNTEVLIYVEKINDGRVVVSKGDVVALDGGDEGVGNEVVGVQAVVNESDSSDTESSEGGSKSGSKNDNECVIFEDSEEERATGVNDGFDSEDESLVNLISKKKCRKASHVGSSSGHWNVEEGNGELSEGYETEEL

SEQ ID NO: 129745 - protein, 177 aa, Glycine max
  Coding DNA Sequence Number=SeqID_38060
  Gene Ontology: Mol. function=structural constituent of ribosome; Cellular component=large ribosomal subunit; Biological process =translation
  Homolog annotation: Hit_ID=A7PMZ1; Match level="QueryCoverage=19%, HitCoverage=27%, E-value=1e-10, Identity=88%"; Hit description =Chromosome chr14 scaffold_21, whole genome shotgun sequence
  Pfam annotation: Domain name=Ribosomal_L32p; Domain location=55-112; Score=3.3; E_value=0.06; Accession=PF01783.14; Description=Ribosomal L32p protein family
  Subcellular localization annotation: CTP_CleavageSite=52; ConfidenceScore=5.49e-01
MRAIVKITGGRLGSILGFFNRFIHSLPQSPPLSVTIDFSSPTFSSSFVGSMELMAVPKRKVSPHKRGIRNGPKALKPIPVIVLCKKSLQVWAHIRDLAPFCRRFTSLQRITDFLIRGRSTSGVQGKLCCLAIAITVYCICLSRNKQLIFEDYQFSVIEVINKIKFLMYRQAHLLQLF

SEQ ID NO: 129746 - protein, 95 aa, Glycine max
  Coding DNA Sequence Number=SeqID_38061
MSHEFSLILTRLCPQMSLVELSLTGQHYGYNIPKNQVTALRVQIYDKLALSYQVLRSNHFPMRMILTTHKLPTEDLAFHCKEAPFYKFKEEKKRN

SEQ ID NO: 129747 - protein, 156 aa, Glycine max
  Coding DNA Sequence Number=SeqID_38062
  Homolog annotation: Hit_ID=Q2HW90; Match level="QueryCoverage=91%, HitCoverage=35%, E-value=4e-15, Identity=32%"; Hit description =Putative uncharacterized protein
MGQLQRQAFRKTYGKIWDLAMIEVSTEAISSLAQYYDRPLRCFTFGDFQLSPMVEEFEEILGCPLGGRRPYLFSGKCLEAKARTLAGKGEWAPLIDILALLIFGGVLFPNMDGLVDLAAIDAFLAYCDHRESPVVAMLADLYDTFDRRCEKSSTRI

SEQ ID NO: 129748 - protein, 80 aa, Glycine max
  Coding DNA Sequence Number=SeqID_38063
  Subcellular localization annotation: CTP_CleavageSite=13; ConfidenceScore=5.11e-01
MPISPGRWIVPTRHSVDPKKSNRALGFPALVTGLCSPTGCPFHPTRSCHRDIGIAPTKTPSGPGEVQQGPGVSCSGYRPL

SEQ ID NO: 129749 - protein, 78 aa, Glycine max
  Coding DNA Sequence Number=SeqID_38064
MHGTSRPCLRKTVERATHECCRVGRANNSNAFEARPTGVQDNQTIRNSSNVSMRLFGSTGEPDGRGDGIWDGGLVVSL

SEQ ID NO: 129750 - protein, 76 aa, Glycine max
  Coding DNA Sequence Number=SeqID_38065
VSREGAQSMKNLRDLRSNPFQDGGRMMQSYPPRVLDRRLQKDWAKAAKEGPGVLMNLRVDFLSPWAKVGSTLLCKY

SEQ ID NO: 129751 - protein, 72 aa, Glycine max
  Coding DNA Sequence Number=SeqID_38066
MDSFASWKMNGSGMEKEERERRCHFKEKMSLEEAHHHRRAWIRALRKKKMNEGRGREEHEILCSKRALKSDV

SEQ ID NO: 129752 - protein, 100 aa, Glycine max
  Coding DNA Sequence Number=SeqID_38067
MASQEEWVPFANILALLIFGVVLFPNVDSLVDLATIDAFLAYHHSKESPVVAILADLFDTFDRRRQHNQLVSSMEGRQGGSSLLMWGLPKRSVDRDEGLY

SEQ ID NO: 129753 - protein, 132 aa, Glycine max
  Coding DNA Sequence Number=SeqID_38068
MNCVFVHASSTHEFGAMHSDCLVQFSILNPFSEHHELWFSFMCPPPTSLEPCVASSTHEFGAMRSDCLVQFSILNPFRSRMNCVFLDATSTHEFAAMRSDCLVQFSILNPFSEPHELRFHSCVLHPRVWSHA

SEQ ID NO: 129754 - protein, 85 aa, Glycine max
  Coding DNA Sequence Number=SeqID_38069
MGMFNSSKHGDFNKLSTRVFTNNYHESRKTNKTTHHISQNPYPQKSKEKEVHPNLKFRSPTRRHALHDSENALLSRFGAEMGTKG

SEQ ID NO: 129755 - protein, 131 aa, Glycine max
  Coding DNA Sequence Number=SeqID_38070
MVLKEELAACSRSKKSLAQHVEATEQSMLAIIGQYKEELNQSLTHEQKLVKDFVQAYTEKEARGRVIDALHQEATMWMDRFALTLNGSQDLPRLLAKGRGMAEGSGTGATARNELGLGQKRDGFQSEGGIL

SEQ ID NO: 129756 - protein, 145 aa, Glycine max
  Coding DNA Sequence Number=SeqID_38071
MKRLLTLLAIVPILFAACSKKEEPVPEKENKLYEVKFSATGLEQSLEPIGPKSSTKASTQDPLLKDEINGIQFFVFDNLSNLVGSKYSDLYDTKGNFIPGSLNVTMELPKDFPSTYSTKEIIQFSPIFIHKQSQLTVGTSAVNHA

SEQ ID NO: 129757 - protein, 33 aa, Glycine max
  Coding DNA Sequence Number=SeqID_38072
MEVSQPNLSAGGRRETHWEGISTPHVRHKRRQP

SEQ ID NO: 129758 - protein, 69 aa, Glycine max
  Coding DNA Sequence Number=SeqID_38073
  Homolog annotation: Hit_ID=A5BKB9; Match level="QueryCoverage=71%, HitCoverage=4%, E-value=6e-07, Identity=51%"; Hit description =Putative uncharacterized protein
MTTLCKSRRRYRWAIIANFGFFTIQVISPNEMFVFMGNRVKTPVEAFGTYRFKLDIGHHLDLLETFYLI

SEQ ID NO: 129759 - protein, 276 aa, Glycine max
  Coding DNA Sequence Number=SeqID_38074
  Homolog annotation: Hit_ID=Q6WAY6; Match level="QueryCoverage=19%, HitCoverage=9%, E-value=3e-09, Identity=53%"; Hit description =Putative uncharacterized protein
MTPSTEDVKKAMQGLFAVLQLSRWGWFHTFFSKKAGPSIRYKEGRIKIPSSCEGCPNVPLMGTRGCINYNPVLAIRQLGYPMRGAPLDESITPFIARGFSDHNARDRELRGSSNGIIGGYHKWLRVRKQGLDWLPNLKTVRDDEVKASEESDEVQAQKAELERAWVVEEKFKAAIVSSNSEEVKGIIMGQSETEGNMWAIIDECKEKLNLAATHEQRLEDEYAKISAEREARERESRTSPIASQSQSNGGHLLRPQEDPQTSQLLSTYDRLNGPYD

SEQ ID NO: 129760 - protein, 119 aa, Glycine max
  Coding DNA Sequence Number=SeqID_38075
MTPLTKIWMTLLLSNILPNDHNTDLLLRKYQLSYRVPVPPARSRHRNIGITPARHPVDPEESNRVLGFPALITSLYQFYGVPVAPSMVIRPPTNQAFIKKYCAPRQAQCVTPQQPGDGW

SEQ ID NO: 129761 - protein, 79 aa, Glycine max
  Coding DNA Sequence Number=SeqID_38076
MAKIQGPKEGKTYSNIYKEEWTQPWSMGSEIYPEVHENPKAFFSSFSRILLESSIQYLWGVGLHHRRCGIQIILKRYNF

SEQ ID NO: 129762 - protein, 67 aa, Glycine max
  Coding DNA Sequence Number=SeqID_38077
MWVIIDQYKEKLSLKVTHKQRLEDEYAKMDKFAFTLNGSQELPRLLAKAKAMADVYSTLEKVHRLLN

SEQ ID NO: 129763 - protein, 85 aa, Glycine max
  Coding DNA Sequence Number=SeqID_38078
MELKVRRPWSCGSAPSQETEQDNHVFIHMGFIRLIGGFCNILEISIRNFWKRCILNEYIYKSRNSGGQDMRVRLIKGEKSITGRL

SEQ ID NO: 129764 - protein, 71 aa, Glycine max
  Coding DNA Sequence Number=SeqID_38079
MREMLLVEILDTVFLTSMIRPSKVGMIPPSEIVPVAGEHKLHAVQLLQIVAQKGKGLRGGQQRSINHRVWR

SEQ ID NO: 129765 - protein, 68 aa, Glycine max
  Coding DNA Sequence Number=SeqID_38080
MDVKSAFLNGLIQEEIYFLENKSKKRNEENKDVQGTHSPRKDASRNGKPQETWPLDNIIGDISKGLLP

SEQ ID NO: 129766 - protein, 60 aa, Glycine max
  Coding DNA Sequence Number=SeqID_38081
VFSEGLGKCAYCAKRVHPLGMKQSVSHGLNSLRHYCELSDLLSAFAELSELHSDAKLPIL

SEQ ID NO: 129767 - protein, 77 aa, Glycine max
  Coding DNA Sequence Number=SeqID_38082
MWLSRRFIYQSLQAACMVSRGGDERDECLFHLGESHDMETCPAVEELLQRLMDWGQLEVSKGGREEPQICMQSEEKK

SEQ ID NO: 129768 - protein, 58 aa, Glycine max
  Coding DNA Sequence Number=SeqID_38083
IQLRPKATAYNPQTQQKQAQFKDKSLTFFSKYMQLRAPKYINGKLESPRMRYLPVGDE

SEQ ID NO: 129769 - protein, 257 aa, Glycine max
  Coding DNA Sequence Number=SeqID_38084
VDSRGSPGHVLIFRGLHVLIFRGLHILTFGGLHALTFRGLQVLTLRGLDVLAFRGRHALTFRGLHVLAIIGLHSLAFKRSSALKCLTETRAPSYGASSFLLSVSGPPPDSGGGPTMQVQPEEEAIVQLLCIPGQDFTRVAAKRQVRIVRTNMITLTQICMTLLLSNILPSDRNADLPLRKGHTRKTPSGPGEVQQGLGVSSSSYGPLSVLQGARPPQQGIVPARHPVDPKKSNRVLGFSALITSLCQFYGVPVAPSK

SEQ ID NO: 129770 - protein, 152 aa, Glycine max
  Coding DNA Sequence Number=SeqID_38085
MEATKEQMATMMGAIISMKKIREVDMVAVAATNAVAKVNPTSPSGLKQMNHPTSNMVGKDLGSTDDPMTCKFKTSTPSRHMACLPNYTPPNVAYIPNEDVNNSTPILIKSQQPQSDHAHVSRPMEETHGMPHHNLADFEPCLGYATEGKAVG

SEQ ID NO: 129771 - protein, 62 aa, Glycine max
  Coding DNA Sequence Number=SeqID_38086
MGVCDMSQRALRGRARARHTGALSKEGKMRGVATNEGISTFHVDKSGAFAPTYPPSKRKSDL

SEQ ID NO: 129772 - protein, 83 aa, Glycine max
  Coding DNA Sequence Number=SeqID_38087
MATARWALKHPVYGIVILRLGIYTNKRGNIKKEHESRDPLVMWLRMPPDSWVTVTKGGVVAQSRAFTPTYPQFVMRNSDLRSS

SEQ ID NO: 129773 - protein, 165 aa, Glycine max
  Coding DNA Sequence Number=SeqID_38088
  Subcellular localization annotation: CTP_CleavageSite=83; ConfidenceScore=5.65e-01
APSTSAAAEAPAPSSSSVPPSSSTQILVIPPTPIQMPLLPPLSAGPSDFIFTPQMLHSMLQSIHRGQSIMMQSLQGLGLPSIISMEEFDAQEAWIGDQPSSSRGGGASTSQEPNIEEPLALAPAPAKGEDELTPPEPFYFDTDVHMAQEEGTSTNQIPEPSSAPP

SEQ ID NO: 129774 - protein, 115 aa, Glycine max
  Coding DNA Sequence Number=SeqID_38089
MLQVDSRGSPPQVNELLDEGLVRKSLNPCALLVPKIAPLIELVRKHVPSCEDAQEMGFQTLPYFNIPNITNIYVFVLFTSVEEKSPEFQEPRDLRSNPFQGGGNEVILPRKGIGL

SEQ ID NO: 129775 - protein, 88 aa, Glycine max
  Coding DNA Sequence Number=SeqID_38090
MEEKSKRGHEEHSCTESPTLNVDPPSPVARHLKWKIARTKRHGQMTIHYRNKQHKGVLFRMGDRTYSTRPLADLSIQAVFASQGQVSQ

SEQ ID NO: 129776 - protein, 265 aa, Glycine max
  Coding DNA Sequence Number=SeqID_38091
  Homolog annotation: Hit_ID=A2Q4P8; Match level="QueryCoverage=61%, HitCoverage=87%, E-value=1e-25, Identity=40%"; Hit description=IMP dehydrogenase/GMP reductase, related
  Pfam annotation: Domain name=DUF1723; Domain location=117-166; Score =51.8; E_value=2.3e-12; Accession=PF08330.1; Description=Protein of unknown function (DUF1723)
TRGLRRVLGTGRGRDLSQHVAEDVPRRRRPTASARRQRVTQRVEDVPQLAEDVPLAFDGSPERTGTADGAESDRVASDGTAADDEGKVDKFGRPTAEIKGMIAATGLDPLIRCSVITTDPGLISAFVERWHRETSRFHLLVGEVTITLDDVSSLLHIPITGALHSFEPLATSDAVALLTELLEVTPDEATAETPWTYLLHLVGCTLFANKSATHVHVVHLQAFRDLGQAGAFSWGVAALVHLYDQLNEASQAPTRHIAGYISLLQ

SEQ ID NO: 129777 - protein, 77 aa, Glycine max
  Coding DNA Sequence Number=SeqID_38092
MPRRPLSGDLSIWYFDLLLGWRQAFRPPLCALRLALIEEKAAVNSKTSGSDPAPRGPHFRSHISLPLFDFPQISCPF

SEQ ID NO: 129778 - protein, 554 aa, Glycine max
  Coding DNA Sequence Number=SeqID_38093
  Gene Ontology: Mol. function=amino acid transmembrane transporter activity; Cellular component=integral to membrane; Biological process=amino acid transport
  Homolog annotation: Hit_ID=Q47689; Match level="QueryCoverage=75%, HitCoverage=89%, E-value=0.0, Identity=94%"; Hit description =Probable S-methylmethionine permease
  Pfam annotation: Domain name=AA_permease; Domain location=73-505; Score=417.4; E_value=2e-122; Accession=PF00324.12; Description=Amino acid permease
  Subcellular localization annotation: CTP_CleavageSite=31; ConfidenceScore=5.12e-01
MPMVNNEASPLRSPSAARSLFFTGLKMTVRMAAHRMAENASVSPGAYGLASDSLCDPYHPPQTQRAACPFTSGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWAWCVVFCVVIFGLNVISTRFFAEGEFWFSLVKVITIIAFIILGGAAVFGFIPMQDGSPAPGLSNITAEGWFPHGGLPILMTMVAVNFAFSGTELIGIAAGETENPHKVIPVAIRTTIARLIIFFIGTVFVLAALIPMQQAGVEKSPFVLVFEKVGIPYAADIFNFVILTAILSAANSGLYASGRMLWSLSNEKTLPRCFARVNKNGVPLTALSVSMLGGVLALFSSVVAPDTVFVALSAISGFAVVAVWISICASHFVFRRRHLQSGQPLSALQYRAPWYPLVPVLGFILCVVACGGLWFDPSQRIALYCGIPFVALSLNMSQNNPLTAILEKQPFVVLDGAMATELEARGCNLADNLWSAKVLMENPGAYPRSPPRLLPGWRA

SEQ ID NO: 129779 - protein, 115 aa, Glycine max
  Coding DNA Sequence Number=SeqID_38094
MAAQLIHDRVEMECLEGVWETLEGNARCRFRGTIRLTATSLLVQVIEVSSSKEDPEEDPEELPPEPAVDALDFPEGDGDPLPDVDSPEDVMSASEANSTEESGPGGIVTSGDSSS

SEQ ID NO: 129780 - protein, 85 aa, Glycine max
  Coding DNA Sequence Number=SeqID_38095
MRVPRKEYARSRHQRLFEENVGKTGKDAIYELLSERFGSCIYARGSKIGEMLAAQLAQASSARPGEPGCFLQKQQPSGGIFWRAQ

SEQ ID NO: 129781 - protein, 111 aa, Glycine max
  Coding DNA Sequence Number=SeqID_38096
MGIAPTKTHSGPEEVHRALGFPALVTGLCRPYRAPVPPASSCHRGIGKDCARKTPSGPEEGQQGLGVASSKYGSLSVLRSVLHPNKVIRPHINRAFIKKYCAPRRAQGETP

SEQ ID NO: 129782 - protein, 103 aa, Glycine max
  Coding DNA Sequence Number=SeqID_38097
MLSAAVRLRCINTGFQHGLRSSIKRCDRKLYGHQRQLVQRHKTTAFQPVTVSVGRTPDNATMQLAVGKGQLALPLQNLPCKEREIDAIQLNINARDIGQIDEL

SEQ ID NO: 129783 - protein, 37 aa, Glycine max
  Coding DNA Sequence Number=SeqID_38098
MLQSPSLEELNCPWEIYAYKTLIETTVIQFKRKTGVN

SEQ ID NO: 129784 - protein, 100 aa, Glycine max
  Coding DNA Sequence Number=SeqID_38099
  Gene Ontology: Cellular component=integral to membrane
  Homolog annotation: Hit_ID=Q8U4V8; Match level="QueryCoverage=82%, HitCoverage=50%, E-value=2e-35, Identity=89%"; Hit description =Putative uncharacterized protein
MALFLVTTLATTLTGFLFPIGNFTPALGVGVISTLVLAIALVALYGYGLNGRARIIYTITATMSLYLNMFVLIVQAFLKVETLNNLAPNGNEPPFLIAQT

SEQ ID NO: 129785 - protein, 250 aa, Glycine max
  Coding DNA Sequence Number=SeqID_38100
  Gene Ontology: Cellular component=integral to membrane
  Homolog annotation: Hit_ID=Q7CSM9; Match level="QueryCoverage=70%, HitCoverage=66%, E-value=4e-63, Identity=68%"; Hit description =Putative uncharacterized protein
  Pfam annotation: Domain name=SH3_3; Domain location=68-121; Score =68.0; E_value=3.1e-17; Accession=PF08239.2; Description=Bacterial SH3 domain
  Pfam annotation: Domain name=SH3_4; Domain location=66-122; Score =18.8; E_value=0.0019; Accession=PF06347.4; Description=Bacterial SH3 domain
  Pfam module annotation: Pfam domain module=SH3_3::SH3_4; Domain location=68-121::66-122
MEERVFSDRGSMRNACSSIEQDGCRQGQSGPLLEEKEVKKKLFGAIALVAMLAAPALAEAATRGFATANVNMRSGPSTAYPAVVVIPVGAPLTVHGCLSDTPWCDVSFVNGRGWVAGRYIQTTFRQNRVYVEPRYYRDLGVPIITFEAGRYWDRYYRDRDFYRERDRWRRPPPSGGYWNAPPPSAGWDRPRPRDDWRDGRRDEWRDGRRDEWRDPRQGGGPNDGRWERRYGDWNQGDRNQDRPRRDDDRR

SEQ ID NO: 129786 - protein, 142 aa, Glycine max
  Coding DNA Sequence Number=SeqID_38101
  Subcellular localization annotation: CTP_CleavageSite=54; ConfidenceScore=5.59e-01
MNSSKPYTGAMKGAMHKPQANLGADQKFSPNRFPPSNVQSFEFWMTSPLNESISCFLIREDPWELVPIASRGLHVLASRGLHVLTFRGLHALAFRELQVITFRELHALAFRGLHALAFRGVHILACRGLHALTFRGLHTLAL

SEQ ID NO: 129787 - protein, 114 aa, Glycine max
  Coding DNA Sequence Number=SeqID_38102
MGGELIKMRVQIEIFKFSNLAHSRIFLKLGKLGGNLLPFFPINRRKEAVPNIPQPPWLCILAILGVKNYFREENSSRGAFVKLLRRFREQIREGFPSFFTVLHPFFVRSSFFNG

SEQ ID NO: 129788 - protein, 172 aa, Glycine max
  Coding DNA Sequence Number=SeqID_38103
  Homolog annotation: Hit_ID=A5AK77; Match level="QueryCoverage=54%, HitCoverage=11%, E-value=2e-10, Identity=38%"; Hit description =Putative uncharacterized protein
MTRGNPSDLQPFDPEIDRTFHRLVRHHFIPFDHSEHCITGESVHSVIGDFEHPDLEHYNSEHSDFAHSEIMAQPPPRERTLREMAAPDFTYESLCIQYPDEDVPYVLKTGLIHLLPKFHGLAGEDPHKNLKEFHIVCSTMKPPDVQEDHIFLKAFPHLLEGVAKDWLYYLAP

SEQ ID NO: 129789 - protein, 153 aa, Glycine max
  Coding DNA Sequence Number=SeqID_38104
CAICGGAHESGCYISTKDTTDEVNYMGNQPRSNFNAGGPQQQGPSLYDRTTKLKETLALFMQVSMSNQKSTEPAIKNLEVQVGQLAKQLADRPSSSFGANTEKNPKEECKAVMTRSKMVSMNEGEERIGAEKQQLVTEPTIDPVVEPLSETKE

SEQ ID NO: 129790 - protein, 338 aa, Glycine max
  Coding DNA Sequence Number=SeqID_38105
EDEEVRALKLELGKARLAKEKFKSAATHIRKECTELQEENAATAKALNKKLKGPARKNMAERNSGGHCGVATMSSSSKERKETGHGSLAQHLEATEQSMLAIIGQYKEELSQYVTHEQKLAEDFAQVYTEKEARGRVIDALHQEVTMWMDRFALTLNGSQDLPRLLAKAKAMAEEQMKADLSALKDQMASISEVMLKLQKTIEDKATATASSTVREAESVLQPALNPGRDRNTAVFGRRYSSQAYPYGLPPDFTPRATPEDLSQAPTFEGQLPPYDDYPGQDDEEGDTHLGPLLHLKDPSPHELPQPNIVHHIPASPTPAKESIPFVEDKGKIEALEE

SEQ ID NO: 129791 - protein, 114 aa, Glycine max
  Coding DNA Sequence Number=SeqID_38106
MGAKYLEVVKRKLHATKQWSPDKIRLTKVAGDHKISLHATDSLSLDDKGAEFVYARLPPNLLLLNDKGKNAGPSGSRMSSGPLPLDDKSMTEIVCAEDDVNLRVSTGLLAAIDK

SEQ ID NO: 129792 - protein, 122 aa, Glycine max
  Coding DNA Sequence Number=SeqID_38107
MRGYIIVTHTVRQPWANEPIDAQRLTSSSAPFDVLTREVRLTSSFAPFVVLTREVKRHSGLPYGYRTFRQLGANASVDAETKIVFYNFCRHDPISQVTCGVTLWLLAPFVNQGQTSPLTPGD

SEQ ID NO: 129793 - protein, 88 aa, Glycine max
  Coding DNA Sequence Number=SeqID_38108
MWRKPKGGVVVQSAHLGLPDSSSRRLLLLEEATLARLGELGCKLLPYFAINSGRSEEGRGSAFLALLILSKLLRKIVSVKKIQAEALP

SEQ ID NO: 129794 - protein, 86 aa, Glycine max
  Coding DNA Sequence Number=SeqID_38109
MANIDPVNEPYDDNLYFDPSVLDQNEYEDFSHFFQVDIVFDQRENAQYMTCDKYGHGRQTNIDMEDPRNTGTKKCGCPFKLIGKRS

SEQ ID NO: 129795 - protein, 127 aa, Glycine max
  Coding DNA Sequence Number=SeqID_38110
MEEAKKRIQSWSTNEQLLVGKVYEYIRGVKPTVSWCSVIWNPAILPKMSFILWLAKRKSLQVWAHIRDLAPFRRHFISLQHITDSLIRGRSTLGVQGKFCCLAITITVYCIWLSRNKLIFEDYQFSV

SEQ ID NO: 129796 - protein, 144 aa, Glycine max
  Coding DNA Sequence Number=SeqID_38111
MKYECPRLSLLIITPIPKANACFEHSNFFKVTAPEARPGQLRPGAHRRAEGTRQPVHTRGGPGRPNPKSNYELFNCNNLIYAIGAGNYRGCWHQTLPSNGSSLRDLDCTHSNYQTQEPGIVIYCHYLPVSGLGNLRACCLPWMW

SEQ ID NO: 129797 - protein, 319 aa, Glycine max
  Coding DNA Sequence Number=SeqID_38112
  Gene Ontology: Mol. function=two-component sensor activity; Cellular component=membrane; Biological process=signal transduction
  Homolog annotation: Hit_ID=Q31IU7; Match level="QueryCoverage=56%, HitCoverage=27%, E-value=4e-48, Identity=51%"; Hit description =Putative integrase
MTEYELVGMVERLDPTKALFGPVGEVAKHLPVAMQEFNTLEHAAVHVTEYGYCVHDYTMSPCEKFRDCVNCTEQVCIKGDDTEKLDRIKKRLEKSERLFLLADAAVESGEIGTDRWYQYHKKTVTRLRELVAILENPEIENGAQIKLRGNDFSQLRRVVAKKSIEAIEQKGKESEEAGGALAKHLDNRDINAIVNLIRGWQEPKLSWSAICEAAEPLVGKLPSRQSLSAHEAIVAAYQTKKEALKGRGRKNPRPASLNIAAARIVNLGSEIEELKEENRRYKQQFVIWQYNAYKHGMAEHQLNAPLTKIDRERSDGEKR

SEQ ID NO: 129798 - protein, 183 aa, Glycine max
  Coding DNA Sequence Number=SeqID_38113
  Gene Ontology: Mol. function=RNA-directed DNA polymerase activity
  Homolog annotation: Hit_ID=Q1RSH0; Match level="QueryCoverage=66%, HitCoverage=62%, E-value=2e-10, Identity=29%"; Hit description=H+ -transporting two-sector ATPase, alpha/beta subunit, central region, related
ALLHGRGSIDNSPWWKDLKSIFQQQHQNSLANNLRWKVSQQQDLTINLMGQNIDNGWDWKFQWRRNFFDHEIDTVAAFMDEIDGAQIHSSRMDYLTWRAEPSGSYSTKSAYNFLMEDGGSDYEDNASRFMWNLKIPPRAAAFSWRIFKDRLPTKANLRRRQRRKLLVMSCLIAQELDAFGGRF

SEQ ID NO: 129799 - protein, 75 aa, Glycine max
  Coding DNA Sequence Number=SeqID_38114
MIVKESIHVAFDETNASLPRKDILDDISESSEDMHIYGVNHKGKGEGNDEDLHIDEIKTNVDLPREWRISRYHPL

SEQ ID NO: 129800 - protein, 171 aa, Glycine max
  Coding DNA Sequence Number=SeqID_38115
  Homolog annotation: Hit_ID=A5BQX5; Match level="QueryCoverage=71%, HitCoverage=34%, E-value=2e-08, Identity=33%"; Hit description =Putative uncharacterized protein
MTRGNPSDLQPFDSEIDRTFHRLVRHSVHPGHSVHFEHSEHSVEGDSEYSDFEHSTTNFYTENMAQPPPCERTLGEMAAPDFTYESLCIQYPDEGVPYVLRTGLIHLLPKFHGLAGEDPLKHLKEFHIVCSTMKPPDVQEDHIFLKAFPHSLEGVAKDGYITLLQGPSRAG

SEQ ID NO: 129801 - protein, 181 aa, Glycine max
  Coding DNA Sequence Number=SeqID_38116
MTTLTQIWMTLLLSNILPCDHNSDLPLPKCQLVYAILTRMSVHVAQLIADAIYLFAGMAPTRHPLDPDKSNRALGFPALITGLCQSFGVPVAPTKEAANHRAHVRTNETLYQLSLSMQSQGFASFSCPTPDQFRAEVAWPGDWPEAQTGEAPPEAPDDGEEAHEDEEMTDLLDFLGGSGAT

SEQ ID NO: 129802 - protein, 191 aa, Glycine max
  Coding DNA Sequence Number=SeqID_38117
  Homolog annotation: Hit_ID=Q949K7; Match level="QueryCoverage=25%, HitCoverage=54%, E-value=3e-08, Identity=54%"; Hit description =Putative gag polyprotein
MGETHEIPHHDLVDFEPWLGYATEGEAVAPPAMAEKGKLDHLKERLRAIEGVLDFDKYKGTTCLKNHLKMYCQKMGEYAKDEELLIHSIQESLTGVAVTCINTILIWFWIGYNYRTFAKKGDGSSKDHAQKVEGSGGPGGTPNDGKGDDDRDGRHIIDLVFASERIDVDPKKGGKFDHPTRTTEKTGANKE

SEQ ID NO: 129803 - protein, 119 aa, Glycine max
  Coding DNA Sequence Number=SeqID_38118
MKDKRDEEEKLEKQKKKKDSKALSSKAKGKGKEEKDFSKNIVNKENHFATKGDIKRALLLKHLLPSPIRENPLAPPYLLSLSDQGLPMDPKRIQVIPEWLTPPSIREIWGFNILTNFYK

SEQ ID NO: 129804 - protein, 58 aa, Glycine max
  Coding DNA Sequence Number=SeqID_38119
  Subcellular localization annotation: CTP_CleavageSite=22; ConfidenceScore=5.10e-01
MTLDGETCSPLKLKVRACSPLKARTYSPLKVRACSPLLARMCSPLKARTCSPLNGEGN

SEQ ID NO: 129805 - protein, 220 aa, Glycine max
  Coding DNA Sequence Number=SeqID_38120
MYEMVPRKLASKRSRKDKVAEGTSSAPDYDSHRFRSAEHQQGFEAIKGWSFLRERRVQLRDDEYTDFQEEIVRQRWASLVTPMAKFDPDIVLEFYANAWPTEEGVQDMRSWVRGQWIPFDADAISQLLGYPFVLEEGQECEYGQRRNRSDGFDEEAIAHLLCIPGQDFAQTTAGRRVSIMRTNMTTLTQIWMTLLLSNIQPSDHNSDLPLPKCQLVYGIL

SEQ ID NO: 129806 - protein, 99 aa, Glycine max
  Coding DNA Sequence Number=SeqID_38121
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=45%, HitCoverage=23%, E-value=6e-18, Identity=93%"; Hit description =Chromosome chr4 scaffold_32, whole genome shotgun sequence
  Pfam annotation: Domain name=APC10; Domain location=7-99; Score= -63.4; E_value=0.00086; Accession=PF03256.7; Description=Anaphase -promoting complex, subunit 10 (APC10)
MLLELWVEENPTLLLEQTWVLKAQSFLCCQLTRYELYLSLLLFLLIVLYVVFKLDESYTPSKVSIRAGDGFHNLKEIKTVELVKPTGWVYLSLSGADPR

SEQ ID NO: 129807 - protein, 172 aa, Glycine max
  Coding DNA Sequence Number=SeqID_38122
MSKSCGFGMTGPLDESISCFLIRVDPWVLVHASLQRTTRPHLERTTRPHHSEGCTPSPPEDYTSSPSEGYTPSPQRTAWLHALTFRGLHVLANRGLHALTLRGLHVLALRGLHVLTIRGLHAFTSRGLHVLALGTSYPHLQRTTRPHLQRATRPRHQMTACPHLRRATRPHL

SEQ ID NO: 129808 - protein, 99 aa, Glycine max
  Coding DNA Sequence Number=SeqID_38123
MDHQRLMQSYPARALDRRLQISGPWAKYEPTYLCTYLSYPNFIRGQLFVDMCVEAKLHDDDKGDDKKLKDQSKNNSSESRTIQEFKIRIKKNSRLKKKV

SEQ ID NO: 129809 - protein, 47 aa, Glycine max
  Coding DNA Sequence Number=SeqID_38124
MDTSEPYTRAIRGTMHKPQANLGANQNFSPGFVPKSKLQKDLSQDLR

SEQ ID NO: 129810 - protein, 87 aa, Glycine max
  Coding DNA Sequence Number=SeqID_38125
MVLAVLWFIPRSEWTTGDLGRITGMEFRLKSARHRVRDLQKVECAMDKENKRLTRAPTKGQRDKEPPAAPPSFPGSLPVRTTRREGI

SEQ ID NO: 129811 - protein, 244 aa, Glycine max
  Coding DNA Sequence Number=SeqID_38126
MGEAEEVQEKMKADMEAMKEQMATMMEAMMSMKKIMEANVVIVAATSAVAKVNPMLPSGLKQMNHPTSNMVGKDLGSADDPMMCKFKTSTPSRHIACLPNYTPPNVAYIPNGDVNNSTPILIKSQQPQSDHAHVSRPMEETHEIPHHDLANFEPCLGYAAEGQAIGGIPLQNTLEGPQYHPQPQPSHSTAVKNPHAMAEMGKRKGSGPLKEVLDFDKYKGTTCPKNHPKMYYRKIRAYAKMRNC

SEQ ID NO: 129812 - protein, 113 aa, Glycine max
  Coding DNA Sequence Number=SeqID_38127
MAILIANTSTTFHRDERLRNTNGFMIPTWLAHEENARIMHKQNMKTKGMQFVEQKCPMCAVKKVIWTFRLPMTKDKTNIQRVRDDMMLMRKSATGGCTQHGNIHKIIIQQRRT

SEQ ID NO: 129813 - protein, 94 aa, Glycine max
  Coding DNA Sequence Number=SeqID_38128
MAVKLRSSAGSFGRGVPPRSLCREFPRWHFLRGQTFGNRFEILGVLCCTINEVPRRVRNQKEAGLRDPSNSVMWRKSKRCVFAQSVSFRNFFES

SEQ ID NO: 129814 - protein, 177 aa, Glycine max
  Coding DNA Sequence Number=SeqID_38129
MSWQRSHCLSMPHKENHDRKIIYNGLTNEITLTHLGTKFVLHPQTPSQVAKDQLTMKDKRDEEEKLEKQKKKKDSKALSSKAKGKKKEEKDSSKKIVKKENHFATKGDIKRSLLLKQSFYLLLSREHPLALPQFLLETLPLNDQGVPKNPKRIKIIPEWPTPPSIRKIWGFHDLRNF

SEQ ID NO: 129815 - protein, 242 aa, Glycine max
  Coding DNA Sequence Number=SeqID_38130
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=88%, HitCoverage=52%, E-value=1e-102, Identity=77%"; Hit description =Photosystem II 44 kDa reaction center protein precursor
  Pfam annotation: Domain name=PSII; Domain location=1-242; Score =217.1; E_value=4.1e-62; Accession=PF00421.10; Description =Photosystem II protein
MTTILGIHLILLGIGAFLLVFKALYFGGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEP

SEQ ID NO: 129816 - protein, 252 aa, Glycine max
  Coding DNA Sequence Number=SeqID_38131
MLAGLWHHAVVGGDHQQGDGDTRRTGHHRMHEALMAGHVDETQRRRRALSVPAFYRDIGIAQFDGNAARTLFLQAIGFDAGQCPHQAGLAMVDMPGGYRRSCLQHAPLGQEGPLRRRVPGSAGPATTRHRRCGPAPDAVADASAWPGGPVRHGVRWQCAVRHWPAAPAAARRCRSGCASKQARGCSPPPARHAWVAAGAGPAHRCRPACATGCAGSAGAVPAAPVRDTGPAPLPARPVPSCPCAVPASAGCG

SEQ ID NO: 129817 - protein, 105 aa, Glycine max
  Coding DNA Sequence Number=SeqID_38132
  Subcellular localization annotation: CTP_CleavageSite=94; ConfidenceScore=5.15e-01
MHHRPRTHRHHLIRLILLGHLAWSGIYSTWFASRRPTTGGRCRYMSVSTSSASVSRARVSFLFRALLQISLGLRLHGPEIGPRPKQGRRLQRLLAMQRKPAWMRR

SEQ ID NO: 129818 - protein, 97 aa, Glycine max
  Coding DNA Sequence Number=SeqID_38133
  Gene Ontology: Mol. function=diaminopimelate decarboxylase activity; Biological process=lysine biosynthetic process via diaminopimelate
  Homolog annotation: Hit_ID=Q76E49; Match level="QueryCoverage=100%, HitCoverage=26%, E-value=7e-44, Identity=86%"; Hit description =Diaminopimelate decarboxylase
  Pfam annotation: Domain name=Orn_DAP_Arg_deC; Domain location=1-72; Score=18.0; E_value=1.2e-05; Accession=PF00278.13; Description =Pyridoxal-dependent decarboxylase, C-terminal sheet domain
MNDLMRPALYDAFHNITTIAPSAAPAQRDFLGHDRTLAIAEGDYLAIHSAGAYGMSMASNYNTRARAAEILVDGDQVHVIREREQIADLFKLERTLP

SEQ ID NO: 129819 - protein, 42 aa, Glycine max
  Coding DNA Sequence Number=SeqID_38134
MTKARQKWVRKENEGGACHPALTGELGCGAFWRTSWKAQVGL

SEQ ID NO: 129820 - protein, 148 aa, Glycine max
  Coding DNA Sequence Number=SeqID_38135
  Homolog annotation: Hit_ID=Q6WAY6; Match level="QueryCoverage=27%, HitCoverage=7%, E-value=2e-10, Identity=68%"; Hit description =Putative uncharacterized protein
DSSSCEGFPNVPLMGTRGCINYNPVLAIRQLGYPMRGAPLDESITPFITRGFSDPNAKDRELRGSSNGIIGGYHKWLRVRTQGLDWLPNLKTVRDDEVKASEESDEESRTSPIASQGQSNGGHLLRPRGDPRTSQLLSAYDRLNGPYD

SEQ ID NO: 129821 - protein, 201 aa, Glycine max
  Coding DNA Sequence Number=SeqID_38136
  Gene Ontology: Cellular component=exocyst; Biological process=vesicle docking during exocytosis
  Homolog annotation: Hit_ID=A7Q0F3; Match level="QueryCoverage=35%, HitCoverage=8%, E-value=2e-22, Identity=70%"; Hit description =Chromosome chr7 scaffold_42, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPHPENFLNPVIRERSYNTLDHKKVVIVSEKLRDPSDRLFGTFGSRGARQNPKRKSLDTLSTELEFVIMVIAVSFGKPVVPAALMNRPTRGERRFAYWALFRFLAH

SEQ ID NO: 129822 - protein, 108 aa, Glycine max
  Coding DNA Sequence Number=SeqID_38137
  Homolog annotation: Hit_ID=A6FJQ2; Match level="QueryCoverage=35%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVASYEFTTLTCIPGVITYRGAKIQ

SEQ ID NO: 129823 - protein, 296 aa, Glycine max
  Coding DNA Sequence Number=SeqID_38138
  Homolog annotation: Hit_ID=A6FJQ2; Match level="QueryCoverage=12%, HitCoverage=84%, E-value=1e-10, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNAREEIGRRQWASLVTPMAKFDPDIVLEFYANAWPTEEGVRDMRSWVRGQWIPFDADAIGQLLDIRLGAGRGSGVRDFAWTAAGRWVRIMRTNMTTLTQVWMTLLLNNIQPSDHNSDLPLPKCQLVYAILTQMSIHVAQLIADAIYIFAGMAPTRHPLDPDKSNRALGFPALITGLCPSFGVPVAPSKAADAPPPHQAGPAGLFDMEQYLRHLVR

SEQ ID NO: 129824 - protein, 49 aa, Glycine max
  Coding DNA Sequence Number=SeqID_38139
MEHDHVVLRDAILPGKGLVTRAMSKRLQEDWARAAEEGPKVLMNLRVDF

SEQ ID NO: 129825 - protein, 341 aa, Glycine max
  Coding DNA Sequence Number=SeqID_38140
  Gene Ontology: Mol. function=helicase activity; Biological process =viral genome replication
  Homolog annotation: Hit_ID=Q9LX60; Match level="QueryCoverage=95%, HitCoverage=19%, E-value=3e-89, Identity=46%"; Hit description =Putative uncharacterized protein F4M19_60
MAICSHVGFPNLFITLTGNPNWPEIHRLLNPLNLKATDRPDIISKVFKLKYEQMLMDLTKNQMLGKVIAYMYTIEFQKRGLPHVHLFLFLHPDNKYPSSDEIDQIISAEIPSQQDDPELHSLVQNHMVHGPCGTSNPGSPCMKEGKCSRFYPKMFQPHTVLDADGFPVYRRRNNGHTIEKNGVIIDNRYIVPYNPRLLIKYQAHINVEWCNQSTSIKYLFKYINNGYDRVTAILIHDDNDSTHNGSTHNDEIKEYLDCRYICPCESTWRIFGFPIHGRKLVVERLHFHLLGQHSIVYEDHDDIDDVLSKPIRRKDVGTLGRKATPLANYYGSHQLQANYFT

SEQ ID NO: 129826 - protein, 210 aa, Glycine max
  Coding DNA Sequence Number=SeqID_38141
  Homolog annotation: Hit_ID=Q6WAY4; Match level="QueryCoverage=80%, HitCoverage=30%, E-value=4e-22, Identity=35%"; Hit description =Putative uncharacterized protein
MGTNQTWKRFYQVKIKGLDITSIKELGQLMGPLQMQAFRKAYGKILDLTIAEISTEAIVSLTQYYDLPLRCFTFGDFQLVPTVEEFEEILGCPLGGRKPYLFSGFLPSLSKIAVVVRDSARGLDRVKKTRNDIVGLPQKYLVDKARDMVNQEEWVPFMDVLALLIFGVVLFPNMDGSVDLATIDAFLAYHHSKESLVVAILADLFDTFNR

SEQ ID NO: 129827 - protein, 103 aa, Glycine max
  Coding DNA Sequence Number=SeqID_38142
MKLGLIWSDEGSRFSNLGYSIEHKSMIGDLIPIDLEINTTCRRRNQERIRNFLQDLEAAAIPVEEPQSFEASSSFPITGHSHLDRIKDQIMAEEPRRVTLEDY

SEQ ID NO: 129828 - protein, 310 aa, Glycine max
  Coding DNA Sequence Number=SeqID_38143
  Gene Ontology: Mol. function=6-phosphofructokinase activity; Cellular component=cytoplasm; Biological process=glycolysis
  Homolog annotation: Hit_ID=A6TAJ0; Match level="QueryCoverage=99%, HitCoverage=99%, E-value=1e-145, Identity=85%"; Hit description=6 -phosphofructokinase II
  Pfam annotation: Domain name=PfkB; Domain location=7-299; Score =219.3; E_value=8.9e-63; Accession=PF00294.15; Description=pfkB family carbohydrate kinase
  Pfam annotation: Domain name=Phos_pyr_kin; Domain location=122-293; Score=-151.5; E_value=0.045; Accession=PF08543.3; Description =Phosphomethylpyrimidine kinase
  Pfam module annotation: Pfam domain module=PfkB::Phos_pyr_kin; Domain location=7-299::122-293
MTKIYTLTLAPSLDSATLTPQIYPEGKLRCSAPVFEPGGGGINVARAITFLGGKATAIFPVGGATGEHLTALMADEQVPVETIETRDWTRQNLHVHVDASGEQYRFVMPGAALTEDEFRRLEEKVLAIEPGSLLVISGSLPPGISVEHLTQLVKNAQQHGLRCIIDSSGDALAAALDVGNIELVKPNQKELSALVNRELTQPDDVRTAAQELVRSGKARRVVVSLGPQGALAVDETSAVQVVPPPMKSQSTVGAGDSMVGAMTLKLAQGASLLEMARYGVAAGSAATINQGTRLCSLADTQKIVDYLSRD

SEQ ID NO: 129829 - protein, 135 aa, Glycine max
  Coding DNA Sequence Number=SeqID_38144
MKNWMQNSKRDVYLGAYLNGAHWQMVVILPKENLVVWFCSLHDRPSNYLKGIINMSVLFSNTFALALLSNINILMFLVFNSALKGLDDTPEPKSKVGTRWIVVKYFNDVRPLEAEKLKALHIQWAQYYLKVRNQT

SEQ ID NO: 129830 - protein, 18 aa, Glycine max
  Coding DNA Sequence Number=SeqID_38145
MTDRGYGGLDDATSGEGR

SEQ ID NO: 129831 - protein, 86 aa, Glycine max
  Coding DNA Sequence Number=SeqID_38146
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=88%, HitCoverage=28%, E-value=3e-33, Identity=73%"; Hit description =Photosystem II D2 protein (Photosystem Q(A) protein)
RIAMTIALGKFTKDENDLFDIMDDWLRRDRTTFVTSWYTHGLASSYLEGCNFLTAAVSTPANSLAHSLLSLWGPEAQGDLPVGVIR

SEQ ID NO: 129832 - protein, 98 aa, Glycine max
  Coding DNA Sequence Number=SeqID_38147
  Gene Ontology: Mol. function=tRNA (guanine-N1-)-methyltransferase activity; Cellular component=cytoplasm; Biological process=tRNA modification
  Homolog annotation: Hit_ID=A4AH24; Match level="QueryCoverage=75%, HitCoverage=32%, E-value=1e-31, Identity=85%"; Hit description=TRNA -(Guanine-N1)-methyltransferase
  Pfam annotation: Domain name=tRNA_m1G_MT; Domain location=1-87; Score= -22.5; E_value=0.0034; Accession=PF01746.12; Description=tRNA (Guanine-1)-methyltransferase
MRVLNGGEVATMAMIEAIGRLIPGVVGNPQSLVEESHEDGLLEYPSYTKPASWRDRSVPDVLLSGNHAAIAAWRREQQLDRTRTRRPDLLPEEQTPSS

SEQ ID NO: 129833 - protein, 196 aa, Glycine max
  Coding DNA Sequence Number=SeqID_38148
MLAIIAKYQEELGLAMAHEHRITDEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMMEAMLGMKQLMEKNAATAAAVSSAAEADPTPLATTHHPPSNIVGRGRDTLGHDGSPHLG

SEQ ID NO: 129834 - protein, 294 aa, Glycine max
  Coding DNA Sequence Number=SeqID_38149
  Gene Ontology: Mol. function=transcription factor activity; Cellular component=integral to membrane; Biological process=regulation of transcription, DNA-dependent
  Homolog annotation: Hit_ID=A9CI07; Match level="QueryCoverage=38%, HitCoverage=100%, E-value=2e-44, Identity=84%"; Hit description =Quaternary ammonium compound-resistance protein
  Pfam annotation: Domain name=DUF6; Domain location=145-287; Score =1.5; E_value=0.056; Accession=PF00892.11; Description=Integral membrane protein DUF6
  Pfam annotation: Domain name=IDEAL; Domain location=59-94; Score=7.5; E_value=0.068; Accession=PF08858.1; Description=IDEAL domain
  Pfam annotation: Domain name=Multi_Drug_Res; Domain location=186-278; Score=110.8; E_value=4.1e-30; Accession=PF00893.10; Description=Small Multidrug Resistance protein
  Pfam annotation: Domain name=TetR_N; Domain location=18-64; Score =74.4; E_value=3.8e-19; Accession=PF00440.14; Description=Bacterial regulatory proteins, tetR f
  Pfam module annotation: Pfam domain module=DUF6::IDEAL::Multi_Drug _Res::TetR_N; Domain location=145-287::59-94::186-278::18-64
MTNAHERKKQPEVVRRNLLDCAAKLAAEQGVAALSVQAVADAAGVTKGGLFHHFPSKQVLLEAVMTDLLAALDNEIDALISQDREAFGSFTRAYGFGSAMGSDLRFDGRRTVASTSCGTVGSRVVLSVIKKRMTGWYWRWCGWLPTASGLPICWRRRQSGWRQGGSEGPDDRPDEEGYVTMNTAVFTYGALVAAIVCEVIATSFLQQSQQFTRLVPTVLMALFYGAAFYLLSFTLRALPVGVAYAIWSGLGIVLISGIGYFVFRQTLDIAAVIGLGFIITGVVIVNVFSKTVGH

SEQ ID NO: 129835 - protein, 256 aa, Glycine max
  Coding DNA Sequence Number=SeqID_38150
  Gene Ontology: Mol. function=hydrolase activity, acting on carbon -nitrogen (but not peptide) bonds; Cellular component=chitosan layer of spore wall; Biological process=carbohydrate metabolic process
  Homolog annotation: Hit_ID=A9CI01; Match level="QueryCoverage=83%, HitCoverage=71%, E-value=1e-108, Identity=87%"; Hit description =Putative uncharacterized protein
  Pfam annotation: Domain name=Polysacc_deac_1; Domain location=72-185; Score=-1.3; E_value=0.0015; Accession=PF01522.12; Description =Polysaccharide deacetylase
ALRHPSGSGIFEVLFMSPKSVADWERWSGWLNDFRKLLPQSEGGESCILDNDKASESLLSEIVGAQPWPGQRNLNMESIYEYGSRAGFWRLWRMFTGLGVTTTVYGVTAAMARNPEAVAANEGSGHGYRWLEYKDFSEEEERKHIVEAVRLHTEVTGERPYGMYQGKPSDNTLRLVMEEGGFLYSSDSYADDLPYWVKGVKDEPFLIIPYTLETNDMRFATPQGFNSGDQFFTYLKDAFDVLYQEGMEGAPKMMSV

SEQ ID NO: 129836 - protein, 74 aa, Glycine max
  Coding DNA Sequence Number=SeqID_38151
MKKHSFEGKGEERKGSSGGGGEGGRELGGEGGRRRGVTRGRRGNEGEGEEKRQIIDMRVGREKLRCGMKLGLVL

SEQ ID NO: 129837 - protein, 187 aa, Glycine max
  Coding DNA Sequence Number=SeqID_38152
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=4e-17, Identity=29%"; Hit description= UPI00006A17C9 related cluster
  Subcellular localization annotation: CTP_CleavageSite=75; ConfidenceScore=5.05e-01
MLVRMICTRLFPAAQVKSCPGMHSSCVIASLSGCARTVGPPPISGGGPGIVKGNYCTLKMRTRSPLKVRACNPLKARMYSPLEVRACSPLKVRACSPLLARTCSPLKVKACSPLLARTCSPLKVRACSPTKVRTCSPLMARACSPLKVRTCGPLKVRACSPTKARASSPLKARTCSPLEVRACSPLM

SEQ ID NO: 129838 - protein, 342 aa, Glycine max
  Coding DNA Sequence Number=SeqID_38153
  Homolog annotation: Hit_ID=A5AKA6; Match level="QueryCoverage=73%, HitCoverage=28%, E-value=5e-13, Identity=22%"; Hit description =Putative uncharacterized protein
  Subcellular localization annotation: CTP_CleavageSite=21; ConfidenceScore=5.24e-01
MAEPSKKRKGVLTSSAVIGTRSHRSSKVHTTQIPPSISSPTLFSLDEQRIWYNSLFSSRSIIDPKFVDLAFFDDEVFDCFQAFQNSGLIQFISMKLPFYPELVKALYSNLEIQEDSLISEVYGIKMVIDQSLLFELTQLSSDGVPFEGTLDDEWKFDFSVSDARRMVCTNQADMTERLLSGSLAFECRIIHYLIVRILLPRSSNLAQVFLTDRQIDWAHLVRYHMHKALRSNTPLPYPHLITMFLQHFNVPLDSKPFVKVKRSFSIGANVVSSFGYRKERDGSWVKKDAPVQAAEDCSPSPHPQRDYSSSLMHNILDRLDGLHTFVGEYFDSLDSCIDAIDA

SEQ ID NO: 129839 - protein, 242 aa, Glycine max
  Coding DNA Sequence Number=SeqID_38154
MNTVEEDGPSRAKRLGEVVTSRRFIYQSLQVACMVSRGRDERDECLFHLGESHDMETCPAVEELLQRLMDYGQLEVSTGGREEPQICMQSEEKRVPLTPKALLISFTRKGTGSTPIYPWAAPKPMPFAYQSNKAVPWKYTPPASSERVATEVDSLSAKVTNITGLSGVTRSGRVFSSPHPAELPSKGKAPMVQEPTDIATPSKEVDPPVVRGAAKKERLQGKIVTLEEAHEFLCLIQQSEFK

SEQ ID NO: 129840 - protein, 97 aa, Glycine max
  Coding DNA Sequence Number=SeqID_38155
MPKSCGFGMTGPLDESISCFLIRVDPWVLVPITFRGLHILALRGLHVLAIRGLHVLAIRGLHALTSRGLPVLALRGLHALTLGTSYPHRRDDYTSSP

SEQ ID NO: 129841 - protein, 95 aa, Glycine max
  Coding DNA Sequence Number=SeqID_38156
MGFLGLKSDTARMRNLARLPIISPKTPYPQNLREKEVHPNLNFQSPSRSHALHDSKNALLSRFGAEMSTKGWSFVGVSMENGGEGKSNVRKRESF

SEQ ID NO: 129842 - protein, 180 aa, Glycine max
  Coding DNA Sequence Number=SeqID_38157
MKILFYVYQNPVEVPWEANQFGLPEIGAKFYITDADLAEIISGDKCLNIAILQLWTIFMNECGRSKADQSLYGLLEPQSIQNAKERRQQCQQYIETWVKESQRQLYLGAYLNQAHWQLFVLHPRENTVVWFCSLRKKPDINIKGAINRLMCKVEGFECGYYVMHWMWCIVTAGLKDDWHK

SEQ ID NO: 129843 - protein, 147 aa, Glycine max
  Coding DNA Sequence Number=SeqID_38158
MTSRDQVWSFCTLVSSRGGGPDDTRRYLMVIRTLLSSRGGGPDDKQRPKTKFGHSAPLYHPEAAGPMIRGDTLWLFAPFCHPEAAVPMTSRDQVWSFCTLVSSRGGGPDDTRRYLTVIRTLLSSRGGGPDDTRKYLSGYPYEHSFAI

SEQ ID NO: 129844 - protein, 49 aa, Glycine max
  Coding DNA Sequence Number=SeqID_38159
MQGSGNRLPGSVIDYQKTGFQEKAVPSGGSNPTRLGELGGYHLPIFSYK

SEQ ID NO: 129845 - protein, 32 aa, Glycine max
  Coding DNA Sequence Number=SeqID_38160
MELERLIKRLSDSGIDDAIGACPFEQLIAIGL

SEQ ID NO: 129846 - protein, 55 aa, Glycine max
  Coding DNA Sequence Number=SeqID_38161
MVIISLSTMGGATYAASKRQRRRGEGRHHPLGNKPRKKELHHQELPWIRSLKRML

SEQ ID NO: 129847 - protein, 70 aa, Glycine max
  Coding DNA Sequence Number=SeqID_38162
AVHVSSTFEFGAEFHDCLSADPQGNPPYSTFVRSTMNKKKEEVEMRVVITERAGWTKSVSYLCFPLISDE

SEQ ID NO: 129848 - protein, 181 aa, Glycine max
  Coding DNA Sequence Number=SeqID_38163
MQFQLQSQIQSQGVALPPELEVGPSAARISTKGSCVDPSATDLDTGDSDKCRLYIEENPSCLVALGRVYEGSTIIDNIHLLHDQVKGAVSPAKPTDRPDPEVMWDASLFRLLNSDFPLYIKHEDLSEIAHGGQCLSISVIQLWIMHLTETSMRLGIPMFMDYSSHSPSRDLGNRSLNQKVT

SEQ ID NO: 129849 - protein, 77 aa, Glycine max
  Coding DNA Sequence Number=SeqID_38164
MKVKVEKDEGNPCGVYPDLSSFIGSGVYPDLSSFIGSDVYPDLSSFTGSGVIQISVACIKRSAPHKIHIIWYQSFGS

SEQ ID NO: 129850 - protein, 101 aa, Glycine max
  Coding DNA Sequence Number=SeqID_38165
NLRRSEFLIGGYVGARASLLSTAPLFVTMTQELKFGLSTPFCQSDTVVSDGAQRQSWSFCTLVSSRGGGPDDTQEIPYDYPHPLCHPEATGPMTSSGDTNV

SEQ ID NO: 129851 - protein, 15 aa, Glycine max
  Coding DNA Sequence Number=SeqID_38166
QEVDSEISNQLIHSY

SEQ ID NO: 129852 - protein, 151 aa, Glycine max
  Coding DNA Sequence Number=SeqID_38167
  Subcellular localization annotation: CTP_CleavageSite=22; ConfidenceScore=5.44e-01
MATPPRSPPPPPPPPADLSTSPSTMKWTRKATWLRSLAIRQPGAGRLVVNVDPDTGKADDPHKKLRTYLEGYSGCAEKGTGHPKAKHCPHVLSRGGYEYLEQKLMAEKTKKKLEEAAQSGSTDGVIDPSSPIRCYVKWKMARTKKIGRGIL

SEQ ID NO: 129853 - protein, 268 aa, Glycine max
  Coding DNA Sequence Number=SeqID_38168
MAKFDPEIVIEFYANAWPTKEGVWDMRSWVRGHWVPFDADAISQFLGDPLILEEDQQCEFSQRRSQTDGFDEEAITQLLCIPGQDFTQTAAGRRVRITCTSMTTLTQIWMTLLLSNVLPSDHNSDLPLPKCQLVYAILTQMSVHVAQVIADAIYLFAGTAPTRHPLDPEKSNKALGFSALIAGLYQSYGVPVTPSKVIRPSITRAFIEKYCTPRQAQGDAHQVTHINRRHLGRPIRMGHWAWSGIYSIWFASRRPTTVDRCRYMSVST

SEQ ID NO: 129854 - protein, 177 aa, Glycine max
  Coding DNA Sequence Number=SeqID_38169
  Pfam annotation: Domain name=Transposase_23; Domain location=30-88; Score=5.1; E_value=0.00033; Accession=PF03017.5; Description =TNP1ENSPM transposase
  Subcellular localization annotation: CTP_CleavageSite=24; ConfidenceScore=5.17e-01
MQSQGLAVPPEPLVGPGPSGPRVRLVHRSRSCPPGCHGVRVYEGSTLVHNTPLLPGQVKVSVDKVKDADAAVPVPTVEVSLVGQALHTFLAWPTHQIKSLSNQVRWDATVFGVVNPDFPLYIKNEDLSEIAHDGQCLSISVLQLWILHLTATCMRAGILISMIPRASVHSEVWAIAV

SEQ ID NO: 129855 - protein, 119 aa, Glycine max
  Coding DNA Sequence Number=SeqID_38170
VVGCTICGGSHESGCCIPNEEQVTHEVNYMGNQPRNNFNAGGFSGFQHGQQCNQQHGQWRNHPGNQFNRDHGGSSIRSQQQGPSLYDHTTKLEETLAQFMQVSMSNQKSTESTIKNLEV

SEQ ID NO: 129856 - protein, 66 aa, Glycine max
  Coding DNA Sequence Number=SeqID_38171
MSVRSWYCVVEAKLHDDDKGDDKKLNDQSKNNSRRKFRVKNQDSRFKISRIKIKIQDSRFKNQEKA

SEQ ID NO: 129857 - protein, 66 aa, Glycine max
  Coding DNA Sequence Number=SeqID_38172
  Subcellular localization annotation: CTP_CleavageSite=14; ConfidenceScore=5.26e-01
YVGFSSSHTSKSSVGGSVGSTEGFSAVLRIVWDNVGVKGVVSGRFQVGGEREERFQEGRQREEGGQ

SEQ ID NO: 129858 - protein, 157 aa, Glycine max
  Coding DNA Sequence Number=SeqID_38173
  Gene Ontology: Mol. function=nucleic acid binding; Biological process= DNA integration
  Homolog annotation: Hit_ID=A5AEB7; Match level="QueryCoverage=71%, HitCoverage=11%, E-value=4e-36, Identity=55%"; Hit description =Putative uncharacterized protein
  Pfam annotation: Domain name=zf-CCHC; Domain location=137-154; Score =25.1; E_value=0.00024; Accession=PF00098.14; Description=Zinc knuckle
NQSANISDIKCDIPELKGDNYKVWREKILLRLGWMDIDYAIRKDEPPGITETSTPDVADLYEKWERSNRLSVMFIKTNISASICSFIDQYEKLQGIRGVRDHIMRMRDIVAQLKALEGINPKNKGKIPAQPVIKEESKCFFCKKKGHMKKDCLKFKS

SEQ ID NO: 129859 - protein, 68 aa, Glycine max
  Coding DNA Sequence Number=SeqID_38174
VPTNPKRIKTIPEWSTPPTPLIELVRNHVPSWEDVSGGIPEYQEPRDLRSNPFQGGGDDAILPPKGIG

SEQ ID NO: 129860 - protein, 181 aa, Glycine max
  Coding DNA Sequence Number=SeqID_38175
  Homolog annotation: Hit_ID=Q6Z8F0; Match level="QueryCoverage=27%, HitCoverage=44%, E-value=1e-12, Identity=71%"; Hit description =Putative uncharacterized protein P0459B01.18
PRGATGSGHDGALTLSGAPFQGTWARSATEDASPDYNSDAEGDRFSWWAFPGLVGSVRARKGSSMGPELTGSHVIGLERGSSTILSRRSRAMNPDFNQPRGGCSREVSIHPAQQHCYMFALGKRCVTPRQACPRPNGFRAQLCVQRLDGSRDSAIHTKYRISLRSFIDARAEISVAESLLY

SEQ ID NO: 129861 - protein, 104 aa, Glycine max
  Coding DNA Sequence Number=SeqID_38176
MTAVSPTKPPPKPDPEVDDPLYLMTLTIPELFLRPYQVTWDATVFGVFNPDFQLYIKHKDLSEIAHGGISLKHVCERGILISMDSSSHSPFRGLSNRNLSLKVT

SEQ ID NO: 129862 - protein, 88 aa, Glycine max
  Coding DNA Sequence Number=SeqID_38177
MAYTHIPDSTSDSPQISASSYQLDLAPYASEPYNAQWNAPGLLRDKHTLRSSRILGEMEVDEPWLGLWLPLNYQVVFVIGSAVDRLCG

SEQ ID NO: 129863 - protein, 118 aa, Glycine max
  Coding DNA Sequence Number=SeqID_38178
  Homolog annotation: Hit_ID=Q84VI1; Match level="QueryCoverage=55%, HitCoverage=9%, E-value=1e-29, Identity=93%"; Hit description =Envelope-like protein
MSIKKPTDGVVDIAVSEHQIAKEITAKRVQHWPKKGKLSAGKLSVKYAILHRIGAANWVPTNYTSTVATGDTCPRHCLDIMKAAASGAVSKDALIAELKDTCKCWKQPSKPPQKRRWS

SEQ ID NO: 129864 - protein, 228 aa, Glycine max
  Coding DNA Sequence Number=SeqID_38179
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP6; Match level="QueryCoverage=76%, HitCoverage=36%, E-value=1e-89, Identity=98%"; Hit description=ATP synthase subunit beta
  Pfam annotation: Domain name=ATP-synt_DE; Domain location=180-227; Score=63.3; E_value=8e-16; Accession=PF00401.11; Description=ATP synthase, DeltaEpsilon chain, long alpha-helix domain
  Pfam annotation: Domain name=ATP-synt_ab; Domain location=1-67; Score= -86.6; E_value=0.05; Accession=PF00006.16; Description=ATP synthase alphabeta family, nucleotide-binding domain
  Pfam annotation: Domain name=ATP-synt_ab_C; Domain location=80-192; Score=157.5; E_value=3.6e-44; Accession=PF00306.18; Description=ATP synthase alphabeta chain, C terminal domain
  Pfam module annotation: Pfam domain module=ATP-synt_DE::ATP-synt _ab::ATP-synt_ab_C; Domain location=180-227::1-67::80-192
MGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVVNDAEKGSDIDPQEAQQTLEIAEANLNKAEGKRQTIEANLALRRARTRVEAINVIS

SEQ ID NO: 129865 - protein, 93 aa, Glycine max
  Coding DNA Sequence Number=SeqID_38180
MRKLEKAACQNSGTVVDSIGNVWSAWANSILEGRSRLLLLLLRAGPSEVRVIPPSRVISVAGEAAQLLQVAAWKGKGLYGGQQREHKPQTFAT

SEQ ID NO: 129866 - protein, 129 aa, Glycine max
  Coding DNA Sequence Number=SeqID_38181
MCKFKNEHAFPPYGLPLNYTPPNVAYTPNEISITPLPYSLRANNLNLIMHISLMEETHEIPHHNLADFEPWLGYATEGQAVGGIPLQNTLEGPQFRPQPQPSRSTVVKNPHDYGRNGKVGSSRGKAQGH

SEQ ID NO: 129867 - protein, 62 aa, Glycine max
  Coding DNA Sequence Number=SeqID_38182
MGLAVFAPPSHLWLHFAFIFDTPTHSNKDGPRPMVHSEAMGHATLPPFPCYSCLNICPPSAR

SEQ ID NO: 129868 - protein, 81 aa, Glycine max
  Coding DNA Sequence Number=SeqID_38183
MYRKRGLLYRWHEHRGVARLCLIFSKASWQSLFHRTAWFLRNSLKMSSQGRDIFLGTLISIPWVDWHNNPKALPLYPFWVT

SEQ ID NO: 129869 - protein, 169 aa, Glycine max
  Coding DNA Sequence Number=SeqID_38184
LGYPMRGVPSDESIMPFIARGFSDHNARDKELRGSSNGIIGGYHKWLRVRTQGLDWLPNLKTVRDNEVKASEECDEVQALKAKLERARVVKEKFKAAIVSSSSEDVKGIIMGQRHDLEGRAKACLSETEGNMWAIIDECKEKLNLATTHEQRLEDEYAKISAEREARER

SEQ ID NO: 129870 - protein, 102 aa, Glycine max
  Coding DNA Sequence Number=SeqID_38185
MECLEGAWETLEGNARCRFRGTIRFTATSLVHLDEPARTLQRTVEWILPTPTPYRLVELVQGDEDPLPEVDSPEDVMSASEADSTEDSGPLEEMAISGGSSS

SEQ ID NO: 129871 - protein, 57 aa, Glycine max
  Coding DNA Sequence Number=SeqID_38186
TGKNRPDYTLVPRVQWVHLTVPSSVGTEITNIHSSLGSVGALSHGPWGNLIGIGCIV

SEQ ID NO: 129872 - protein, 19 aa, Glycine max
  Coding DNA Sequence Number=SeqID_38187
MGTDRGYGGLDDATSGEGR

SEQ ID NO: 129873 - protein, 38 aa, Glycine max
  Coding DNA Sequence Number=SeqID_38188
SSYGACLPWIFFINGFLCFLRSNCSEMEKEKDEWRCHF

SEQ ID NO: 129874 - protein, 41 aa, Glycine max
  Coding DNA Sequence Number=SeqID_38189
MARACSPLKVRTCSPLKARACSPLKVRTCSPLKAWACRPLK

SEQ ID NO: 129875 - protein, 224 aa, Glycine max
  Coding DNA Sequence Number=SeqID_38190
METCLEVEELLQRMIDQGRLEVGITGKEEQHICMQSTEGSGVAKPKPLVIYFTKSAASQKPGHPLMAKPVPFPYQNSHAVPWRYTPPGKKEEEVTDVSSLSAKVTNITGLSGVTRSGRVFAPPDLPVQPADVKGKGKVVEEQDGEAPHASSKDMPAKGPPEKRDGRKEVSLEEASEFLRIIQQSEFKGYGAGNSDTNARCRTGCHDITLQNMQIISECMNRLNK

SEQ ID NO: 129876 - protein, 93 aa, Glycine max
  Coding DNA Sequence Number=SeqID_38191
MAKFDPEVVLEFYAKCLAHRGGSARHAFMGMQPTRHPLDLDKSNRALGFPALITGLCQSFGVPVTPSKVIRPLITRAFIEKYCTPRQAQGDAH

SEQ ID NO: 129877 - protein, 48 aa, Glycine max
  Coding DNA Sequence Number=SeqID_38192
MRGVVILAQTKYQNSQRLDCLREKERVLEEERKNEIVRQRRLRSQSQN

SEQ ID NO: 129878 - protein, 68 aa, Glycine max
  Coding DNA Sequence Number=SeqID_38193
LSLSLQSQGFTSFPCPTPDQFRAEVAWPRDWPEAPAEAPVEAPDEANEAREDEEMTDLLDFLGGSGAT

SEQ ID NO: 129879 - protein, 199 aa, Glycine max
  Coding DNA Sequence Number=SeqID_38194
MLATGNRLPESKTLWLRTDHREIEAALCIPGRGFILNVEGHPGRILRKDLTTLAQVSSVLSYSNLAPTSHTSDLTVDRASLIFGLVSHMDMNFDALISRQMTSIAQSNSCKLGFPALIIALCRARVVVSYSLTFECLSPAINLAYIRKNFWNIDDLTVAFRGARRARARPADIPSSFSASAPTPTSTSTAPSVPAHVDS

SEQ ID NO: 129880 - protein, 100 aa, Glycine max
  Coding DNA Sequence Number=SeqID_38195
MAAQLIHDRVEMECLEGAWGTLEGNTRCRFRGTIRFTATSLVHPDEPARTLQRTVEWILPTPTPYRLVARGRWRSASASEADSTEDSGPGEMVISGGSSS

SEQ ID NO: 129881 - protein, 64 aa, Glycine max
  Coding DNA Sequence Number=SeqID_38196
  Subcellular localization annotation: CTP_CleavageSite=46; ConfidenceScore=5.28e-01
MGGANSTQAHLGPPEAKALPKRFRNVFREESRKGFNRSSTFFIVLRSSTGKYLEPSFSIHSMHP

SEQ ID NO: 129882 - protein, 107 aa, Glycine max
  Coding DNA Sequence Number=SeqID_38197
MPISPYRCIRWDRTHKMPSGPEEVQQGPGVSSSGIAPARHLVNPKKSKRVLRFPALITGLCNSTECPSSPARSSGLLLTELSSRSIAPPDRQRARHHNSIGMAGSGQ

SEQ ID NO: 129883 - protein, 77 aa, Glycine max
  Coding DNA Sequence Number=SeqID_38198
MSLEQTNQWLAPTFQWKQRLLGFTSDSPQISARPHQLDFAPYALRSYSAQWNVPELLHDMHMLCSSRILGKMEVEET

SEQ ID NO: 129884 - protein, 83 aa, Glycine max
  Coding DNA Sequence Number=SeqID_38199
TLVSIVTPLRLEFIPQVKELLDEGVPMNPKRIKVIPEWPTPPTPLIELVRNHVLSWEDAQEMGVEGRSPEYEEPRDLRSNPFQ

SEQ ID NO: 129885 - protein, 139 aa, Glycine max
  Coding DNA Sequence Number=SeqID_38200
  Gene Ontology: Mol. function=endonuclease activity
  Homolog annotation: Hit_ID=Q9AY32; Match level="QueryCoverage=43%, HitCoverage=90%, E-value=3e-25, Identity=96%"; Hit description=RRNA intron-encoded homing endonuclease
  Subcellular localization annotation: CTP_CleavageSite=47; ConfidenceScore=5.40e-01
GKSGASSRVKKARSWTLGWVDRSASGVHRSARPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 129886 - protein, 146 aa, Glycine max
  Coding DNA Sequence Number=SeqID_38201
NTKTLLSLTSYPELRRSEFLIGGYVGARASLLSTTPPFVVMTQELANVVICALSGDVSIFRWRLFQVSQVIQNYSCPMHAETKFGHSAPFVIQGGRKPVVTQEKFTVISALAIDTVCHTIESRKTGGNTRVVIRINILLLSVRQNA

SEQ ID NO: 129887 - protein, 83 aa, Glycine max
  Coding DNA Sequence Number=SeqID_38202
MKLGYDTTLWREGNTELTGASSMGGKCAESPPTFIRGKRRKKLKKVWSTNFKCERFGSCFYAWGRVFPSLLRILNCDDEVRPM

SEQ ID NO: 129888 - protein, 44 aa, Glycine max
  Coding DNA Sequence Number=SeqID_38203
MHGDPPVEYWNDLKSALRKRHIPSYYERELMYKLQRLRQGLHNV

SEQ ID NO: 129889 - protein, 95 aa, Glycine max
  Coding DNA Sequence Number=SeqID_38204
  Subcellular localization annotation: CTP_CleavageSite=58; ConfidenceScore=5.18e-01
MPFIATRVNWTSSYPLVTSGSGLSFTGTPHGDVFGCRMRLDHMTTKQNDTKQIELNFNSASDKTYQIPQETWTNITKSSCEVELTQIRLKNMQNG

SEQ ID NO: 129890 - protein, 178 aa, Glycine max
  Coding DNA Sequence Number=SeqID_38205
MKRWWAAHPQSFADLVFANERINVGPKRGKFDHPTRTTEKTGANKEGEDEGETHAVTAIPVRPSFPPTQQYLYSANNKLSPYPPPSYPQRPSLNLPQSLSTALPMTNTTFSTNQKHQPRTITLAKVHQPPFLREYDSNATCACHGEAPGRSIEHGRALKRKVQCLIDAGWLKFEENCV

SEQ ID NO: 129891 - protein, 225 aa, Glycine max
  Coding DNA Sequence Number=SeqID_38206
  Gene Ontology: Mol. function=helicase activity; Biological process =viral genome replication
  Homolog annotation: Hit_ID=Q9LTU4; Match level="QueryCoverage=61%, HitCoverage=9%, E-value=2e-37, Identity=52%"; Hit description =Helicase-like protein
MLDENNAHAKSFRMAKDRLTDTQVHNVRLKLIVGQEKDGRTYNVPSVPEVAALIADPMKVKLCCILENYSSNLLLKGYTMIESERLSYVRNNQKKLRVDKFYSLQQSSEAGNTEGLGQGKRIILPSTFVGSPRYMDQLYFDGIAICSHVGFPNLFITFTCNPNWLEIHRLLTPLNLTPIDRPEIISRIFKLKYEQMLLDLTKNHLLGKVVACKLMLIPICSATNR

SEQ ID NO: 129892 - protein, 61 aa, Glycine max
  Coding DNA Sequence Number=SeqID_38207
MKYFTQFGVLLSPLALKVVFPLLLDSNSSNDGTNPPFQFPIWKLTSKETKRQAITKDQKMK

SEQ ID NO: 129893 - protein, 302 aa, Glycine max
  Coding DNA Sequence Number=SeqID_38208
RARRRPRRSGVPGRHGGWSGTGWRAGRLRRQGPLLRGGYGLCAGGDGLPGYIEGGRTGAHRSRRADLQEHRRRRALRGRQPDHGRGDGAGHVLGPARRRGGDAAGVPARNPAPRPGRPGHPARDAGARFGVRGPVAGPPPAAPQCRPRTAVRGGRFRPVRDRLRPVAALLAVGDDPAVLRGLRWRLGGDPIDHPAVGHAGRNARTGVVNQRHIHQFVQRAGRVLRRHDGQAARPGADRGKGWVRGAERGRDHRVEEPDITEIESSRPAVTLLTADSAAPGVWLGPLLSLDDWACHFLFAKRK

SEQ ID NO: 129894 - protein, 156 aa, Glycine max
  Coding DNA Sequence Number=SeqID_38209
MVHEQRPMWSSAPFPEMSAFSDGDFLSLTSYPELRRSEFLIGGYAAGPMTSRDQVWSFCTHDTRRYLMVIRTLLSSRGGGPDDKQRPKTKFGHSAPMIRGDTLWLFAPFCHPEAVGPMTSRDQVWSFCTHDTRRYLMVIRTLLSSRGGGPDDKQRP

SEQ ID NO: 129895 - protein, 58 aa, Glycine max
  Coding DNA Sequence Number=SeqID_38210
DDFVAIADRLDMLLNLRILTEGTKVYTVVEECVGIARCYIGQPIVGHKSKQRWRTNDH

SEQ ID NO: 129896 - protein, 57 aa, Glycine max
  Coding DNA Sequence Number=SeqID_38211
MSVKNLVGRLGVHDKDEPHTSKSSLKEHSNRVTPKDYTSKSPSGPLPPDSSSTQKTF

SEQ ID NO: 129897 - protein, 60 aa, Glycine max
  Coding DNA Sequence Number=SeqID_38212
MPHRDNLLKVFVTMLNEMEEVDIFVPHPLTKMICYSTFTLEWMQAIGLFAQVTSALSVDF

SEQ ID NO: 129898 - protein, 237 aa, Glycine max
  Coding DNA Sequence Number=SeqID_38213
MVIDQSLFYELTQLSSEGVPFDGTLIDDWKYEFSVHDARRLVCTNQVDMTGRLLASSLAFESRILHYLIVRILLPRSSNLAQVSEEDLIVMWAFHEGRQIDWAHLVGYRMHKALRLNAPLPYPHLVTLFPQHFNVPLDYELYVPIKRSFLIGVVVIASFGYQKEHDGSWVKKDSSLLQNFLDRFDGLLTFVGERFDTLELQVDMCFNEMDSRITKVEEDVSYIRTSFDLPPPPPPSF

SEQ ID NO: 129899 - protein, 79 aa, Glycine max
  Coding DNA Sequence Number=SeqID_38214
MDEFIELMKEHNLETLGCLSAHLAVAMTNFARCFQIIIVTRALWNNMEARPKIDTLTPKFVSPRYQDWVHTIKTPLKTP

SEQ ID NO: 129900 - protein, 80 aa, Glycine max
  Coding DNA Sequence Number=SeqID_38215
MNHHSSNVNGKGTSHKDPLSRILDELSSLKLWKEKLERKEKGKEREGIGHILDLTLIGEKRKESLKRLTLTSHTSMGRTM

SEQ ID NO: 129901 - protein, 157 aa, Glycine max
  Coding DNA Sequence Number=SeqID_38216
  Homolog annotation: Hit_ID=UPI00016621D1; Match level="QueryCoverage =65%, HitCoverage=36%, E-value=3e-07, Identity=34%"; Hit description =UPI00016621D1 related cluster
GLHVLAIRGLHVLTFRGLHVLAIRGLHVLTFKGLHALTFRGLHIHTFRGLRVLTFRGLHILAIRGLHVLAIRGLHALTLRGLHVLAIRGLHALTFRELRVLTFILGPPPDIGGRPTVRAQPEREAITQLLCIPRQDFTRAAAKRRVWIMRTNMTTLK

SEQ ID NO: 129902 - protein, 74 aa, Glycine max
  Coding DNA Sequence Number=SeqID_38217
LQGARSPRQGHVIIGIAPAGHPVDPKKSNRVLELSSSNYGQAQGETPQQPGDGRQRATDAPPSPLEFTSAHPQK

SEQ ID NO: 129903 - protein, 289 aa, Glycine max
  Coding DNA Sequence Number=SeqID_38218
MAKFDPDIVLEFYANAWPTEEGVRDMRSWVRGQWIPFDVDAIDQLLGYPLVLEEGQECEYCQRRNWSDGFDEEAIAQLLCIPGQDFARTAAGRRVRIMRINMTTLTQIWMTLLLSNIKPSDHNSDLPLPKCQLVYAILTRMSIHVAQLIADAIYIFAGMAPTRHPLDPDKSNRALGFPALITGLCQSFGVPVAPSKVIRPSITRAFIEKYCTQRQAQGDAPQAVDAPPPHQAGPAGSFDTEQAEVTWPGDWPEAQAGEAPTEAPDEADEAHEDEEMTDLLDFLGGSGAT

SEQ ID NO: 129904 - protein, 59 aa, Glycine max
  Coding DNA Sequence Number=SeqID_38219
MGGAMTLLDIPGGGNRFFMRKKYLYMGACHSVWNSLETQADHHGGELLVHDRVTSTVTA

SEQ ID NO: 129905 - protein, 155 aa, Glycine max
  Coding DNA Sequence Number=SeqID_38220
MAQPPPRERTLREMAAPDFTYESLCIQYPDEDVPYVLKTGLIHLLPKFHGLAGFSSFSGGSGKGLVVLDNSVERACMRLSNMERSMIDAASGGALGDMTPAEARNLIEKMASNSQQFSARNDAIVIRGVHEVATNPSASSETKKLEGKLDALVNL

SEQ ID NO: 129906 - protein, 86 aa, Glycine max
  Coding DNA Sequence Number=SeqID_38221
MKTKGMQFVEQNVMLKYDNGQMQERYVHYDAMKRCLCVATYPSAGGRRETRGMRVPRKEYARSRHQRLFEENVGKTGKDAIYELFK

SEQ ID NO: 129907 - protein, 1533 aa, Glycine max
  Coding DNA Sequence Number=SeqID_38222
  Gene Ontology: Mol. function=carbonate dehydratase activity; Cellular component=extracellular region; Biological process=one-carbon compound metabolic process
  Homolog annotation: Hit_ID=A7NZL7; Match level="QueryCoverage=24%, HitCoverage=96%, E-value=4e-55, Identity=39%"; Hit description =Chromosome chr6 scaffold_3, whole genome shotgun sequence
MRHSQGFDFVGKWDNVKSMVENCLEYTMNNYQICTEPVSILQAFQLSLCWTAASLLNHKLDFEASLMLAKQNLNFDCKKEVVDEINSRLWTLKENFLKLTGNSNVVSYPKASESSNGVFSYIEETTEVELVKNDNSKNIKNFQKRKSQWNKLLLMQQEEKQKLKKDIENENDEFWRRYQIHRAAIQLCSPNDVTKEQKLKVFNTEYMKIIRELERQHEIRLKDLEAKQLKTRLTFPETLALDELLNPVASNEPGTKVDQTCDQAQHSNAPKALVSDHVAEGEGFNDMVEVITRIGTGIGLSEAPDANASVVVPCSSALELQTPLVKHADANNKCNNIAENEYDSQGNIFSKHSNSREQCSDGAISPPEEGVCVNYSCESHDFGQDAITRVLPSCNEEICDGKTLDVQCSDGAISSPEEGECVNYCFESHDFGQDAITRVLPSCNEEICDGKTLDVQCSDGAISSPEEGECVNYSCESHDFGQDAITRVLPSSNEDICDGKTLDVPSGEVAPTVCNTTSSNGDHVEISSRQGELDGTILSNPVCGSSIEVEANGSNDGAKNMAPVNSQSSEEDIPSVNTMSTSNCENAAQIHEADDNNGSKNAETLNSSLSDERISSLNSKSPQGHVRNENAMCMQNCENFAQSLEDDDSNGSNSVIPNPPLIDERNADRTIILNRDAHVGMVETVNFTPSTEQISGGAVDEDGLPNHISEKSVLDSVLSRPREAYSPRGSSDADCIILSNQPSFEKQNHDGVSSSIPVGQIPLEVSNTRHERISVNVLDGEEAVGRPATVNCTDYPENVIALNSSSMDQISNGGPLLDGDLSPGPCTSSPSNGRTLPDEQIPVLEPENSNKVAECQLTDSVVVNKNAISDQLEGVCRTMTENSLSLETPVSRPVDDLMEPLEQVHSLSSVESPPDPDTAREMKNTLVSSPVDIVPANQSINDSLVMEPPEQEAQLPSAGFLSSNQDLSNLPLVTGTEDQPSNEDDLPNHIPEMPIEIQNQVVQHASNSDRQEGVCRTMTENSLSLETPVSRPVDDLMVPLEQVQPLSSVESPPDRDTAREMQNILVSSSVDIVPANQSMNDSLVMEPPEQEGQLPSAGILSSNQDLANLPLVTGTEDQPSNEDGLPNHIPETSIEIQNQAVVQCASNVELDSCSRQVVHPASNMDLDSLLPGGVRLQSSDTRNLSTLTEINNHPIQPASQSASRIIRHLCLDPLTNELERLRILTDQNMKEYENKKLQLKYDFEKELEELYRKYDIKRKEVEVEFQNIRKNLDTQHNIVLVNKILAEAFRAKSMDLKVSGASRMQQDASVPQQLFQLASQQNATRPCLVGPSSCGPPADSMQSSYATTTSQTMVSPIQATYSTPGTFSSVSPRVPHINSLSSPLGNAQTAGEIRAPAPHLQPYRPPTSIPASSPCTVPHGRPSQPAPGNIPVTSPPFSHRTPWSMPANFQSVPHRGHWLVSTGGLSTPNLSSVNSCADANSQPGINLPNVRPHMPDLPTLMNLNLSKFSGNSTPANSAHPATSPDVVCLSDDE

SEQ ID NO: 129908 - protein, 365 aa, Glycine max
  Coding DNA Sequence Number=SeqID_38223
  Gene Ontology: Mol. function=fatty-acyl-CoA synthase activity; Cellular component=peroxisome; Biological process=jasmonic acid biosynthetic process
  Homolog annotation: Hit_ID=A5BUH4; Match level="QueryCoverage=98%, HitCoverage=59%, E-value=1e-113, Identity=55%"; Hit description =Putative uncharacterized protein
  Pfam annotation: Domain name=AMP-binding; Domain location=2-281; Score=34.2; E_value=9.8e-09; Accession=PF00501.19; Description=AMP -binding enzyme
MEMAGPVTQGDTAALLYSSGTTGLSKGVVLTHRNFIAASVMIGMDDDIAGEQNDVYLCVLPMFHAFGLAVVTYAALQRGSAVVVMGRFELKALLRAVEKHWVTKLWLVPPILLALAKQSVGYGMTETCGIVSLENPRVGVRHTGSTGTLGSGVEAQIVSVDTQKPLPPRQLGEIWVRGPNMMQVDQWILSQNSCITSWTGNCSCKIMFEAKDLHWNACYNTVNQACTKTISHGDLGYFDEDGQLYVVDRIKELIKYKGFQVAPAELEGLLVSHPEILEAVVVPNSHLSYFLCNRYPDDEAGEVPIAYVVRSPNSSLTEEEIQKFIAKQVAPFKKLQRVTFINSVPKTASGKILRRELTAKARSKI

SEQ ID NO: 129909 - protein, 429 aa, Glycine max
  Coding DNA Sequence Number=SeqID_38224
  Gene Ontology: Mol. function=serine carboxypeptidase activity; Cellular component=vacuole; Biological process=proteolysis
  Homolog annotation: Hit_ID=Q2Z1Y2; Match level="QueryCoverage=83%, HitCoverage=86%, E-value=3e-95, Identity=45%"; Hit description =Serine carboxypeptidase
  Pfam annotation: Domain name=Peptidase_S10; Domain location=90-401; Score=57.6; E_value=4.3e-18; Accession=PF00450.13; Description =Serine carboxypeptidase
  Subcellular localization annotation: CTP_CleavageSite=32; ConfidenceScore=5.61e-01
HSSCHKRKTWASSPSISKVSLSLVLLVFVSVSSSYATPRFTHGRTYTPQSQAEKLIRSLNLFPKDSVNIIKGDLDSFVPGKIVESKFSFFGDSGNSIQDLRHHAGYYSLPHSKAARMFYFFFESRKSKDDPVVIWLTGGPGCGSELALFYENGFSYSSDDTDIRHDEAGVSNDLYDFLQGFAIGNGLTNPAIQYPAYPDFALDNGIITKAAYDNISKLIPGCEQAAKTCVQFTYCIVLIYEVRTLQLFAVSGVRHASVSVSDTDTTPVLIHKVQYYDIKKCEGELCYDFSNVETLLNQQKVKSALGVRDDLQYVLCSTTMHNALLQDWMTNLEVGIPALLEDGIKLLVYVGDRRRSHGIGLWSGQKAFGKSPTAKFVVDGVEAGSLNSYGPLSFPKVHGAGALGPYGSTKSCTSDVEKLDGREIGYACC

SEQ ID NO: 129910 - protein, 54 aa, Glycine max
  Coding DNA Sequence Number=SeqID_38225
MCVRQRLLVRSHGKRLKGRNGSEMSWFNTISDNGKFYRDNILAFDVRTVWIELV

SEQ ID NO: 129911 - protein, 367 aa, Glycine max
  Coding DNA Sequence Number=SeqID_38226
  Homolog annotation: Hit_ID=A7PQQ9; Match level="QueryCoverage=91%, HitCoverage=73%, E-value=3e-90, Identity=49%"; Hit description =Chromosome chr6 scaffold_25, whole genome shotgun sequence
MDTNDPLDFEVEDDLLKCPPINNKRKKIIGLDDLLKDHYIEQDKLLEKRNKQKKKAKTKAKKIESSYDDEDSKEARLTRIVEKSFGEEQEIPPWGVKVFGDKKAFPPLESPDLGSCNLLQSFLNNKLNSMVELTADKGDIFLEGLLVNGWLSKLAYLCGHVEKTVAIWAFNTMLYSSKEELCNSSSDFWCAILSSEKEVDQAPVKVDWFPEYMDIRRALDIYGFLFKFSSSAKPNNLDSDIEGPPQNIRAWIRCVTACCLIRSKKAIFSTVEAEEIVEIIICLFLDRQFQGLLVLLNDCMEAIVNYFTDQEWCSSCENIAKFIACSVSCDLSVMRRKLGLSNTWVKEQRLVFLISVLYNMDTGAEID

SEQ ID NO: 129912 - protein, 775 aa, Glycine max
  Coding DNA Sequence Number=SeqID_38227
  Gene Ontology: Mol. function=DNA ligase (ATP) activity; Cellular component=nucleus; Biological process=DNA recombination
  Homolog annotation: Hit_ID=Q2PEZ1; Match level="QueryCoverage=90%, HitCoverage=96%, E-value=0.0, Identity=73%"; Hit description =Putative DNA ligase
  Pfam annotation: Domain name=DNA_ligase_A_C; Domain location=627-692; Score=93.9; E_value=5.2e-25; Accession=PF04679.6; Description=ATP dependent DNA ligase C terminal region
  Pfam annotation: Domain name=DNA_ligase_A_M; Domain location=363-602; Score=246.9; E_value=4.4e-71; Accession=PF01068.12; Description=ATP dependent DNA ligase domain
  Pfam annotation: Domain name=DNA_ligase_A_N; Domain location=120-298; Score=301.1; E_value=2.1e-87; Accession=PF04675.5; Description=DNA ligase N terminus
  Pfam module annotation: Pfam domain module=DNA_ligase_A_C::DNA_ligase_ A_M::DNA_ligase_A_N; Domain location=627-692::363-602::120-298
  Subcellular localization annotation: CTP_CleavageSite=80; ConfidenceScore=5.82e-01
MSKPPSAFDALMSGARAAAAAKKKSQSLSQSSPSSPKKRKTPPSSSSQNPSDLKPPSPPKTVTPQEGAVKPEPLKVRHVSSSSFSQEKTAELKKQAPQLKKKPSDFDPASISAWEKGQPVPFLFLCLAFDMISQESGRIVITDIVCNLLRTVMYSTPEDLVKVVYLSANRIAPAHEGMELGIGDASIVKALAEAYGRTEVWIKTQYQKKGDLGLVAKESRSSQPMMFKPEALTITKVFNTFRLIAKESGKESQEKKKNHIKALLVAATDCEPQYLIRLLQTKLRIGYAEKTLLAALGQAAVYTEEHSKPPPDIQSPLEEASEIVKQVYSVLPDYDKIISALLTEGLWMLPKKCNFTPGVPIGPMLSKATKGVSEILNKFQDVEFTCEYKYDGERAQNGSVEIYSRNAERNTGKFPDVVAAVSRLKKPTVSSFILDCEIVAYDRSTQKIRSFQMLSTRARKNVEIEDITVGVCIFAFDLLYLNGQALLQENLRVRREAEFRSYISEMVNCMRLNWKGDCKIVGFGPTYCVVRATPRWHLYASFEEEPGFLQFATTITSNDVEEIQNFLDQAVGASCEGLIIKTLNEDATYEPSKRSLNWLKLKKDYMDSIGDSLDLVPIAAFHGRGKRTGVYGAFLLACYDNDNEEFQSICKIGTGFSEAVLEERSSSLRSKVIPKPKAYYRFGETINPDVWFEASEVWEVKAADLTISPVHRAAVGIVDPNKGISLRFPRLLRVRPDKAPEQASSSEQVREHNCFFYMIEGSVYNVEEAHGGSKK

SEQ ID NO: 129913 - protein, 258 aa, Glycine max
  Coding DNA Sequence Number=SeqID_38228
  Gene Ontology: Mol. function=RNA-directed DNA polymerase activity; Biological process=RNA-dependent DNA replication
  Homolog annotation: Hit_ID=Q9LDL8; Match level="QueryCoverage=43%, HitCoverage=11%, E-value=7e-11, Identity=33%"; Hit description =Putative uncharacterized protein AT4g08830
MDKSLMFFSKNVGINHRTQLSYDIGLQWIEDLSKYLGVPIFHQKVSSGTFQFIMDKVHQRLSAWKAKILSFADPVEGWLVNNFKDCFPDTIVHIILNLSHPKQEDAGFDKIAWNYAPNGNNKGESSVIYAEVSAILLGLKLAWAKGFNSANLVADIIAKQALNTNMGYHIFVVAPDCISNALRAELAHNKSAIGIGFKLSPTPSHQWTPNEDEEVHNGRRRGTSTNGDRGRGTTNKHQQRNENKQQAPTKEEEDEEAA

SEQ ID NO: 129914 - protein, 249 aa, Glycine max
  Coding DNA Sequence Number=SeqID_38229
  Gene Ontology: Mol. function=superoxide dismutase activity; Cellular component=chloroplast; Biological process=superoxide metabolic process
  Homolog annotation: Hit_ID=P11964; Match level="QueryCoverage=87%, HitCoverage=93%, E-value=1e-73, Identity=66%"; Hit description =Superoxide dismutase [Cu-Zn], chloroplast precursor
  Pfam annotation: Domain name=Sod_Cu; Domain location=52-240; Score =296.0; E_value=7.1e-86; Accession=PF00080.11; Description=Copperzinc superoxide dismutase (SODC)
  Subcellular localization annotation: CTP_CleavageSite=49; ConfidenceScore=5.82e-01
MQLAVAANAVVSPSPFRPHPLLRSSFSGVSVKLTPQSITFSRLKPLTVFAATKKAVAVLKGTSAVEGVATLIQEDDGGAFAHPHSQIGPPPDGNEMEGKVSNQVCVYSPTTVSVSITGLTPGLHGFHLHEYGDTTNGCISTGAHFNPNNLTHGAPEDEVRHAGDLGNIVANAEGVAEATIVDNQIPLSGPNSVVGRALVVHELEDDLGKGGHELSLTTGNAGGRLACGIKPAMCRVGIAGQGELVKLIQ

SEQ ID NO: 129915 - protein, 854 aa, Glycine max
  Coding DNA Sequence Number=SeqID_38230
  Gene Ontology: Mol. function=metal ion binding; Biological process =embryo sac development
  Homolog annotation: Hit_ID=A5CA54; Match level="QueryCoverage=94%, HitCoverage=83%, E-value=1e-143, Identity=38%"; Hit description =Putative uncharacterized protein
  Pfam annotation: Domain name=zf-C3HC4; Domain location=802-840; Score= 8.3; E_value=0.01; Accession=PF00097.16; Description=Zinc finger, C3HC4 type (RING finger)
  Subcellular localization annotation: CTP_CleavageSite=49; ConfidenceScore=5.27e-01
MAIAGLHSVSVLDSSFLRDSRSQSSGRGGDGRRGTTRSSSLLQMWREIEEEHVVNQVQGRPDEVPIEQRRDGLVADPSQDIQERRQQHVLEDAVLGENESETWSQSQSQNESHDGNEDLNNSSCDNSSDLGEVERERVRQIFREWMNSGARDHASNISGRNNGSRGEWLGETEQERVRVIREWVQMSSQQRSVSSGENREEPSAEIDMQIERVRDGLVVNQIGGQTEHTRRGIRKLCGRQAMLDMLKKAERERQREIQELLNHQAVSQFPYRNRIQALLRGRFLRNDRPVDNNKPLSVAESELGFLRRRQTVSGLREGFFCRKENSGCSQATSNADTSSNVEIDFNTNEQMGSSSSHIVPIVHPEQSDPNHRGSNRLGVSGSQNCVRGTACENLDWQESTAQADQLQHLPIESLDCQSSFSACVERGDNPEQNVDVMPTEDAANEITQQSLRIEDSEHSNNQEFSEVHNEPSELGGINNSQNNSSNYNIHMEDNVVDDVNWNESGALEGEQPEEVFENEGSEWYQNNTEWRNSTEENVDDNQLSNTANEWPDNSLANEDGENSRLQESHEVWQEDGGFQEAVENWLGGPSDHESAPVGRIRGFYFPEDDNVYSVELRELLNRRSVSNLLRSSFRESLDQLIQSYVERQGHANIDWEFQETTPSSASVEQDLEQHSRDQIVGQEEVTVSPLNLPSLPIPPPLPIWDQHHHRDNWSQNDINNQRLVIDWEIINDLRIDMARLQQRMNNMQRMLEACMDMQLELQRSIRQEVSAALNRSAGSSGIHDCESPEDKSKWECVRKGLCCICCESNIDSLLYRCGHLCTCSKCANELLQSRRNCPMCQAPVVEVIRAYSIQ

SEQ ID NO: 129916 - protein, 26 aa, Glycine max
  Coding DNA Sequence Number=SeqID_38231
MDEVKDKASVWYYKRCQQRFKSKDGI

SEQ ID NO: 129917 - protein, 611 aa, Glycine max
  Coding DNA Sequence Number=SeqID_38232
  Homolog annotation: Hit_ID=A5AWN3; Match level="QueryCoverage=21%, HitCoverage=13%, E-value=8e-16, Identity=42%"; Hit description =Putative uncharacterized protein
  Pfam annotation: Domain name=POX; Domain location=461-604; Score= -25.4; E_value=9.8e-05; Accession=PF07526.2; Description=Associated with HOX
MQHRRIEETVIESEIRRNKKGKRKKLWKEEGEKKGPQMLEFHPTHESLTSHGTSLPIIAFAIIVALLSFIHPSSHFPFQTNTTFSTGIFTLPTKSHQNLFSIAPKEVVSGWNLEASTRSAGVGGVEQNLGFHLLLCFYVSRESFKLFFGYLRRFYGLGYSFTCERASWVIVKALFGSGGIKSSQQHLQEFSNNNLEHLSLHPGFNLDLLQVRNVRNGNMLDEAAAALYSSEMITFSNPLSAPRNPLECQELMMAQYGSTSFPHSSSTKEQQCEPRNLGASGMVNYNGSNPNNNNSTFYSSELNNNVSSEMGNSEIQIQKQFGEIHYPPSSSSSPPLYHNALQDMAYGVWGGNNNNHGESVLHYGNNELRFGGASLWTHNNSALGFKKINNEQLHDTNHPHQGLSLSLSSNSQQQSSKPCFEERSVVKPPSSPMKLNVLSNNNNNTVYRNVGPLGPFTGYATILKSSRFLRPCQQLLDEWCCQSGSKFAKRGVCDVPEWVSRDVSAASTSATALNVDESAAAKGGGNSGASSSMLYSSIENNNNNNSNNNNNSADGGAASSFCLSSRPECQKNKAKLLYMQEEHKEKRPNALKLLRATRSHFWCRLMWMQSS

SEQ ID NO: 129918 - protein, 37 aa, Glycine max
  Coding DNA Sequence Number=SeqID_38233
MDGFKKIEGEVSNVGANFEDCVGRGAVVAWERFFVWG

SEQ ID NO: 129919 - protein, 1290 aa, Glycine max
  Coding DNA Sequence Number=SeqID_38234
  Homolog annotation: Hit_ID=Q8RXC2; Match level="QueryCoverage=96%, HitCoverage=98%, E-value=1e-175, Identity=53%"; Hit description =Putative uncharacterized protein At2g27890:At2g27900:At2g27910
AAARSRGLKFAMQPNLFPFGSVLGNPFIFNGDGDLSEGGGGIESSRVFFLLPFFLLSQGGAMDLSKVGEKILSSVRSARSLGLLPPVSDRPEITPYDWIVEMYCVFVVKLGRSSNCAAFNAFDASFGFDDVCTVAMRLPPRCDLVAILDIAGDAVAIVVMVSEKTLDFAVAIAVADIFLQPWGLLNNLFNPPVNLLVNVPCGYPAVHVPARAAAAAAVARALAGLPPHQRYSLSSSSEELSSIYGSIPQGQVVEELEDEFYEEVLLAVSLQFQFRTDLSCSLLCVLDRNYFHMEDFDPIRHVLEHVPVEENELTYFEKQPAAGTAYLSNGCKPLNELMLASPGAAVKLCLGDLLVMGSNPETASLHMQGEEPLGNGAALRLAQLDRVAERLSRHVMEHHEVMVADTYFCPVKGMNLVRELEKDLRIANVICMNGRRHLTSSMNEVSRDLIVNSYSKKKQALLDMLPTLTELRRALDMQSTLESLVEEGNYWKAFQVLSEYLQLLDSLSELSAIQEMSRGVEVIDAYALIGDTAGLAEKIQSFFMQEVISETHSVLKAIVHEWGQPSLYELAFGIELGPNHSKMCIEKNSSSTSTRDSVKIEYTSEGQPSPYELAFGVELGPNQHSKTQQDSAAQTSNKCNEEISCSPGEPQEVDSDVRACNNSMSSSGDVIHGSSSREESATVSSLTETSGSPYSDSHDTIKEAGKEDSATSSIESPWYHLRKEATTFVSQTLQRGRRNLWHLTASRVSVLLSSATAYTASIHQFLKNYEDLSIFILTGEAFCGIEAVEFRQKLKSYNVDRDFLCSSFESGTCKMQCHFYPPMSARCLQDDDGALKMVLEKETWLKLPPDTVQMISFAGLIGDGAPLISLSSGKSTNVSAVHSTKSVNVVHTGARKNGFSHWIKSGNPFQQKLPTSNEGRGYSQPNGSVCGEFDGSSTNNFHDDKTPRKNDFNQMNGANSVSEDENEDLLADFIDEDSQLPSRSSQPHHSRTLSSHGNDEENTTQTGSSLCLLKSMDKYARLMQKLEVVNVEFFKVWDLCLTLEGWDFSVHSGLVLGVRTTAQPVHVGAGAPDEHGGMLGSNCKEWDLSFKLEVWESSVGFEERCVAVDTISLVARILNRSKAHLQSMLLQSNSTILEDFYVHLVQDLLLDYGLEIVAETLVEGLSRVKRCSDEGRALMSLDLQVLINGLQHFVALNVKPKLQMVETFIKAYYLPETEYVHWARAHPEYSKSQIVGLVNLVATMKGWKRKTRAPCKGSVYCLAFDPLLIMEYFPNLCALVTDRYPLFLTS

SEQ ID NO: 129920 - protein, 439 aa, Glycine max
  Coding DNA Sequence Number=SeqID_38235
  Gene Ontology: Mol. function=zinc ion binding; Cellular component =cytoplasm; Biological process=intracellular protein transport
  Homolog annotation: Hit_ID=A5BP44; Match level="QueryCoverage=82%, HitCoverage=60%, E-value=1e-160, Identity=77%"; Hit description =Putative uncharacterized protein
  Pfam annotation: Domain name=WD40; Domain location=103-141; Score =25.7; E_value=0.00017; Accession=PF00400.23; Description=WD domain, G-beta repeat
  Pfam annotation: Domain name=WD40; Domain location=144-186; Score =0.6; E_value=27; Accession=PF00400.23; Description=WD domain, G-beta repeat
  Pfam annotation: Domain name=WD40; Domain location=208-243; Score =1.0; E_value=24; Accession=PF00400.23; Description=WD domain, G-beta repeat
  Pfam annotation: Domain name=WD40; Domain location=50-85; Score=1.0; E_value=24; Accession=PF00400.23; Description=WD domain, G-beta repeat
  Pfam module annotation: Pfam domain module=WD40::WD40::WD40::WD40; Domain location=103-141::144-186::208-243::50-85
MVPFPSENGVEGDDEREEEDEEEEEEEEDEEVVEDEEDEEEPRLKYQRMGGSIPSLLASDAASCIAVAERMIALGTHGGTVHILDFLGNQMYARDCGYLLVYVDTVKEFSAHASVVNDLSFDTEGEYIGSCSDDGSVVINSLFTDEKLKFEYHRPMKAVALDPDYARKMSRRFVAGGLAGHLYLNSKKWLGYRDQYLLFVNDKITPPYPPQKVLHSGEGSIHAVKWRASLVAWVNDAGVKVYDTANDQRITFIEKPRGSPRPELLLPHLVWQDDSLLVIGWGKSVKIASIRTNHQKAANGSFRQVPLTGMTQVDIVASFQTSYFISGLAPFGDALVVLAYIPGEEDGDKDFSSTAPLRQGNAQRPEVRIVTWNNDELSTDALPVHGFEHYRAKDYSLAHAPFSVFRRLRASPGAAVKLCLGDLLVMGSNPETASLHMQG

SEQ ID NO: 129921 - protein, 560 aa, Glycine max
  Coding DNA Sequence Number=SeqID_38236
  Gene Ontology: Mol. function=zinc ion binding; Cellular component =cytoplasm; Biological process=intracellular protein transport
  Homolog annotation: Hit_ID=A7PQN0; Match level="QueryCoverage=97%, HitCoverage=57%, E-value=0.0, Identity=80%"; Hit description =Chromosome chr6 scaffold_25, whole genome shotgun sequence
  Pfam annotation: Domain name=Clathrin; Domain location=231-378; Score= 37.5; E_value=4.9e-08; Accession=PF00637.11; Description=Region in Clathrin and VPS
  Pfam annotation: Domain name=zf-C3HC4; Domain location=476-556; Score= 1.8; E_value=0.056; Accession=PF00097.16; Description=Zinc finger, C3HC4 type (RING finger)
  Pfam module annotation: Pfam domain module=Clathrin::zf-C3HC4; Domain location=231-378::476-556
MEECTNADCSDVIWVIIVVQDTEDHIAWLLQHGWHEKALAVVESGQGRSELLDEVGSRYLDHLIVERKYREAASLCPKLLRGSASAWERWVFHFAHLRQLPVLVPYMPTENPRLRDTAYEVALVALATNPSFHKDLLSTVKSWPSVIYSALPVISAIEPQLNTSSMTDSLKEALAELYVIDGQFEKAFLLYADLLKPEVFDFIDKHNLHDAIRGKVVQLMRLDCKRAVPLLIQNRDLISPPEVVNQLLNADDKSDCRYFLHLYLHSLFEVNPHAGKDFHDMQVELYADYDPKMLLPFLRSSQHYTLEKAYEICIKRDLLREQVFILGRMGNSKQALAVIINKLGDIEEAVEFVTMQHDDELWEELIKQCLHKPEMHTVGNLDPLYIVNKVPNGLEIPRLRDRLVKIITDYRTETSLRHGCNDIIKYYKEARHGISLGNEDEPRVKMSDTRASQVFDKSPSLRTVELKSKTRGGGRCCICFDPFSIQNVSVIVFFCCHGYHTTCLMDSSYTSSNQKEVQATSLEAETYDGYNGYEEDASEDDEEAKSGGPRMRCILCTTAG

SEQ ID NO: 129922 - protein, 624 aa, Glycine max
  Coding DNA Sequence Number=SeqID_38237
  Gene Ontology: Mol. function=phosphatidylcholine-sterol O -acyltransferase activity; Cellular component=endoplasmic reticulum membrane; Biological process=lipid metabolic process
  Homolog annotation: Hit_ID=A7PQK9; Match level="QueryCoverage=100%, HitCoverage=100%, E-value=0.0, Identity=63%"; Hit description =Chromosome chr6 scaffold_25, whole genome shotgun sequence
  Pfam annotation: Domain name=LACT; Domain location=121-586; Score =183.8; E_value=4.3e-52; Accession=PF02450.6; Description =Lecithin:cholesterol acyltransferase
MVSISKLKKFYLVEPLKSSSLGFHSFEETKKCESIVINEVEGKRQKKHRKKQCKDWRCIDYCFWMIGYMCTTWWLLSLLYGCLPAMLLGFEAPVSPGVRLSREGVTALHPVVLVPGIVTGGLELWEGRSCAEGLFRKRLWGDSFAQILKRPLCWLEHLSLHDETGLDPPGIRVRAVPGLVAADNFASGYLLWADLIENLARIGYEGKNLFMAAYDWRLSFQNTEIRDQALSRLKSHIELMFVTNGYKKVVVVPQSMGAIYFLHFLKWVETPPPMGGGSGPGWCDKYIKAIMNVSPAFLGDPRAVSNIFSTESSVGFVRTVASGILNFDYVGRQTLEHAMRVCRTWDSIISLMPKGGETIWGGLDWCLEDWNNYDQEISWGSNSATFNLSYEAVWIDCDEMSRESIQKISKKRAYTARTVFDILNFVAPKMMKRAEAHFSHGIAENLEDPKYAHYRYWSNPLETKLPDAPDMEIYCLYGVGIPTERSHVHKFYPSEKDKSIPFQIDSSADGEDGSWLHNGVYFVDGDESVPIVSSGFMCAKGWHGRTRFNPSGTATYTIEYQLKQPGGLIDRRGLENGASSNIMGNAALIEDVLLVAAGATGVDIGGDRIFSDIMRMSERINLRL

SEQ ID NO: 129923 - protein, 387 aa, Glycine max
  Coding DNA Sequence Number=SeqID_38238
  Gene Ontology: Mol. function=hydrolase activity, acting on ester bonds; Biological process=lipid metabolic process
  Homolog annotation: Hit_ID=A7PQL0; Match level="QueryCoverage=52%, HitCoverage=83%, E-value=1e-40, Identity=73%"; Hit description =Chromosome chr6 scaffold_25, whole genome shotgun sequence
  Pfam annotation: Domain name=Lipase_GDSL; Domain location=178-383; Score=39.4; E_value=1.3e-08; Accession=PF00657.13; Description=GDSL -like LipaseAcylhydrolase
MKTPLPGAREAIESARERCVAEEGCDRSGAATLVKKARNTKPKWSPTTLIRPNTSYYYVPFSILSNFFFLFLLFSLYMFLVEFICVLLYTFGSMVEKYLAKPTILYASDSKQKTYVRLLVPQTSSESTFSIVSFCMNNKKLIAEEELKRMGYSRSFLASLLLAVFLNVTNGQPLVPAMFTFGDSIVDVGNNNHQLTIVKANFPPYGRDFENQYRTGRFCNGKLATDFIAEIIGFTSYQPAYLNLKTKGKNLLNGANLPQLLLSLYALGARRIGVTTLPPIGYLPGAITLFGAHTNECVTSLNSDAINFNEKINTTSQNLKNMLPGLNLVVFDIYQPLYDLVTKPSENGFFEARKACCGTGLIETLCNKKSIGTCDHTYLKIVIVKYG

SEQ ID NO: 129924 - protein, 121 aa, Glycine max
  Coding DNA Sequence Number=SeqID_38239
  Pfam annotation: Domain name=AT_hook; Domain location=103-115; Score =12.4; E_value=0.17; Accession=PF02178.10; Description=AT hook motif
  Pfam annotation: Domain name=AT_hook; Domain location=71-83; Score =16.5; E_value=0.034; Accession=PF02178.10; Description=AT hook motif
  Pfam module annotation: Pfam domain module=AT_hook::AT_hook; Domain location=103-115::71-83
MEKQNHTTDTDEFSTLGPTSNEPHTPMVHVNADNNNNNVVSAAVNVGVGSVSELVVAVAKSEAVGSGQMVKRGRGRPRKYDAVGSAVLPATTGPPGFSDQTVKRGRGRPRGSGKLQILASI

SEQ ID NO: 129925 - protein, 154 aa, Glycine max
  Coding DNA Sequence Number=SeqID_38240
MSHSHQHPQPQQRLLLSQCLNQLHEHPAESSFSSSQTHYKTKIPLCLIHSETTSTPTHSFFGPKIVSSSPHQHYYFHEPHSPSSFPCCFNVSSRRWSAFKLGCTSMDPQVELSASLHSPSEIIRKRKITGRQKREELEKEVYILIRTAQFDGKF

SEQ ID NO: 129926 - protein, 616 aa, Glycine max
  Coding DNA Sequence Number=SeqID_38241
  Gene Ontology: Mol. function=nucleic acid binding; Cellular component= intracellular; Biological process=regulation of transcription, DNA -dependent
  Homolog annotation: Hit_ID=Q8LJS2; Match level="QueryCoverage=53%, HitCoverage=98%, E-value=1e-92, Identity=58%"; Hit description =Histone deacetylase HDT1
  Pfam annotation: Domain name=Nucleoplasmin; Domain location=278-481; Score=-84.9; E_value=0.073; Accession=PF03066.6; Description =Nucleoplasmin
  Pfam annotation: Domain name=zf-C2H2; Domain location=590-613; Score =21.5; E_value=0.003; Accession=PF00096.17; Description=Zinc finger, C2H2 type
  Pfam module annotation: Pfam domain module=Nucleoplasmin::zf-C2H2; Domain location=278-481::590-613
MPNSKNNRNGQGEPHRRGKLTKKSSSFYGHSSPAAMSGDPILRPKTVPDLLSERHRAAATPLVEVVPKQPPKLLLKVTSMGSLGPVQVVMTPESTVGDLVAAAVRQYVKEGRRPILPSNDPSHFDLHYSQFSLESLDREEKLRDIGSRNFFMCPRKCGGGGGDGRGTTPFASCSREADKTTKGGAFGWLRVGKGSLLGIYSIWKELEYLHNGFEVKLGNWMLDFWNDIWVNRTPIALEVAWIDIHDVGIQVKDMWCQHQFSYELKGVDRDFLLALDDQIVNYVYSQGVEVKVGQTVTVDPMDPVDSYIHISQVALGEAKKDKPNEPVVLYLKVGEQKIVLGTLSRDGIPHLSLDLVLDSDSELSHTSKSANSSEEDEELALEGQDNGKPELKAEGAKVTKPSKSIPKIGAPAKAADPKKDEDDDSDDESDDDLAGEDESGSSDEMDDDSNSEEESDGDDEETPAKKVDQGKKRPNESAAKTPISAKKAKTATPEKTGFGLKCGAHWCKSSRCLLPSNTPTTGIRVDGSTVFLAALLPLEGETIMWKRLTLEGEMVGLQKSVHVATPHPSKKGGKTPNSTKGQTPNSAGQLSCASCKKSFTNEAGLQQHKKAKHGGQ

SEQ ID NO: 129927 - protein, 42 aa, Glycine max
  Coding DNA Sequence Number=SeqID_38242
  Subcellular localization annotation: CTP_CleavageSite=31; ConfidenceScore=5.12e-01
MVQTAKTRMKKATATFGGVVYLSNNNVAQPRTKGKGSSTRST

SEQ ID NO: 129928 - protein, 151 aa, Glycine max
  Coding DNA Sequence Number=SeqID_38243
  Homolog annotation: Hit_ID=A5C9H4; Match level="QueryCoverage=84%, HitCoverage=23%, E-value=3e-22, Identity=37%"; Hit description =Putative uncharacterized protein
MVATTISALAAIPTTTLNDAQFENAYPYIGDLEGNVNEAQLLELFGQVVSIRVCKDQLDDPLLDFGTITCCKVVLESNGHSKGYGFVAFSPVEDATPGTITPLPVGIPGYHPGTPRLAPPWLYFGQGAPGLVPPQPAGYGFPAAPLPRHAS

SEQ ID NO: 129929 - protein, 593 aa, Glycine max
  Coding DNA Sequence Number=SeqID_38244
  Gene Ontology: Mol. function=nucleoside-triphosphatase activity; Cellular component=endoplasmic reticulum; Biological process=cell division
  Homolog annotation: Hit_ID=Q9SCN8; Match level="QueryCoverage=99%, HitCoverage=89%, E-value=0.0, Identity=66%"; Hit description=Cell division control protein 48 homolog D
  Pfam annotation: Domain name=AAA; Domain location=255-420; Score =209.8; E_value=6.7e-60; Accession=PF00004.20; Description=ATPase family associated with various cellular activities (AAA)
  Pfam annotation: Domain name=AAA; Domain location=509-593; Score =29.2; E_value=4.7e-08; Accession=PF00004.20; Description=ATPase family associated with various cellular activities (AAA)
  Pfam annotation: Domain name=CDC48_N; Domain location=27-113; Score =125.3; E_value=1.8e-34; Accession=PF02359.9; Description=Cell division protein 48 (CDC48), N-t
  Pfam module annotation: Pfam domain module=AAA::AAA::CDC48_N; Domain location=255-420::509-593::27-113
MSHQVESSDSKSWKKDSSTSILERKKSPNRLVVDEAVNDDNSVVAMHPQTLKKLQLFRGDTILVKGKKRKDTVCIALRDENCEESKIRLNKVLRSNLRVRLGDAVSVHSCPDVKYGKRVHILPIDDTIEGVTGNLFDAYLKLVVMRSYYCLLWVWLGKKRDLVLVIIFLVQGGMRSVEFKVIEIDPGEYCVVARDTEIFCEREPVKREDEERLDEVGYDDVGCVRKQMAQIRELVELPLRHPQLFKSIGVKPPKGILLYGPPGSGKTLKARAVSNETGAFFFCINGPEIMSKLAGESKVISGKHLKKLKREKTHGEVERRIVLQLLTLMDGFKSRAHVIVIGATNRPNSSPALRRFGRFDREIDIGVPDEVGRLEVLRIHTKNMKFSDDVDIERIAKDTHGYVGADLAAICTEAALQCIREKMDVIDLEDENIDAEVLNSMTVSNEHFHTALGTSNPSALRETVVEVPNVSWEDIGGLENVKRELQETVQYPVEHPEKFGKFGMSPSKGVLFYGPPGCGKTLLAKAIANECQANFISVKGPELLTMWFGESEANVREIFDKARQSAPCVLFFDELDSIATQRGSSVGDAGGCC

SEQ ID NO: 129930 - protein, 296 aa, Glycine max
  Coding DNA Sequence Number=SeqID_38245
  Gene Ontology: Mol. function=metal ion binding; Biological process =metal ion transport
  Homolog annotation: Hit_ID=A9PGK8; Match level="QueryCoverage=93%, HitCoverage=87%, E-value=1e-39, Identity=36%"; Hit description =Putative uncharacterized protein
  Pfam annotation: Domain name=GRP; Domain location=165-261; Score= -23.2; E_value=0.018; Accession=PF07172.2; Description=Glycine rich protein family
  Pfam annotation: Domain name=HMA; Domain location=122-184; Score =20.6; E_value=0.006; Accession=PF00403.17; Description=Heavy-metal -associated domain
  Pfam annotation: Domain name=HMA; Domain location=21-90; Score=45.1; E_value=2.4e-10; Accession=PF00403.17; Description=Heavy-metal -associated domain
  Pfam annotation: Domain name=Ribosomal_S25; Domain location=88-164; Score=-33.6; E_value=0.076; Accession=PF03297.6; Description=S25 ribosomal protein
  Pfam module annotation: Pfam domain module=GRP::HMA::HMA::Ribosomal _S25; Domain location=165-261::122-184::21-90::88-164
MGAKKKNGNNKENEDNTTTTVVLKVQMHCDGCASKIIKHLRAFQGVETVKAESDAGKVTVTGKVDPTKVRDNLAEKIRKKVELVSPQPKKEKENEKDPKPNNKSENKTQDKKTKDKEVVTTAVLKVALHCQGCLDRIGKTVLKTKGVQEMAIDKEKEMVTVKGTMDVKALAENLMEKLKRKVEVVPPQKDKEGDNKEGGGGEKGSGKKKNKGGGGDKNENIEDGIEKIEHNRMEYLAPPAFGFGYGPYGGYGHGHGHGNIGGYSCVPVYPEQMHFHLHAPAPQMFSDENPNACSVM

SEQ ID NO: 129931 - protein, 410 aa, Glycine max
  Coding DNA Sequence Number=SeqID_38246
GTSTWVVVTKNKKGYISCGSVQVEGTSTWLFKENKGGYIPCGSLLVKVFTRLKRNLKDCRPLDPTHYDDGDNHRVVLVDGIHALEVLIRKHLKSLEGFLVQDVSGIVLEGLNSLRRHEVHYDDGDNHRIVLVDGTHALEFLIHKRHRRKTSLKGCIEKINVDVPDGKAASDGVDYTSNVLGGFLLRWSLAPAWGLPGLLTNWAKYPAYGYLHVECFLENHGAIGCYGCVTLVPGPFGEKLALVWLVPLVRLVCLKLGVYFALVVLLSGLIVYKLAGCKARSMECNATSKLRFWIWMVVHPNLSMNFLRDLSFACHRLAKAAKSVTEVSRLRPHRVLTTDECERIDMRPWGMFYRSPTVGAKCSYQNPKLSHVRVDVVEWGPELHTSTRIGAFDRREDPQNKGLQRSNKNM

SEQ ID NO: 129932 - protein, 178 aa, Glycine max
  Coding DNA Sequence Number=SeqID_38247
MSHHSSSVNGEGTSHKDPLSRILDELSSLKLWKEKQERKEKGKKRVEEISQDERKKIRDEDRRKIMKEMKREKHASYSSHNSCKSLSEELRDYYEGMHRSHLRPHSHRREKERKPQEANINLSYFHGKDNVEANLVLEIRVEQQLKKKSTSKSYGSHSYPKTYQGYGILRVTPSKPKD

SEQ ID NO: 129933 - protein, 114 aa, Glycine max
  Coding DNA Sequence Number=SeqID_38248
MKREKHVSYSSHDSCKSLSEELSDYYRGRHSSHSKHHSQRKEEDRRPQEVNISLLYFHGKDNVKAYLDWETKVEQIFAFHHISEERKVPLATQGMPSIGGLPLLGNKGFMGILQ

SEQ ID NO: 129934 - protein, 101 aa, Glycine max
  Coding DNA Sequence Number=SeqID_38249
  Subcellular localization annotation: CTP_CleavageSite=64; ConfidenceScore=5.06e-01
MATMMKAMMSMKKIMEANAVAVTATSVVAKLNPTPPSGLNQMNHPTSDMVGKDLGSTSGLHYVQFQNKHAFPPNGLPSNYTPPNVAYTLGEDVNNSISHTH

SEQ ID NO: 129935 - protein, 69 aa, Glycine max
  Coding DNA Sequence Number=SeqID_38250
MFSPFGTSLSFEFAWKNRFREENLSRGASETLSVSDSVEILHRSSPFFIRSSFVLRSSTVFFSSVFNVL

SEQ ID NO: 129936 - protein, 69 aa, Glycine max
  Coding DNA Sequence Number=SeqID_38251
MAIGTISNNASPKEENSIRGFTIVKPGYRAQYLKMCSKSVGVMCERSNLRITQPHLQNNQKIPRQIQEL

SEQ ID NO: 129937 - protein, 105 aa, Glycine max
  Coding DNA Sequence Number=SeqID_38252
MAPRKLASKRSRKDKAAEGTSSAPEYDSHRFRSAVHQQRFEAIKGERRIQLRDDEYTNFQEETGRRRWTSLVTPMAKFDPEIVLEFYANAWPTEEGVRDMRSWVR

SEQ ID NO: 129938 - protein, 87 aa, Glycine max
  Coding DNA Sequence Number=SeqID_38253
MLTSPERVQMPTLVSTCQSDLGSPNDEVQITGRCLRMLPDSWVMIAKGGVVDKSGAFAPTYPQLVMSNSDLRSSFKSETKIVSVFLH

SEQ ID NO: 129939 - protein, 76 aa, Glycine max
  Coding DNA Sequence Number=SeqID_38254
MQAQVLALPPEPKVGPSAAPVSTKESCVDPSGNDPNTGDSDKCGLYIEENPPHLVALGKVYEGPTTVHNIPLCKIK

SEQ ID NO: 129940 - protein, 190 aa, Glycine max
  Coding DNA Sequence Number=SeqID_38255
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MEVDEPWLGLWLPLNYQVDMGSSLAYDNGIWGMAFVDNWVVGKEEVCYWLSNDIVGLVGNLATHIDPFTGEDQICKALRRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 129941 - protein, 235 aa, Glycine max
  Coding DNA Sequence Number=SeqID_38256
MSSPSEDYTSSPSEGYTPLPSEDYTSSPLEDYTSSPLEGYTSSPSEGYIGQHVLPYRGLHVLPFRELHALAFRGLHVVAIRGQHLLAFRELHILTFRGLHVLPLRGLHALASVGLPAVTIKGLHVPHSKGYTPSPLEDYTSSPSEGYTSSSSEGYTPSPSEDYTSSPSEDYTSSPSEDYKSSSSEGYTRSPSQDYTSSPSEDYMSSPSKGYTVRQVAKDILRRGVELRYSKLLPQ

SEQ ID NO: 129942 - protein, 81 aa, Glycine max
  Coding DNA Sequence Number=SeqID_38257
  Subcellular localization annotation: CTP_CleavageSite=69; ConfidenceScore=5.45e-01
MGVQIATRPLGPSRLFLHKAVASGGSNLARMGEQSSPGRAGKSKPRRYRNVSVGYFAKIFNRSSPFVVRSSSFFDLQPVSS

SEQ ID NO: 129943 - protein, 117 aa, Glycine max
  Coding DNA Sequence Number=SeqID_38258
MVAIIPTKVHQPPFLREYDSNATCACHGEAPGHSIEHCRGLKRKVQGLIDAGWLKFEENRVIFNFHRNWVQAIGLFAQAICAPEFGLPRSFNQRLLVLHVGGAAIKQQVKFKTNKFQ

SEQ ID NO: 129944 - protein, 78 aa, Glycine max
  Coding DNA Sequence Number=SeqID_38259
  Homolog annotation: Hit_ID=Q2HW78; Match level="QueryCoverage=100%, HitCoverage=13%, E-value=8e-07, Identity=39%"; Hit description=RNA -directed DNA polymerase
MAGRGRDQNRDVLDRITAVLETLVQERDVEPAEYRGLMAFRKNHQPKFNGDYDPEGARLWLAETEKIFEAMGCLEEHK

SEQ ID NO: 129945 - protein, 156 aa, Glycine max
  Coding DNA Sequence Number=SeqID_38260
MRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPLPKCQLVSQPTLRREGDARLTGCVFHERNTRGVATNVYLRKTSEKPEKTRSTNF

SEQ ID NO: 129946 - protein, 98 aa, Glycine max
  Coding DNA Sequence Number=SeqID_38261
MSSGCFLVETSSKIFESIQRLTNWNEGNVTRVFKVFCLCPVFLAVLGRIDGDPVLGETRIWATWEYVSSVGGGQQGMVDLCAICGCGKLVVHHRPTAT

SEQ ID NO: 129947 - protein, 140 aa, Glycine max
  Coding DNA Sequence Number=SeqID_38262
ALRLNAPLPYPHLVTLFLQHFNIPLDSEPYVPIKRSFLIGVAVIASFGYRKEHDGSWVKKGAQPNDGEGHLQGGEDSSLLQKILDRFDGLQTFVGERFDALELQVDMRFDEMDSRITKVEEDVSYIRTSFDLPPPPPPSS

SEQ ID NO: 129948 - protein, 96 aa, Glycine max
  Coding DNA Sequence Number=SeqID_38263
MGSLARTQPPPHCDDEDPAAQEAASTLEKSPEATLEPPAPMADTTSPEQAAYPSMPKDQTTPAQSPNASLVSTHVLHLTDEEEFQTQDTQDQSQDF

SEQ ID NO: 129949 - protein, 361 aa, Glycine max
  Coding DNA Sequence Number=SeqID_38264
  Homolog annotation: Hit_ID=A5BSR3; Match level="QueryCoverage=35%, HitCoverage=42%, E-value=8e-07, Identity=32%"; Hit description =Putative uncharacterized protein
MAEKTKKKLEEVAQSRSTEGVIDPPSLIRRHVKWKMARTKKTGQMTSEAAKEITKKIVSQDSFVPHGRQDVLTIGIGRPEHSGRVHAVGDGVTIKQYFGSTPQSSRSSSCIPPEELEQLTQQIKDQLEKSITEKGLALPPELEVGPSTARVSTKRSCVDPSPTDPEMGDSDKYGLYIEANPSRLVALERVFEGSTVVYNVPLLHGQVKTLNTFVAWPTHLVKRAAMSPIKPPDRLDPEVDDPLYLMTLTIPRLFLKPFQVMWDATMHVTETSMQAGNSDVYGFLEPQSIPRSGQSQFESESYMKIELDAEHWQMVVILPKENLVVWLCSLHNKSDNYLKGIINSALKGLDDTPQPKSKAGA

SEQ ID NO: 129950 - protein, 267 aa, Glycine max
  Coding DNA Sequence Number=SeqID_38265
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=22%, HitCoverage=40%, E-value=2e-23, Identity=87%"; Hit description=LacZ -alpha
MGLRKRGRDWRIALSNHYAWLQTRGWRMNENAIHGAPKQGREWRIALSNHYAWLQKMGGGCKNKNVIHGAPKKGREWRIALSNHYAWLQLVGGGFMNENAFHGATKKGREWRIALSNHYAWLQTRGCRMHERKRNSWGSEKRGREWRIAIRNHCVWLQTRGWRMHERKRNSVGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 129951 - protein, 177 aa, Glycine max
  Coding DNA Sequence Number=SeqID_38266
GSTFNFEGLDILWDSIRHPSKKLLSFELAQRFNIQFRASRYYGTQSDIRVKSYCRLNWLRGSTFNFERLDILQDSIRHPSEKLLSFEFAQRFNIQFRASRYIIGTQSDIRVKSYCRLNWLRGSTFNFEVLDILRDSIRHPSKKLLSFELAQRFNIQFRASRYITGLNKTSEKKVIVV

SEQ ID NO: 129952 - protein, 65 aa, Glycine max
  Coding DNA Sequence Number=SeqID_38267
MTLGAEFNVESLTYRDWNTSSKVSQKECVRFCARKKRTTYISMKFSRFKKLGLGFDMLMKDRDTG

SEQ ID NO: 129953 - protein, 89 aa, Glycine max
  Coding DNA Sequence Number=SeqID_38268
MSPPQAFYRDHLGASYFIWITKLPWPVMIKTSPSQGTKVSGRKHATAAGHTTQSRDIGYLGRQRADVGGFFFPFVRRCVPPRDCVAVLV

SEQ ID NO: 129954 - protein, 179 aa, Glycine max
  Coding DNA Sequence Number=SeqID_38269
MRGIVHEPQVNIGADQKFSPVDVFKRKGGTNPRIFNGLIKHQTTPLPSLQNGQVTKSNRTHTLREFPERGLHVLAIRGLHVLAIRGLHALTSRGLHVLTLRGLHVLTIRGLHALTSRGLHVLALRGLHALTLVTLTVERTTRPRLERTTRPHHQRAARPHLQRTTCPRLERATRPHLGY

SEQ ID NO: 129955 - protein, 71 aa, Glycine max
  Coding DNA Sequence Number=SeqID_38270
TYQGNPCGVYLDLSSFTGSGVYPDLSSFIGSCVYPDLSSFTGSGVIQTFVACIKQSAPTQVRIIWYHSFGS

SEQ ID NO: 129956 - protein, 113 aa, Glycine max
  Coding DNA Sequence Number=SeqID_38271
MSKSFEFGMTGSLDESISCFLIRVDPWVLVPITFRGLHVLANRGLHALTFRGLHVLALRGLHALTLVTLTVERTTRPRLERTTRPHHQRAARPYLQRTTCPRLERATRPHLGY

SEQ ID NO: 129957 - protein, 126 aa, Glycine max
  Coding DNA Sequence Number=SeqID_38272
MAGRCARFEFAHHGGRPYFPNLCLPYLRLDDHLVEARWGRRVHLNNSAGSGNCNHIGFHYLLDAHHGLYHCGHLLFHGLCHNLPFGGRATHHSRVRLPRKEYVRSRHQRLFEENIRKTGKDVVNEF

SEQ ID NO: 129958 - protein, 106 aa, Glycine max
  Coding DNA Sequence Number=SeqID_38273
MILEDELKACQRSKRSLSEQLSKTEENIWAIINQYKEKLSLVATHEQRLEDEFSFTLNGSQELPRLLAKAKAKAMADLYLAPEEVQGLLDYCQHMIDLMAHIIRSR

SEQ ID NO: 129959 - protein, 90 aa, Glycine max
  Coding DNA Sequence Number=SeqID_38274
  Subcellular localization annotation: CTP_CleavageSite=50; ConfidenceScore=5.10e-01
MKMLLISHDVSSIGACRLSQPTLLRASEARLMGASSKGGKCAESPPTFICGKRRKNRRKPVMKNIPDSGVVFTFEEGISTSHVCPKGQQD

SEQ ID NO: 129960 - protein, 252 aa, Glycine max
  Coding DNA Sequence Number=SeqID_38275
  Gene Ontology: Mol. function=methyltransferase activity; Cellular component=cytoplasm; Biological process=rRNA processing
  Homolog annotation: Hit_ID=A4WE82; Match level="QueryCoverage=96%, HitCoverage=100%, E-value=1e-103, Identity=77%"; Hit description =Putative uncharacterized protein
  Pfam annotation: Domain name=Methyltrans_RNA; Domain location=27-246; Score=360.9; E_value=2.1e-105; Accession=PF04452.5; Description=RNA methyltransferase
MRHNAGRNRMRIPRIYHPEALTVNSEVLLDEDAANHVGRVLRMSAGQQIELFDGSNLTFSAEITQADKKRVKVKVLASQPDDRESPLHLHLGQVMSRGEKMEFTIQKSIELGVNVITPLFSERCGVKLDAERLAKKIQQWQKIAIAACEQCGRNRVPEIRAAMTLEAWCAEADDGLKLNLHPRASHSINTLPQPVERVRLLIGPEGGLSAEEIAMTAQHGFTDILLGPRVLRTETTALTAITALQVRFGDLG

SEQ ID NO: 129961 - protein, 152 aa, Glycine max
  Coding DNA Sequence Number=SeqID_38276
  Homolog annotation: Hit_ID=A7FN18; Match level="QueryCoverage=18%, HitCoverage=1%, E-value=2e-07, Identity=82%"; Hit description=RHS/YD repeat protein
  Subcellular localization annotation: CTP_CleavageSite=30; ConfidenceScore=5.16e-01
MKPLPPVNPSGSGITSGLCAGRARRTASCRARVAVQSVAGSIWGTDREGHDWAVAWAGQNYASSPPYDQIGLAGGLNLYHYAPNALGWMDPWGLSKYSLGKETGSNGNPLKKENARCQPEPATPTPAAGPAQSSAAAAKAAPAPGAAGSLRN

SEQ ID NO: 129962 - protein, 300 aa, Glycine max
  Coding DNA Sequence Number=SeqID_38277
  Gene Ontology: Mol. function=coproporphyrinogen oxidase activity; Cellular component=cytoplasm; Biological process=porphyrin biosynthetic process
  Homolog annotation: Hit_ID=A6TDW5; Match level="QueryCoverage=100%, HitCoverage=79%, E-value=1e-143, Identity=82%"; Hit description =Coproporphyrinogen III oxidase
  Pfam annotation: Domain name=HemN_C; Domain location=176-290; Score =88.0; E_value=3e-23; Accession=PF06969.7; Description=HemN C -terminal region
MQQLMDGVRARLPLAADAEITMEANPGTVEADRFSGYQRAGINRISIGVQSFSPQKLTRLGRIHGPDEAVRAAQLAAGLGLRSFNLDLMHGLPDQSLEEALDDLRQAIALNPPHLSWYQLTIEPNTLFGSRPPVLPDDDALWDIFEQGHQLLSAAGYQQYETSAYAKPGYRCEHNLNYWRFGDYLGIGCGAHGKLTQPDGRIVRTVKTRHPRGFMKGNYLDKQHDVPDEDKPFEFFMNRFRLLEAAPRADFQRYTGLEEAVIRPQIDAAIAAVYVQEQPEHWQITEKGKLFLNSLLELFM

SEQ ID NO: 129963 - protein, 344 aa, Glycine max
  Coding DNA Sequence Number=SeqID_38278
  Gene Ontology: Mol. function=unfolded protein binding; Cellular component=plasma membrane; Biological process=response to stress
  Homolog annotation: Hit_ID=A4W6D5; Match level="QueryCoverage=100%, HitCoverage=53%, E-value=1e-179, Identity=93%"; Hit description =Chaperone protein dnaK
  Pfam annotation: Domain name=HSP70; Domain location=4-344; Score =415.9; E_value=6e-122; Accession=PF00012.11; Description=Hsp70 protein
  Pfam annotation: Domain name=MreB_Mbl; Domain location=2-339; Score= -231.1; E_value=4.4e-05; Accession=PF06723.4; Description=MreBMbl protein
  Pfam module annotation: Pfam domain module=HSP70::MreB_Mbl; Domain location=4-344::2-339
MGKIIGIDLGTTNSCVAIMDGGKARVLENAEGDRTTPSIIAYTGDGETLVGQPAKRQAVTNPQNTLFAIKRLIGRRFQDEEVQRDIKIMPYKIIGSDNGDAWLDVKGQKMAPPQISAEVLKKMKKTAEDFLGEPVTEAVITVPAYFNDAQRQATKDAGRIAGLDVKRIINEPTAAALAYGLDKGQGNRTIAVYDLGGGTFDISIIEIDEVDGEKTFEVLATNGDTHLGGEDFDSRLINYLVAEFKKHQGIDLHNDPLAMQRLKEAAEKAKIELSSAQQTDVNLPYITADATGPKHLNIKVTRAKLESLVADLVTRSIEPLKVALNDAGLSVSDINDVILVGGQT

SEQ ID NO: 129964 - protein, 1146 aa, Glycine max
  Coding DNA Sequence Number=SeqID_38279
  Gene Ontology: Mol. function=pyridoxal phosphate binding; Cellular component=cytoplasm; Biological process=threonine biosynthetic process
  Homolog annotation: Hit_ID=Q3Z606; Match level="QueryCoverage=27%, HitCoverage=100%, E-value=1e-157, Identity=88%"; Hit description =Transaldolase 1
  Pfam annotation: Domain name=MoCF_biosynth; Domain location=958-1111; Score=109.9; E_value=7.7e-30; Accession=PF00994.15; Description =Probable molybdopterin binding domain
  Pfam annotation: Domain name=PALP; Domain location=38-332; Score =101.3; E_value=3e-27; Accession=PF00291.16; Description=Pyridoxal -phosphate dependent enzyme
  Pfam annotation: Domain name=Transaldolase; Domain location=644-944; Score=617.1; E_value=1.6e-182; Accession=PF00923.10; Description =Transaldolase
  Pfam module annotation: Pfam domain module=MoCF_biosynth::PALP::Transa ldolase; Domain location=958-1111::38-332::644-944
LTDIDAMLEMDFVSRSSKILSAYIGDEIAAHQLAERVKNAFAFPAPVSQVSDDVACLELFHGPTLAFKDFGGRFMAQMLSYVSGADEQITILTATSGDTGAAVAHAFYGMENVRVVILYPQGKISPLQEKLFCTLGGNIETIAIDGDFDACQALVKQAFDDEELKKAIGLNSANSINISRLLAQICYYFEAVAQLPQEKRNQLVVSVPSGNFGDLTAGLLAKSLGLPIKRFIAATNANDTVPRFLADGQWQPNATVATLSNAMDVSQPNNWPRVEELFRRKTWRLTDLAYGAVSDETTKATMRELAELGEFGLFLGTAHPAKFKESVEEILGQPLPLPEALAARADLPLLSHAMKADFAALRVFLLKRAMIQVKLALLLAALKYQLVTLTLRRIKEITVNIKLLQLRRLRQALLNHITAHQATRLLGVETDHLELTVFLIEEHRLNQLGIQLLRLDGFEILIGGEVDQHVIALFRQRVVELLRQQVAPETVEIFAGRFASLMPISKRYGCIKSSGRSRPYRPESMRRIACRALSGEKGGCHWLKRSALRCASLSLMPISEAICAGERSRATVLAGEITISIVSVLVDPLFSGDGWEKCRDEARGDVAPLSLRDIIATAFYTLTVNLREKRTMTDKLTSLRQLTTVVADTGDIAAMKLYQPQDATTNPSLILNAAQIPEYRKLIDEAISWARQQSSNKEEQLALVSDKLAVNIGLEILKLIPGRISTEVDARLSYDTEASIAKARSLIKLYNDAGISNDRILIKLASTWQGIRAAEQLEKEGINCNLTLLFSFAQARACAEAGVFLISPFVGRILDWYKQNTDKKEYAAHEDPGVVSVSEIYNYYKQHGYETVVMGASFRNVGEIIELAGCDRLTISPGLLKELAESEGSVERKLSYSGEVKARPAKMTEAEFLWQHNQDPMAVTKLAEGIRNFAIDQGKLEKMIAELLDNSMDTLRIGLISVSDRAANGIYQDQGIPALESWLSAALATPFEIDTRLVPDEQPMIEQAICELVDERFCHLVLTTGGTGPARRDVTPDATLAVADREMPGFGEQMRQISLQFVPTAILSRQMGVIRKQSLILNLPGQPKSIKETLEGLKADDGTVKVPGIFAAVPYCLQLLEGPYVETHPKVVAAFRPKSARRETNF

SEQ ID NO: 129965 - protein, 416 aa, Glycine max
  Coding DNA Sequence Number=SeqID_38280
  Gene Ontology: Mol. function=RNA methyltransferase activity; Cellular component=intracellular; Biological process=RNA processing
  Homolog annotation: Hit_ID=A7MIJ9; Match level="QueryCoverage=53%, HitCoverage=97%, E-value=6e-75, Identity=64%"; Hit description =Putative uncharacterized protein
  Pfam annotation: Domain name=SpoU_methylase; Domain location=2-153; Score=134.0; E_value=4.2e-37; Accession=PF00588.10; Description=SpoU rRNA Methylase family
MHFPLILVSPARPENIGAAARAMKTMGFSELRIVASDAWQDPAARRVAHGAGEILDHVKTYDTLSAALADVDFSVATTARSRAKFRYYATPAQVETILQEKRQWLNRIALVFGREDSGLTNEELEQVDLLTGIPMAQDYPSLNLGQAVMVYCYQLSALHQVAAAPVEAANAQQLQALRQRFHQLLVTLDVSNDAKLADWIDQRIGLLEQRDSAMLHRLLHDVTVRADAYRKNKRKKPAPQQCGLFFRQKFRRASIMRVLKFGGTSVANAERFLRVADILESNAQQGQVATVLSAPAKITNHLVAMIEKTISGQDALPNISDAERIFAELLQGLADAQPGFDYDGLKTRVELEFAQLKQVLHGISLLGQCPDAVNAAIICRGEKLSIAIMEALLQARGHKVTVIDPVEKLLAGGPLS

SEQ ID NO: 129966 - protein, 406 aa, Glycine max
  Coding DNA Sequence Number=SeqID_38281
  Gene Ontology: Mol. function=sequence-specific DNA binding; Cellular component=intracellular; Biological process=regulation of transcription, DNA-dependent
  Homolog annotation: Hit_ID=A8G9J5; Match level="QueryCoverage=70%, HitCoverage=98%, E-value=1e-116, Identity=69%"; Hit description =Transcriptional regulator, AraC family
  Pfam annotation: Domain name=AraC_E_bind; Domain location=241-403; Score=57.3; E_value=5.2e-14; Accession=PF06445.6; Description =Bacterial transcription activator, effect
  Pfam annotation: Domain name=HTH_AraC; Domain location=124-170; Score= 52.8; E_value=1.2e-12; Accession=PF00165.14; Description=Bacterial regulatory helix-turn-helix proteins, araC family
  Pfam annotation: Domain name=HTH_AraC; Domain location=176-220; Score= 46.2; E_value=1.2e-10; Accession=PF00165.14; Description=Bacterial regulatory helix-turn-helix proteins, araC family
  Pfam module annotation: Pfam domain module=AraC_E_bind::HTH_AraC::HTH_ AraC; Domain location=241-403::124-170::176-220
MTFLVKEAHHLQLFKHQRSAFAKHHFTLRLALRDFIAKLYRSHLLTGDGRVGSIFRQTQSALNTAGFCPADITGYIFNVGVVESFHHDLMIGAKHLEYGVNGADLLGQHALTQHKCCQPGIIRDLLVWLESHLDQPLSLDNVALKAGYSKWHLQRMFKEVTGHAIGAYIRARRLSKAAVALRLTSRPILDIALQYRFDSQQTFTRAFKKQFNQTPAWYRRSSEWNSYGIRPPIRLDDYPMPQAQFVTLPETVLVGQTQSYTCTLEQISSYRDEMRIHFWKQFLLETDTVPPVLYGLHQVRASHEKDDEQEILYTTAVPADQQALSMQSNQSVILEAGEYVQFSYQGPRTALQEFILLLYGTCMPTLGLVRRQGQDIERFYTHGGKKRSEPPMEIRCEYLIPIRPQQ

SEQ ID NO: 129967 - protein, 598 aa, Glycine max
  Coding DNA Sequence Number=SeqID_38282
  Gene Ontology: Mol. function=carbon-nitrogen ligase activity, with glutamine as amido-N-donor; Cellular component=cytoplasm; Biological process=metabolic process
  Homolog annotation: Hit_ID=Q6D599; Match level="QueryCoverage=98%, HitCoverage=98%, E-value=0.0, Identity=68%"; Hit description =Probable amidase
  Pfam annotation: Domain name=Amidase; Domain location=25-436; Score =273.5; E_value=4.3e-79; Accession=PF01425.12; Description=Amidase
MASTFGFTLQDWQRCAQQDAQQIPALLAAHLDALDNQDNAWLYLASPAQLLAQVEPLLAAYQRNPAALPLFGVPFAVKDNIDVAGWPTTAACPALTYQAAADAFVVARLKAAGAIVIGKTNLDQYATGLVGTRSPYGAVSNTFNPAYVSGGSSSGSASVLARGLVGFSLGTDTAGSGRVPAGFNNIVGLKPTKGWFSASGVVPACRLNDTISVFALTVADAFSVASIAGGYDADDAYARQSPRSAPASFQPQPSLAIPAAPQFYGDQQAEAAWHSALEQLTASGATLHPIDFAPFHQLAEQLYYGPWVAERTVAVGEMLDRPEEMDPVVYGIVSSGRQYSAVEAYQAEYLRAELTRQIQQTLARFDALVVPTSPTIHTLEEMQQEPVHYNSQFGTYTNFTNLADLSALALPGPFRADGLPAGITLIAPAWHDRALATFGLRWQQQLALPLGATGKALPPQPAALPPSPDHVRVAVVGAHLTGMPLNFQLTTRQAVWVEETQTASHYRLFALLDGPIKKPGLLHGDSGAAITVELWDIPLARFGEFVAEIPAPLGIGSLTLADGRIVKGFICEPAALTQALEITEFGGWRNWLTSQGNH

SEQ ID NO: 129968 - protein, 54 aa, Glycine max
  Coding DNA Sequence Number=SeqID_38283
MDAMVVIIKKGEIVEASFMMMNQVDSSSFDDDKDDDKKLKRMISRLSQQVQDQD

SEQ ID NO: 129969 - protein, 189 aa, Glycine max
  Coding DNA Sequence Number=SeqID_38284
EDEEVQALRTELKQAQTVKERARREEHGRNKFRGALWGSNRELKLQREERDQSRVDSLILKDELKACSRSKRSLSQRLCETETNMLAIITKYQEELSLATTHEHRVADEYAQVYAEKEARGRVIDSLHEEATMWMDRYALTLNGSQELPRLLAKAKAMADTYSAPEEIHGLLDYCQHMIDLMARIIRNC

SEQ ID NO: 129970 - protein, 72 aa, Glycine max
  Coding DNA Sequence Number=SeqID_38285
LVIDYQRLPKFPDFVFKPGNRLHPLELACLGTSQVLTDRLCPGWVGIGQAWFWTIAPLLTSSRSPDPRDIFS

SEQ ID NO: 129971 - protein, 323 aa, Glycine max
  Coding DNA Sequence Number=SeqID_38286
  Gene Ontology: Cellular component=viral envelope
  Homolog annotation: Hit_ID=Q84VI1; Match level="QueryCoverage=100%, HitCoverage=60%, E-value=1e-103, Identity=92%"; Hit description =Envelope-like protein
MDKKIRSIVSSILKDASVPEADEDVPTSSNPNVSVPDVKKDVPTSSAPNAEALPSPSEEGSTEEDDQAAEETPAPRAPEPAPGNLIDLEEVESDEEPIANRLAPGIAERLQSRKGKTPLKRLALERELGRAALDCKEIMDLIKAAGLLKTVSKLGDCYEGLVREFIVNIPSDISNRKSDEYQKVFVRGKCVKFSPAVINKYLGRPTDGVIDIAVSEHQIAKEITAKQVQYWPKKGKLSAGKLSVKYAILHRIGAANWVPTNHTSTIATGLGKFLYAVGTKSKFNFGNYIFDQTVKHSESFAVKLPIAFPTVLCGIMLSQHPNM

SEQ ID NO: 129972 - protein, 77 aa, Glycine max
  Coding DNA Sequence Number=SeqID_38287
MTEARQKGVRKVNENENKIEDRRKRRTNDECQRTVENLRVITHGNVIETLRKRLGLYFLHGNNFPQQFQENTKCQEG

SEQ ID NO: 129973 - protein, 316 aa, Glycine max
  Coding DNA Sequence Number=SeqID_38288
  Homolog annotation: Hit_ID=Q6WAY6; Match level="QueryCoverage=89%, HitCoverage=51%, E-value=4e-35, Identity=33%"; Hit description =Putative uncharacterized protein
MGTNQNGKRFYQVKVKSLDVTSLNELGRLMGPLQRQAFRKVYGKILDLTVAEVFTEAVLSLTQYYDQPLRCFMFGDFQMVPTIEDKIAAVVEDSAKELDRMKQTRNSVVGLPRKYLEGKARDMASQEKWGPFADILALLIFGVVLFPNVDGLVDLATIDAFLAYHHGKESPVVAILADLFDTFDRRCEKNSARIVCCLPALCVWLVSHLFQQDTRHPCPLQSYRSCAEKGRVDWDQHLAGIGGNAINWFPRWKEGKEGVLFSCGDYPNVLLIGTRGCINYNPALAIRQLGYPMRGAPTEGSLSPFLVKDLGAQGLK

SEQ ID NO: 129974 - protein, 160 aa, Glycine max
  Coding DNA Sequence Number=SeqID_38289
  Homolog annotation: Hit_ID=Q84VH5; Match level="QueryCoverage=74%, HitCoverage=28%, E-value=5e-26, Identity=99%"; Hit description =Envelope-like protein
IAVSEHQIAKEITAKQVQHWPKKGKLSAGKLSVKYAILHRIGAANWVPTNHTSTVATGDTCPRHCLDIRKAAASGAVSKDALIAELKDTCKVLEATIKATTEKKMELERLIKRLSDSGIDDGEAAEEEEEAAEEEEEAAEEEEDAAEDTESDDDDSDATP

SEQ ID NO: 129975 - protein, 85 aa, Glycine max
  Coding DNA Sequence Number=SeqID_38290
  Subcellular localization annotation: CTP_CleavageSite=40; ConfidenceScore=5.24e-01
MSFSLGSLLNQLSDLSSLTGSGVYPDLSSLFGSGVYPDLSSFTGSGVYPDLSSFTGSGVIQIFVACIKRSAPTQVHIIWYQSFGS

SEQ ID NO: 129976 - protein, 137 aa, Glycine max
  Coding DNA Sequence Number=SeqID_38291
MRKNLNFGTDISHHSTSVNDEGTSHKDPLRELRKEKHASYSSHNSCKSLSEELRDYYEGRHRAHIRPHSHWRERERKPQEANINLPYFHGKDNVEANLDCEIRVEQQLKKEVYFKILWLSLLSKERPRLRHLRGDTF

SEQ ID NO: 129977 - protein, 28 aa, Glycine max
  Coding DNA Sequence Number=SeqID_38292
MVEDTLSYPNFVRGPLLDDMRPFFGPCE

SEQ ID NO: 129978 - protein, 50 aa, Glycine max
  Coding DNA Sequence Number=SeqID_38293
MNLLSEHAALSKFISTHCIEAFFEELAKRAYRAKRVHPLRMNTHPLAELP

SEQ ID NO: 129979 - protein, 143 aa, Glycine max
  Coding DNA Sequence Number=SeqID_38294
  Gene Ontology: Mol. function=hydrolase activity
  Homolog annotation: Hit_ID=A8G7P6; Match level="QueryCoverage=99%, HitCoverage=53%, E-value=2e-46, Identity=58%"; Hit description=Beta -lactamase domain protein
MECYRQPFAISERLLWSGEIVVNRPQSFGVLASSPLTPDYIVDEGVLIYLSNHGLVIICGCGHRGVENIVRHCQNITGIERVHALIGGLHLRAASVARVWQVRSYLQQLQVEKILACHCTGAWGKLWLAGAQAPATGDILQLA

SEQ ID NO: 129980 - protein, 98 aa, Glycine max
  Coding DNA Sequence Number=SeqID_38295
MMENLHGFTHENISEALRKHLGLDFLHGNNFFHPKQKKGEEVAAQLAQASWVASSRSNPASKILWKGYGNFTEALRKSRKPFFNKTGEVVAAQLAQAS

SEQ ID NO: 129981 - protein, 418 aa, Glycine max
  Coding DNA Sequence Number=SeqID_38296
  Homolog annotation: Hit_ID=Q6WAY4; Match level="QueryCoverage=74%, HitCoverage=55%, E-value=5e-15, Identity=25%"; Hit description =Putative uncharacterized protein
LFDTFDRRCEKNSARIVCCLPALCVWLVSHLFQQDTRHPCPLQSYRSCAEKGRVDWDQHLAGIGGNAINWFPRWKEGKEGVLFSCGDYPNVPLIGTRGCINYNPALAIRQLGYPMRGAPTEESLSPFLMRDLGAQSLKVIQRVHKAWRSPLRKDKELKGIRNGVIGGYHGWLRVHTRGLDWLSKLKVINEENFEALEEDEEVRALKLELGKARLAKEKFKSAATHIRKECTELQEENAATARALERETKRACKEEYGREKFQRALWGSNNELKLRREERDRSQVHGMILKEELAACARSKRNLAQHLEATEQSMLAIIGQYKEELSQSVTHEQKLVEDFAQVYAEKEARGRVIDALHQEATMWMDRFALTLNGSQDLPRLLAKAKAMAEVCTAPEEINGLINYCQHMIDLMAHIIRNR

SEQ ID NO: 129982 - protein, 150 aa, Glycine max
  Coding DNA Sequence Number=SeqID_38297
  Homolog annotation: Hit_ID=A2Q7P4; Match level="QueryCoverage=89%, HitCoverage=18%, E-value=1e-47, Identity=67%"; Hit description =Putative uncharacterized protein
MAANTVVGTRGWHSPKNGERLSKRDSGEVNVPVTLWSQHIEYRLPYAIPAFILLALCIALGAWSIWLLILRRVGLKQMRTYLARTSPGRILGHALHEDQGNILASTDVWLQQIGLRKVTLPGRNEDSEIPLLDVQRTLTHEDGGGDKSSK

SEQ ID NO: 129983 - protein, 38 aa, Glycine max
  Coding DNA Sequence Number=SeqID_38298
MWTTTGEVVAAQLAQASSARLGEPGCFLQKQPPPGGIF

SEQ ID NO: 129984 - protein, 74 aa, Glycine max
  Coding DNA Sequence Number=SeqID_38299
  Gene Ontology: Mol. function=aspartic-type endopeptidase activity; Biological process=RNA-dependent DNA replication
  Homolog annotation: Hit_ID=Q69F85; Match level="QueryCoverage=78%, HitCoverage=3%, E-value=6e-10, Identity=55%"; Hit description=Gag -pol polyprotein
MVIFHHGDAAEDKGEERMRGEARKDPAKGKLPLKWEGPFRVTTTLQNGEYQLDELDGKVIPRIWDATHLKPYCS

SEQ ID NO: 129985 - protein, 151 aa, Glycine max
  Coding DNA Sequence Number=SeqID_38300
MEACCRPAEVSIVQKKCMTRGNPSDLQPFDPEIDRTFHRLVRHHFIPFDHSEHSITSESMHSVIGDFEHPDLEHYNFEHSDSEHSDFAHSENMAQPPPRERTLREMAAPDFTYESLCIQYPNEDVLYVLKTGQIHLLPKFHGLAGEDPHKH

SEQ ID NO: 129986 - protein, 60 aa, Glycine max
  Coding DNA Sequence Number=SeqID_38301
MDKRIKIHETKCGPPRQNREKLAAQLAQASKVASSRSNSLLEEGSGRPKWARLLFAPPFY

SEQ ID NO: 129987 - protein, 149 aa, Glycine max
  Coding DNA Sequence Number=SeqID_38302
MASKKRKAPSTPSQVRYNQSRFTSQEGWERYTYIIVPRKLLPEKNVVIYHTEFNEIKKELMIRQWDEELTSFDEGNIDVAITPVIVEEGENLYVYSRFALLRPDPQEIAAKLCIPGRGFKLNVDGLPLMILRKNMTTLAQTWSVLSIVT

SEQ ID NO: 129988 - protein, 60 aa, Glycine max
  Coding DNA Sequence Number=SeqID_38303
KNVMHLLVVERAVQNEFWMFSSRSQRVFCLCPVLLGCDSLCCLNVALLGCCGSLGGLMGT

SEQ ID NO: 129989 - protein, 173 aa, Glycine max
  Coding DNA Sequence Number=SeqID_38304
SALDSEEHIGEWRNPIGKIRSALDGSALDGEEHIGEWRNPIGKITKITFANQEGSLLTVKSTLENGGFNRENNKDNISQSRGSALDGSALHGEEHIGEWRNPIGKITKITFPSQEGPLLTVMNTLENVDINRENNKDHISQSRGSALDGSALDSEEHIGEWRNPIGKIRSALD

SEQ ID NO: 129990 - protein, 168 aa, Glycine max
  Coding DNA Sequence Number=SeqID_38305
ARKEEHGREKFRGALWGSNSELKLRREERDQSRAHSMVLKEELAACSKSKRNLSQRLCETETSMLAIINKYQEELNLAMAHEHKVADEYDQVYAEKEARGRVIDSLHQEATMWKHRFALTLNGSQELPRLLAKAKAMADTYSAAEEIHRLLSYCQHMIDLMAHIIRNR

SEQ ID NO: 129991 - protein, 40 aa, Glycine max
  Coding DNA Sequence Number=SeqID_38306
MTHCNRLQVLVIDYMPNKPSGCLFMCNRLHWMVIDYQSLS

SEQ ID NO: 129992 - protein, 241 aa, Glycine max
  Coding DNA Sequence Number=SeqID_38307
  Gene Ontology: Mol. function=transaminase activity; Biological process=mitochondrial electron transport, ubiquinol to cytochrome c
  Homolog annotation: Hit_ID=Q2R0G4; Match level="QueryCoverage=74%, HitCoverage=19%, E-value=1e-17, Identity=35%"; Hit description =Putative uncharacterized protein
  Pfam annotation: Domain name=DUF1723; Domain location=105-154; Score =40.1; E_value=7.8e-09; Accession=PF08330.1; Description=Protein of unknown function (DUF1723)
MSQGQAVPFGWEVGNTLQSGMMEKRWSQNHMATQNRQKPGNQRIFDSEPYNFNCLSKPNKLFRSAPSIAHRDYLPWLDRVEQAYEDFWKTYGIFDLIQFSRSGPEYRPEMLIAAMHFFESSTNTFQFKCGMMTPTLLDVAALTGLRPSGETYDPTNSSDNIKLVYKENTFSKYIAEHKGPVEEEVSDEEHVAFLTLWLSHYVFCSKSLQVAKRFIPMALQIHEGQNFGFGRLLLAVLYESL

SEQ ID NO: 129993 - protein, 110 aa, Glycine max
  Coding DNA Sequence Number=SeqID_38308
GCKHANAVGHATQPRDIGYLGRQRADVGGLLLPFAWRRIPPWNCVAVLINLLGGRHVLQRLGPARPTRLDGINFSPSMIGKRAFFGGVARGFPWYAQVASGLYHFRKGGW

SEQ ID NO: 129994 - protein, 72 aa, Glycine max
  Coding DNA Sequence Number=SeqID_38309
MGYVGVRELSWRWATGDGGFMRALWMWKNLLCTIARPPPSTTCDGVKLPAFIVDHRVVPGDMSRGSGDLGDV

SEQ ID NO: 129995 - protein, 116 aa, Glycine max
  Coding DNA Sequence Number=SeqID_38310
  Homolog annotation: Hit_ID=UPI0000ECBAF8; Match level="QueryCoverage =45%, HitCoverage=62%, E-value=2e-22, Identity=96%"; Hit description =UPI0000ECBAF8 related cluster
MTMITPSSKLTLTKGNKSCGRHRGGAPIRPIVSRITIHWPSFYNVVTGKTLALPNLIALQHIPLSPAGVIAKRPAPIAPSQQLRSLNGEWDAPCSGALSAGGCGGYAQRDRYTCQR

SEQ ID NO: 129996 - protein, 212 aa, Glycine max
  Coding DNA Sequence Number=SeqID_38311
MTQKLVARGDTLRLSAPRHPVIPSVIDERRPMWSSAPFPEVLAFSGGDFFKSHKLSRTTTLVSSRGGGPDDRGDTLRLSAPFVIQEAAGPMTSRDKIVVICTLVSFPEAAGPMIRGDFSSLTSYLEPTVIRTLVSSRGGGPDDTRRYLTVIRTLVSSRGGGPDDTRRYLTVIRTLVSSRGGGPDDTRKYPSGYPYKHSFAICKTKRLIACRG

SEQ ID NO: 129997 - protein, 275 aa, Glycine max
  Coding DNA Sequence Number=SeqID_38312
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GPGASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHIYTRAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 129998 - protein, 153 aa, Glycine max
  Coding DNA Sequence Number=SeqID_38313
MMRQEHVDMILEVLSLKYHSVIVIIESKFETQPLEQVEALLLAHEPRMIKFKQCLAESPLINFTHSQTTNKSYSHQDPERFSNVRAKEKGLKPTFDCHRARDVYLFTDIISQIPTEEFYLDGFECSGKKIGFWERGRKNGFERKRECRYISEM

SEQ ID NO: 129999 - protein, 151 aa, Glycine max
  Coding DNA Sequence Number=SeqID_38314
  Subcellular localization annotation: CTP_CleavageSite=61; ConfidenceScore=5.47e-01
MPRPAPAAPCPASHGRCAKCCASNWLISASYCSVQSTALPPPISISRFRALTVNDTLMVLRCASAATARQTLIIRLAQTQRQHAVTLAVIVKNAGEAGADNRADAQLIQPPHRMFAAGAAAKIGTDQQKRRVLPARLIKDEIRPAAVPACR

SEQ ID NO: 130000 - protein, 138 aa, Glycine max
  Coding DNA Sequence Number=SeqID_38315
MSLPSAVHVFSIIKCEASGDWEARYSVVFQIGSFAKYKKKEEVEMRVVIAKRAGRTKSVSYLCFPLISDESLEACQKSQGSRLARSVKFRNVAEIEKRGVQIAIWPTWAFQILPPEGCCFWRKQPCSPGRAEVAWASW

SEQ ID NO: 130001 - protein, 69 aa, Glycine max
  Coding DNA Sequence Number=SeqID_38316
  Subcellular localization annotation: CTP_CleavageSite=50; ConfidenceScore=5.11e-01
MVQLSAHRCAKPNIFTVSCTLSSGLSVDVIESALSAGSSAKPESLTKMLSAAAVLSPKCLLEVTTSIWA

SEQ ID NO: 130002 - protein, 181 aa, Glycine max
  Coding DNA Sequence Number=SeqID_38317
  Homolog annotation: Hit_ID=Q6WAY3; Match level="QueryCoverage=86%, HitCoverage=6%, E-value=5e-08, Identity=30%"; Hit description =Gag/pol polyprotein
  Pfam annotation: Domain name=G-patch; Domain location=1-42; Score =20.0; E_value=0.00072; Accession=PF01585.14; Description=G-patch domain
MVVRVMLRNGFEPGMGLGKDCLGNADVVDIKGNPYKYGLGYEPGMPGGRNVPSRFRADRVWPGRISQCFTSAGMVSEEEVAAIEEEFPQDPPSFVQPCHPDSQVGNWRVISHSEVYAADSICEGRFFEDPNNDQGLTIDFDRDISQTMNEEEEDDILSPELERLVAQEEREMKPHQEKPNW

SEQ ID NO: 130003 - protein, 156 aa, Glycine max
  Coding DNA Sequence Number=SeqID_38318
MTCFRNKDHEGSIAAYRKPSIKVDFIHKSLEFSVVYKSKGETKDIELVEEEQARVGVDPSSETSNKSENYKEEARNATQKHKPKKNKTGDSTVLKIGNSGKVVINQDMKGRRHKYGFNNNKHEKAKKKRVVDDEAGDKHQLDEVLRIPCTCVFLKI

SEQ ID NO: 130004 - protein, 67 aa, Glycine max
  Coding DNA Sequence Number=SeqID_38319
MNYTPSYGKTWLAKQRVLEMIHGNWKESYAKLSKLLRALQFCVPKTVGVAQTESVFEGENHTGQKNA

SEQ ID NO: 130005 - protein, 202 aa, Glycine max
  Coding DNA Sequence Number=SeqID_38320
MGDQEETQEQMKADMNEAAHGEKRGDRCRCQFGCRSRPNSLGNCAPSSLKHSRTREGTHWGTMATLTWDTTERLTLMDCRPTTHHPSCKTMRAILLLPSLKESLLNSPDEVHKDPQDYARRDVEFYPPIPEGPAPSTLPQPNITTQPIVSSTEGPPPATEERKKLDLLEERLRAVEGFGDYPFADMTDLCLVPDVVIPPKFK

SEQ ID NO: 130006 - protein, 125 aa, Glycine max
  Coding DNA Sequence Number=SeqID_38321
  Subcellular localization annotation: CTP_CleavageSite=50; ConfidenceScore=5.12e-01
MVKVGTSYVPINVSFSPKVGPGLPGINRDTRIYLSLRRLPGFCFYQLSLRSATDGVVRNFEPGVIMGANSHSIQAALNCSGKGRSVRAFAINESPTRRKGDVLVAISWVARVSHTGYYVVKLRGQ

SEQ ID NO: 130007 - protein, 120 aa, Glycine max
  Coding DNA Sequence Number=SeqID_38322
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLGDCAPPSQARDYAQTKTISRRSSY

SEQ ID NO: 130008 - protein, 276 aa, Glycine max
  Coding DNA Sequence Number=SeqID_38323
  Homolog annotation: Hit_ID=Q6WAY6; Match level="QueryCoverage=70%, HitCoverage=32%, E-value=5e-07, Identity=24%"; Hit description =Putative uncharacterized protein
ANWDQLLASMERRLLIGSLAGRKEESGFYSHAKEVQMSLVGTRGCINYNPTLAIRQLGYPMRGAPTEESMSPFLVRDLGAQNSKIIQRIHKAWETPLRKDQEIRGIRNGIIGGYHEWLKVGIRGLDWLAKLKVVREEDFEAPEEDEEVQALKRELGKAKLPKEKFKSIAIKGSNSKIKLRRGERNHHGAIIDKCKEKLNLAATHEQRLEDEYAKISAEREVRERVIDSLHQEATMWTDRFALTLNKSQELPRFLAKAKAMADTYSAPKEIHELLSY

SEQ ID NO: 130009 - protein, 141 aa, Glycine max
  Coding DNA Sequence Number=SeqID_38324
MPQNVLYDAIGIYQRCWNLLRADQRLIFAKKLAQGFPGINRDTRILFILRSDLPSQHRRTSALASVAVTLRVTTTPAALNAPLQGASHSPFRLRNCWEGRSVRASSLLRQLAKGGCAARRLSWVTPGFSQSRRCKTTASEL

SEQ ID NO: 130010 - protein, 79 aa, Glycine max
  Coding DNA Sequence Number=SeqID_38325
  Homolog annotation: Hit_ID=A5BTR2; Match level="QueryCoverage=73%, HitCoverage=4%, E-value=2e-14, Identity=58%"; Hit description =Putative uncharacterized protein
MNHLQSLMKVAQLMLRYISGGRWERSNRLNVMFIKTKISTRIRGSIDQHEKTLASTLIMKFSSLRLTSVKGVHKYIMKM

SEQ ID NO: 130011 - protein, 173 aa, Glycine max
  Coding DNA Sequence Number=SeqID_38326
MARTKKTGEITTEAAKEIAEKIDSFEEQATQGSFVPHGRPDVLAAAIGHPEHPGRVRAAGAGVTIKQYFGSAPRTSHSASSMPPYELQQLTQQIRDQLEESITEKVTRQVSVEEVTDTDAPVPVPTDEVSLVGQALHTFLAWPTHLVKSLSQQLCLHPNHLRSPIRRSMICFI

SEQ ID NO: 130012 - protein, 154 aa, Glycine max
  Coding DNA Sequence Number=SeqID_38327
MYHHEVRVILLIKGFKYTVANFSVSPPKPPPKPDLEVDDPLYLMTLTIPELFLRPYQVRWDATVFGVVNPDFPLYIKHEDLSEIAHGGQCLSISVLQLWILHLTETCMRAGNSDIYGFLEPQSIQRSRQSQFESESYIKSGCRVHNAMCILEPT

SEQ ID NO: 130013 - protein, 69 aa, Glycine max
  Coding DNA Sequence Number=SeqID_38328
MLEVVSNPWRFIVGNWLCDSDLVSPTGIERVLTEKDLLADAYSDLEASILDEKEFLLLKGWGIDGVPSP

SEQ ID NO: 130014 - protein, 76 aa, Glycine max
  Coding DNA Sequence Number=SeqID_38329
MLKPPERAQMTTLASAPQSHLGSLNDEVRITVRCLRGLPAFGSWVTKSGCGPQKQGFCSYVSSNEGTQTSVVLDNL

SEQ ID NO: 130015 - protein, 334 aa, Glycine max
  Coding DNA Sequence Number=SeqID_38330
  Homolog annotation: Hit_ID=Q2HW90; Match level="QueryCoverage=55%, HitCoverage=35%, E-value=7e-17, Identity=33%"; Hit description =Putative uncharacterized protein
LAAIDAFLAYHHSKESPVVAVLADLFDTFDRRCEKSSARIICCLSALCVWLISHLFRQDTRHPCPHLSHRSCTEKRRIDWDQLLAGIGGRTISWFPRWKEGKEGVLFSCGRYPNIPLVGTRGCINYNPALAIRQLGYPMRGAPTGESMSPFLVRDFGAQNSKTIQRIHKAWETPLKKDQELRGIRNGIIGGYHEWLKVHIRGLDWLAKLKVVSKESFEASEEDEEVQALKSELGKAKLAKEKFKLAATHVRKECAGLREENAITARALEQETKRARKEEYGRNKFRGALWGSKRSLSQRLCETETNMLAIIAKYQEELGVATAHEHRIADEYAP

SEQ ID NO: 130016 - protein, 198 aa, Glycine max
  Coding DNA Sequence Number=SeqID_38331
MATRPRLAFRGQHIIAIRGLHVFVLRGLHVPAFRGLHNLAFRGLRVLAFTGLQVLAFTGTHFLVFRGLNVLTIRGLHVLAFRGLHVLAFKGLHALAFKGLHALTIRRLPALAKLSEDKTSSPSEDYTSSPSERYTPSTLEDYTSSPSEDYTSSSSEDYTSSPSEDYTSSPSEDYTSWPSEGYTSLPSEGYTSSPWDPL

SEQ ID NO: 130017 - protein, 90 aa, Glycine max
  Coding DNA Sequence Number=SeqID_38332
MGEVKEIQEKMKADMEAIKEKMATMMEAMMSVKKIMEAHAVAIAATSVVAKIEVDLKRGKFNHPAWTNEKTGANKEGEDEGETHAVTAIP

SEQ ID NO: 130018 - protein, 92 aa, Glycine max
  Coding DNA Sequence Number=SeqID_38333
  Subcellular localization annotation: CTP_CleavageSite=50; ConfidenceScore=5.72e-01
MLVRMIRTRLFAAARVKSCPSMHSSSVIASLSSCARTVGPPPISGVPKVRACSPLKARTCSPLEVRACSPLMVRTCSPLKARTCSPLNGEGN

SEQ ID NO: 130019 - protein, 104 aa, Glycine max
  Coding DNA Sequence Number=SeqID_38334
MGEELATQLAQASKVASSKSNSLLEEESERPKGQMSYRMSRHHASEHADCMCPYEQIKQVNNTRELFTQFGATSPTSGAPSQGGNPLSIVLVQGLTAPVYNLLT

SEQ ID NO: 130020 - protein, 318 aa, Glycine max
  Coding DNA Sequence Number=SeqID_38335
  Homolog annotation: Hit_ID=Q652R5; Match level="QueryCoverage=73%, HitCoverage=90%, E-value=2e-22, Identity=37%"; Hit description =Putative uncharacterized protein P0603C10.50
MAHLGALDSMARLNRAAAPSYLFKNSPAGSSYPEGNFGGNQLLDGSISLSPLYPSQTNDLHVSIAAGLHQSFLWLRPAQHSSPSFGPDRYALTRTLHRRSGSVGGATHRGIPPISFLAPYGVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFS

SEQ ID NO: 130021 - protein, 69 aa, Glycine max
  Coding DNA Sequence Number=SeqID_38336
MGTNQTGKRFYQVKVKSPDTTSIKELGRLMEPLQMQAFRKTYGKILELTIAESNSCSPGDPLVLERPPP

SEQ ID NO: 130022 - protein, 90 aa, Glycine max
  Coding DNA Sequence Number=SeqID_38337
MGYMGIIEDFYQQRTMRLGVYEQFKQRDPCWSFIQLLDYLKLALLDEAKELMDLFQTPLTTGGSTYFEGVATSVGSWTMGAFPLEGNSAG

SEQ ID NO: 130023 - protein, 84 aa, Glycine max
  Coding DNA Sequence Number=SeqID_38338
MGHLSDQGVPMNPKRIKVIPEWPTPPSIRKIWDFHNLTNFHDVSSIGACRPRIFFINGFLCFLEDKWQQNAEGRQRGDATSRRR

SEQ ID NO: 130024 - protein, 188 aa, Glycine max
  Coding DNA Sequence Number=SeqID_38339
  Homolog annotation: Hit_ID=A5BT20; Match level="QueryCoverage=55%, HitCoverage=22%, E-value=3e-08, Identity=35%"; Hit description =Putative uncharacterized protein
FSNSRSSANSLVTGDEAITNDQTQQIEPKEIRFSPEQYKALLALIQQPSEGNSDSMSSSSKQIASCSVDTTPVHDSGATDHVSASLSSFKSYTKLNPPILVKLPNGHHVSATHSGDDALTQAKIGIVEMRNGLYYLTPTRPATCSIETEIVHPNCTIIPIDLWHSRLGHLSFERLQKMQGTYPFLEIQ

SEQ ID NO: 130025 - protein, 289 aa, Glycine max
  Coding DNA Sequence Number=SeqID_38340
  Homolog annotation: Hit_ID=A5B939; Match level="QueryCoverage=17%, HitCoverage=44%, E-value=2e-07, Identity=50%"; Hit description =Putative uncharacterized protein
VSLRIAGARGDLYRDGAAALLSRALESRAPSGPFLENKNWRCGMNRKLGYGAQLRANLDPTKGVGRLRQQDGGHGSRNPLRECVTTHLPNQLAPKMDGAKARDLYPAGASPGGAVVGADLGGTGEARLIALCARTPKGIGLPHPGNGSAGGRVSGWKSTARRVVSASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 130026 - protein, 124 aa, Glycine max
  Coding DNA Sequence Number=SeqID_38341
  Subcellular localization annotation: CTP_CleavageSite=20; ConfidenceScore=5.07e-01
HRRTSALAKCSGHAARNPTPAALNAPLQGASPFAIQAAQLLGRAIGAGLFAITPAGERGMCCKAIKLGNASVFPEFDQNATHNTADLLIHLRVYFPRTCCKARVVPGAEMMVQRVNQELKFLLV

SEQ ID NO: 130027 - protein, 71 aa, Glycine max
  Coding DNA Sequence Number=SeqID_38342
  Subcellular localization annotation: CTP_CleavageSite=34; ConfidenceScore=5.34e-01
MATVFTLYPFPKDVRDLLADTTKKVSFANPFIARSQAVTNVVTSTLSRDVSVFRTEHYEKASFAIRKTNAR

SEQ ID NO: 130028 - protein, 174 aa, Glycine max
  Coding DNA Sequence Number=SeqID_38343
MDNEEGVQEQMKADLSALKDQMASISEVMLKLQKTIEDKATATASSTVREAEPMLQPALNPGLDRNTVRVRSKGQLPPYEDYPGQDDGERDTHLGPLLHLKDPSPHELPQPNIVRHIPASPTPVKESVPFAEDKEKIEALEERLRAVEGLGNYPFSDLADLCLVPNIVIPPKFK

SEQ ID NO: 130029 - protein, 138 aa, Glycine max
  Coding DNA Sequence Number=SeqID_38344
ERSGYKYIEQLTEMPQNVLYDAIGYINGVGTSYVPINVSFSPKSWPGLSRASGDAANFTDLVYDGVFEVLPVASVFYQLSPPCSATDGGGRVPFAIQAAQLLGRAIGAGLFAITPAGERGMCCKAIKLGNARVFPVTT

SEQ ID NO: 130030 - protein, 151 aa, Glycine max
  Coding DNA Sequence Number=SeqID_38345
LGRIDGDPVLRETRDMGLRGSPPPSVGGGQQGMVGFMRALWMWKTLLCTIARPPPSTTCDGVVPGDMSRGSGDLGDVRRAPGSQQIKGTKTTKQGGLWWLASCESCVIYGLWPLVIDYQGLENEVVEASGNRLPVCVIDYTEEWVTGNRLP

SEQ ID NO: 130031 - protein, 219 aa, Glycine max
  Coding DNA Sequence Number=SeqID_38346
GGALGDMTPVEARNLIEKMASNSQQFSARNDAIVLRGVHDVATDSYSSAENKKLEGKLDALVNLQSGVNEQPEAYAANIYNRSPQPYVPPPMQQQQQRQQATKAPSQPSLEELVRQMTIQNMQFQQETRASIQSLTNQMGQMATQSQNSDKLSSQTVQNPKNVSAITLRSGKQIEVPPPVAAPAPEPVKLHSTPEKEDELAAQKRKLPDHEGANKNFHA

SEQ ID NO: 130032 - protein, 247 aa, Glycine max
  Coding DNA Sequence Number=SeqID_38347
  Homolog annotation: Hit_ID=A0H805; Match level="QueryCoverage=92%, HitCoverage=24%, E-value=2e-07, Identity=26%"; Hit description =Putative uncharacterized protein
MASAVLERRRSALQERAGAFAHVLGGEQQAELRAFVLQPCLQAAFATHVHGIQQATQGQRRRARQLAGDILHTVVQRVGGYHLVDDAQFQRTRGVDRCTQQAQLQGGGAAAQAQQTLAAAEAGNQAQIDLRLPDLGRIGSDAQVAGHGQLQPAAQGEAVHARDHRLGHALDLAHQGLAEQGEITSLNRTECVHLGDVGPGHERLRTGTGQHHHAHVRVGSGGAERFGQRLQGRGIQGVELVRALDGH

SEQ ID NO: 130033 - protein, 220 aa, Glycine max
  Coding DNA Sequence Number=SeqID_38348
  Pfam annotation: Domain name=Transposase_23; Domain location=100-170; Score=5.7; E_value=0.00028; Accession=PF03017.5; Description =TNP1ENSPM transposase
TTAIGRPEHPGRVRATGAGVTIKQYFGSAPRTSCGSSSLPPEELQQLTQQIKDQLEESITEKVTRQLMASFSQMQSQMQSQGLALPPEPPLGPSGNDPETGDSDRCGLYIEANPARLVALGRVYEGSTVVHNTPLLPGQVKVGVEEVKDPDAPILVPTNEVSLVGHAIHTFLVWPTHLVKFLSQQTVVSLAKPPQKPNPEVDDPLYLMTLTIPELFLRPY

SEQ ID NO: 130034 - protein, 184 aa, Glycine max
  Coding DNA Sequence Number=SeqID_38349
  Homolog annotation: Hit_ID=Q2HSV3; Match level="QueryCoverage=98%, HitCoverage=26%, E-value=2e-14, Identity=30%"; Hit description=IMP dehydrogenase/GMP reductase, putative
AHMKGITGAPYRARCDGLTVTDVSWLPYTEHRGVRAFQEISSFQGQLRCGPMIVTVRPERVVRQFGYIQSIPPPPVSARLSHDQIDDRWMEFADHLLPAGQLCLVPGQVSADYMEWFFRISHPFMTPTQAGDQQMDAPAADPEDYIQPPSPQDDYEGYEAIAQRLERVLNLRIVIAGTELYDIM

SEQ ID NO: 130035 - protein, 69 aa, Glycine max
  Coding DNA Sequence Number=SeqID_38350
MRLSLCLDNETKGPADKPYRMTKLGLCLSSGPPPLDDKRVRITIRYLRVSWVQNDQTWSLLVIGPAASG

SEQ ID NO: 130036 - protein, 167 aa, Glycine max
  Coding DNA Sequence Number=SeqID_38351
ALRRLYEGSTTVHNIPLSHDQVKVGVEEVRDADALISIPTQEVQLVGQTLNTFVAWPTHLVKRLLEQVMWDATVFGVFNDNFPFYIKYEDLSKTTHGGQCLIISVIQLWILHMTETSMRAGNVDVYRFLEPQSIQRSGQSQFESESYIMNWMHNSKRDVYLGAYLNG

SEQ ID NO: 130037 - protein, 186 aa, Glycine max
  Coding DNA Sequence Number=SeqID_38352
  Gene Ontology: Mol. function=RNA-directed DNA polymerase activity; Biological process=RNA-dependent DNA replication
  Homolog annotation: Hit_ID=Q0ZCD0; Match level="QueryCoverage=97%, HitCoverage=16%, E-value=8e-10, Identity=26%"; Hit description =Integrase
MIDAASGGALGDMTPVEARNLIEKMASNSQQFSARNDAIVLRGVHEVATDSSLSTENKKLEGKLDALVNLVTQLAMNKKSTPVARVCGLCSFADHHTNLCPSLQQSGVNEQPEAYAANIYNRPPQQQNQQKQNNYDLSSNRYNPSWRNHPNLRWTSPPQQQQPIPPFQNVAGPSKPYYPPPIQQQS

SEQ ID NO: 130038 - protein, 61 aa, Glycine max
  Coding DNA Sequence Number=SeqID_38353
MGHLSDQGVPTGPKRIKVIPDWPTPPSVEGRSTEYEEPQDLRSNPFQHGGDDAILPPKGIG

SEQ ID NO: 130039 - protein, 231 aa, Glycine max
  Coding DNA Sequence Number=SeqID_38354
  Gene Ontology: Mol. function=aspartic-type endopeptidase activity; Cellular component=chromatin; Biological process=DNA integration
  Homolog annotation: Hit_ID=A5ACJ6; Match level="QueryCoverage=54%, HitCoverage=14%, E-value=1e-09, Identity=26%"; Hit description =Putative uncharacterized protein
NDSKALSTKAKGKEKEEKDSSKKNVKKENHFATKCDIKIALLLKQSFYLLLSRETSLSTAIPLELEVIPQVKELLDEGFVCKSLNPCALLVPKIGIIRHQIPMIGGMMNVLNGATLFCKITHAPNIFMICVHRDSLDSDQGLPMDPKRIKVILEWPTPPSIREILGFNDLTNFYKRFVPYFSILVAPLIELVLRKKPQSFRNLGILRSNPFQGGGNDAIILCKGIWIENSK

SEQ ID NO: 130040 - protein, 137 aa, Glycine max
  Coding DNA Sequence Number=SeqID_38355
MDISKDTDIHVILGRPFMLTASCIVDMGKRKLELGFEDQKIDFDLFVEDNPALEHNGFNLLRKGLKYNLENIFLKKSPFAKREPHAKHIFGHALSRESQALNAQPLHLRLILSAKLAKDELSQLQFDLNSSKLQPDH

SEQ ID NO: 130041 - protein, 189 aa, Glycine max
  Coding DNA Sequence Number=SeqID_38356
MGRSMIDVASGGALGDMTPVEARNLIEMMASNSQQCSAKNDAIVIRGVHEVARNSFSSAKTKKLEESVVYAPLPTTIQTIALLCSNLEQLSSLKLMLQTFTIDLLNLNSKMNHNRTIMTSLATDRIPDGGITLISDGLALNNNNSSLLLPSKMLLAQVDHTFLHQSNNNNSPRNSQQLRLLCNLPSKNL

SEQ ID NO: 130042 - protein, 64 aa, Glycine max
  Coding DNA Sequence Number=SeqID_38357
MASYGGELLSRLIFSLKWRLLFLFLSPLHCYSSSKKQRNPLMKKILGLQAPMELTSCGSIIFHS

SEQ ID NO: 130043 - protein, 150 aa, Glycine max
  Coding DNA Sequence Number=SeqID_38358
MCLPGKETMLMNFLITINEILDVSISFLTDHLEETLGPTKIEENHSKCINLTRLLSGPKTFLHISSVFFRSLIGKFLSSLFFPSSIGNFLSFFAFSPSSIGNFLSFFAFFRGQGLTFSPWVKVYGKLGFWLKACRKAGHDICQFWPAVWG

SEQ ID NO: 130044 - protein, 53 aa, Glycine max
  Coding DNA Sequence Number=SeqID_38359
MPHQNEFVGYSFIGKNLKKFDIPSGCTMDELKDLIKQVAPHEIPSYGIHETQM

SEQ ID NO: 130045 - protein, 99 aa, Glycine max
  Coding DNA Sequence Number=SeqID_38360
MTSKCGKPVNLKRDCRISEERTRAGPSGSMSLKSNKDDDVAWWFDSGVNKPFLNNYGFLERLQAYLETYEGRVHLGSRHGSFVGFGYREGIDKVNDKTA

SEQ ID NO: 130046 - protein, 133 aa, Glycine max
  Coding DNA Sequence Number=SeqID_38361
MPPTRHPLDPDKSNRALGFPALIMGLCQSFGVPVTPSKVIRLPITRAFIEKYCMPRQAQGGDPQAPDAPPPLHQADPAGSFDTERYLRHLVHQQAANHRVHVQTHDCLYQLSLSLQSQGLASFPCPTPDQFRA

SEQ ID NO: 130047 - protein, 79 aa, Glycine max
  Coding DNA Sequence Number=SeqID_38362
GRPHALRVVEGIALRKTPAVAMLKEEIEDHSRILSDLCQHRDSKPPAQTKGGGAIVKPREAEAANRFYRVPQQQLSLVA

SEQ ID NO: 130048 - protein, 36 aa, Glycine max
  Coding DNA Sequence Number=SeqID_38363
MTMHTSLNCPMSIIWRSRIERERVMRTWKGLRTRNL

SEQ ID NO: 130049 - protein, 35 aa, Glycine max
  Coding DNA Sequence Number=SeqID_38364
MSDTEFSIQSLKEICRMSDVGKEMFDRRHAVMLLF

SEQ ID NO: 130050 - protein, 235 aa, Glycine max
  Coding DNA Sequence Number=SeqID_38365
MIVNQQVKITLTHLGTKFVLHPQTPSQVAKDQLTKKNKRDEEEKLENQKKKKDSKALSSKAKGKEKEEKDQAHVAKDQAEIKLKWDEEKNRKRKEEQPLMVKEKCKEVSVSSKRLAKKESHLAIKTNIKEFSLLRQSPHLLLCKRTLVSTTIPLELEVIRQVKELLDEGLVHKSLNPCALLVPKIGIMRHQIPMIGGMMNVLSGATLFCKIIHASNIFMIHMHRDSLGWCSCGTP

SEQ ID NO: 130051 - protein, 128 aa, Glycine max
  Coding DNA Sequence Number=SeqID_38366
MHQRTSIRPHSPIHLAPLPTPRCLLAYEMLLAPSKVYQFFATKHPQVRNWLHDGRGGKPPPQLPKCLSTRLVEHKMYVLMKKPGQWHTNLAKILNESPVKTYMSNKKIHPAQKRALRSLILSSETGVV

SEQ ID NO: 130052 - protein, 108 aa, Glycine max
  Coding DNA Sequence Number=SeqID_38367
MFAYSPFAKRKPRAKRIFCHALDTYSLNIALPSNTSSLRVRYSVLTVLYYLRDPVHLTGAVEIKNEVTSKVFKVNGRQLKLFHESPQVEEEFVADLSLILPILCDDVP

SEQ ID NO: 130053 - protein, 97 aa, Glycine max
  Coding DNA Sequence Number=SeqID_38368
MSVRSLGLYGSDHIYPPHGKGPRCGQYIQWQGWSVEIVCKRLAFVTLPYMEATVAFHGMACPLACIPKEPSWTSSSMRLASFSVHASEQNHVMVALV

SEQ ID NO: 130054 - protein, 117 aa, Glycine max
  Coding DNA Sequence Number=SeqID_38369
EQATDAQNFGWQLSYPNFVRGPLLDDRRPLFGPCPLGPSRRFLQKAVASGGSNLARLGELGGNHLPYFAINRGGSEEEKAEALPKRFRNVFREEFRKGFDRSSTFFIRSSSFFDLQR

SEQ ID NO: 130055 - protein, 167 aa, Glycine max
  Coding DNA Sequence Number=SeqID_38370
MSPQGRNTWTVDDLVPYVEKITILSEEQERITEIVTHGPASERRFPPQEFHMLQSSVETRGFDRRREAVEAQEFSQQIEERDHGMYYSPPTFSQYPSQMYQYLFEGHHTNMSASEHSFGGVAETHPHFSWPTMTPSQQHDAPMATPNAPLALQWNAPGAIPDMSDLL

SEQ ID NO: 130056 - protein, 208 aa, Glycine max
  Coding DNA Sequence Number=SeqID_38371
  Gene Ontology: Mol. function=sequence-specific DNA binding; Cellular component=nucleus; Biological process=regulation of transcription, DNA-dependent
  Homolog annotation: Hit_ID=A7PQZ6; Match level="QueryCoverage=89%, HitCoverage=43%, E-value=1e-62, Identity=62%"; Hit description =Chromosome chr6 scaffold_25, whole genome shotgun sequence
  Pfam annotation: Domain name=Homeobox; Domain location=1-36; Score =12.3; E_value=0.00068; Accession=PF00046.20; Description=Homeobox domain
HKYPTEEMKLVLAEELGLTEKQISGWFCHRRLKDKRLMKDEAVANGRQDRSSGVIQDRGSGLGQDSCGSSKHADHRYLDPKEVESHGLYNHELSVADMTHGCLDPYDMEPSRHLTPNGALPPLNPKGAINMGHKPSGYLKVKGEIEHAAITAVKKQLGRHYLEDGPLLGIEFDLLPPGAFECQTADPANGSECLKIELGVIGDELFME

SEQ ID NO: 130057 - protein, 136 aa, Glycine max
  Coding DNA Sequence Number=SeqID_38372
  Homolog annotation: Hit_ID=Q6WAY3; Match level="QueryCoverage=55%, HitCoverage=3%, E-value=2e-07, Identity=43%"; Hit description =Gag/pol polyprotein
MNFAARKPVEFTPIPVSYADLLPYLLDNSMVAITPTKVHQPPFLREYDSNATCACHGEALGHSIEHCRGLKRKVQGLIDAGWLKFEENRVIFNFHQNWVQAIGLFAQATCAPEFGLPRPFNQRLLVLHVGGAVVRQ

SEQ ID NO: 130058 - protein, 200 aa, Glycine max
  Coding DNA Sequence Number=SeqID_38373
MTLLLSNIQPSDHNSDLPLPKCMPPTRHPLDPDKSNRALGFLALITGLCQSFGVLVAPSKVIRPPITRAFIEKYCIARQAQGGDPQAPDAPPPPQADPAGSFDTERYLRHLVRQQAANHRAHVQTHDSLYSLASACRVRVLLLFHALLRISSGQEVAWPGDWPEAQAGEAPAEAPGEADEVCMDEEMTDLLDFLGGSRAT

SEQ ID NO: 130059 - protein, 131 aa, Glycine max
  Coding DNA Sequence Number=SeqID_38374
  Homolog annotation: Hit_ID=Q84VH5; Match level="QueryCoverage=71%, HitCoverage=13%, E-value=3e-18, Identity=56%"; Hit description =Envelope-like protein
MLLCLMLRKDVPTSSTPSVSVPDAEKDVPTSSAPNAEALPSPSEEESTEEEDQASEETPAPRAPETAPGDLIDLEEVESDEEPIANRLAPGIAERLQGRKGKTPIERSGRIKTMAQKKSTPVTPTTSRRSK

SEQ ID NO: 130060 - protein, 43 aa, Glycine max
  Coding DNA Sequence Number=SeqID_38375
MGCSAKEKRSDEDMTKSKGKDPLEGLRGPMTWARANKAKEALQ

SEQ ID NO: 130061 - protein, 80 aa, Glycine max; identical to SEQ ID NO: 94624
  Coding DNA Sequence Number=SeqID_38376

SEQ ID NO: 130062 - protein, 83 aa, Glycine max
  Coding DNA Sequence Number=SeqID_38377
ADARILVPTQEVQLVEQTLNTFLAWATHLVKPFLEQDKLAAKGSTKPVDMSDPIVNPLYLMTLTIPQLFLKSLQVSWDATVFG

SEQ ID NO: 130063 - protein, 54 aa, Glycine max
  Coding DNA Sequence Number=SeqID_38378
MASAGSSLSCWNYRPGESCSELELGELPSGHSRYEPRSSGDVARTDGYHEVFAG

SEQ ID NO: 130064 - protein, 84 aa, Glycine max
  Coding DNA Sequence Number=SeqID_38379
SDDESLEGTNTWDPTIDFKQETDQTEGEEDEDVGLPPELEKIVSHEDQEMGPHQEETELVDLGIGSGKKEVKIGTGMTAPSVKN

SEQ ID NO: 130065 - protein, 205 aa, Glycine max
  Coding DNA Sequence Number=SeqID_38380
  Homolog annotation: Hit_ID=A7UQU7; Match level="QueryCoverage=57%, HitCoverage=19%, E-value=4e-13, Identity=33%"; Hit description=IMP dehydrogenase/GMP reductase, putative
MLLLVELLMVSADVAMVETGQCGGPYALRDLILAGRYAWGAAGLVHMYDQLNNASLSTSRQLAGYITLLQYWIYEHFSSVAECNADLDYDEVSGRTCRWIATKKTVKKVSTTTYRQRLDRLRIPDVCWMPYAEHRPMQYFHPISCFSGQLRWGLLLSDTDQRGLCASSTTSNAFLHTLSIHRCHMMTWTIRGRTTQTIWQQQVIY

SEQ ID NO: 130066 - protein, 107 aa, Glycine max
  Coding DNA Sequence Number=SeqID_38381
MSHHSSSFNGEGRHRSHLRPQSHRREKERNPQEANINLPHFLWKDNVEANLDWEIRVKQQLKRKSTSKSYGSHSYPKKDQGLGILGAPPSKPKDGKGKTIEKKPPKA

SEQ ID NO: 130067 - protein, 74 aa, Glycine max
  Coding DNA Sequence Number=SeqID_38382
MEGIKGLLCSENSQGWSHITFKVGTTSDNISSKRKTLDEASLLSSKSKTQHNHKSTSTSYVSMDPDIGRQPHPT

SEQ ID NO: 130068 - protein, 55 aa, Glycine max
  Coding DNA Sequence Number=SeqID_38383
MADEHDQRTTLEDYSSGYVPQFFTSIARPEERPRGGSTHSTTTVLKPGKKWWKNF

SEQ ID NO: 130069 - protein, 107 aa, Glycine max
  Coding DNA Sequence Number=SeqID_38384
CRLEFRSVLQSKSLVRTCSNRKERRVFKKEFPGSKEYFRSTKLRQERGLRVIGHFELVYGRVEVISEQIFTKLVRSRVMWITVLGSGYMCMQGVRSRILGVRIAFDR

SEQ ID NO: 130070 - protein, 270 aa, Glycine max
  Coding DNA Sequence Number=SeqID_38385
PRSYWTRSAGGKIKLKTPEEAMDLIENMVASDIAILRDRAHIPTKKSLLELTSQDALLAQNKLMSKQLEALYDVPFVGELMNLDVVSLLKNNPLMKSITWEISPETILMQEDFLDSNMASNTVNIRDNGGTTLEINLIEINVSIYNQKSTESAIKNLEVQVGQLAKQLADRSSSSFTANTEKNPKEKCKDVMTRRRMAIHVDESEAKKKMEDHKQQLEPKPALESISDFVELEEINEEAEDDKEEETPIKEKEKERINEEEKEKRKKVEK

SEQ ID NO: 130071 - protein, 86 aa, Glycine max
  Coding DNA Sequence Number=SeqID_38386
MTQELVARGDTLRLSAPRHSVTPSVIDEQRPMWSSAPFPKIHSRVRWHAETNYGHSAPFVNRGRQARSHAEIYIIFRTYKIYHTDF

SEQ ID NO: 130072 - protein, 80 aa, Glycine max
  Coding DNA Sequence Number=SeqID_38387
MAVRLFPAADHPNAAVVFRPAPVWGAILLDEGSISRGPDALAGGLIEARNQSWKPQGPVGLFRVHWGEIGIAVAGQNVAK

SEQ ID NO: 130073 - protein, 299 aa, Glycine max
  Coding DNA Sequence Number=SeqID_38388
  Homolog annotation: Hit_ID=Q6WAY6; Match level="QueryCoverage=98%, HitCoverage=49%, E-value=4e-34, Identity=31%"; Hit description =Putative uncharacterized protein
MAEVSTEAIAQYYDQPLRCFTFGDFQLTPTVEEFEEILGCPLGGRKLYLFSGFYPSLARISNIVKISTQELDRRKQVENGVAGVPRKCLEAKARVLASQGEWAPFMDILTLLIFGVVLFPNVDGLVDQAAINACFAFYDRKESPVVAILVDLYDTFDRRCEKNNARIICCMSALYVWLVSNFFRQEMRHVCPLEGHRSCTEKKEANWDWLLANKEGASVNWFPRWKEGRTGVLISCGKFPNVPLIGTRGCINYNPVLAIRQLGYPIRGAPSEEGLMPFITRGFNSTNAGVLQRIHKAWE

SEQ ID NO: 130074 - protein, 84 aa, Glycine max
  Coding DNA Sequence Number=SeqID_38389
MASIRLSSESKRSPTKVWSPSRRDYICTNREGSPDFDKGLRVKRDIKMLKKQGNQMGIWEWSIGLQCLMHAISHKMGPVDLSTG

SEQ ID NO: 130075 - protein, 15 aa, Glycine max
  Coding DNA Sequence Number=SeqID_38390
MARASHQWSWVVEKK

SEQ ID NO: 130076 - protein, 41 aa, Glycine max
  Coding DNA Sequence Number=SeqID_38391
MPPTFNVGQELYVGMEFDSKDAVKNELKQYVMKAWSEKIHQ

SEQ ID NO: 130077 - protein, 137 aa, Glycine max
  Coding DNA Sequence Number=SeqID_38392
GNPRALLGSSGSTGCLVGAIPANNRWHQKSVGPYAYLPMSGRHRPTDTSAGGDRHCGLSQHALSRASEARLTGALSKGGKMRGVATNVYLWKTSEKPRGTGHNENSKFGELYLRLRKVDKSGAFAPTYPPLERKSDL

SEQ ID NO: 130078 - protein, 84 aa, Glycine max
  Coding DNA Sequence Number=SeqID_38393
MESISERKNRGQGLRLGQQAKGPPPCHISRSFISAGLRHEGQVAAICEDDSSRRSDLVRPCPPGFRLGNWRVEERPDVYATSIM

SEQ ID NO: 130079 - protein, 19 aa, Glycine max
  Coding DNA Sequence Number=SeqID_38394
MEKNEETTMEEKRKIKKKR

SEQ ID NO: 130080 - protein, 56 aa, Glycine max
  Coding DNA Sequence Number=SeqID_38395
MWTTTGEMLAAQLAQASRVASSRSNNLMEESSGGPKWAWLLFAPPFLLSTPPALFW

SEQ ID NO: 130081 - protein, 97 aa, Glycine max
  Coding DNA Sequence Number=SeqID_38396
MGSKNLKDGILTCWSELKHQKRKQNAIKSGLGEQEPGCSPRQAQLAQATTFSASFSAGKGNDWVGRDPIPTCIRPYVPASRKQKSVANRVRSSSYLG

SEQ ID NO: 130082 - protein, 98 aa, Glycine max
  Coding DNA Sequence Number=SeqID_38397
MSVLELYIEKDVAGGSMFHSANSLTSCGNYVSNDYTQPPTNMSNLNLDEDDDHDDDNYLVSNSYVEELLDEDDSVDGISDTDNEVPEMIPPVNNIIQM

SEQ ID NO: 130083 - protein, 43 aa, Glycine max
  Coding DNA Sequence Number=SeqID_38398
MALEQELVRAFIIVVGFTQFVYPRVCVMWTGGGITGIGSRFFK

SEQ ID NO: 130084 - protein, 68 aa, Glycine max
  Coding DNA Sequence Number=SeqID_38399
MMTKVVNKKLKRSKNNLSESKNISSKSRTSQEFKNQGEFKTQEESLESRIKIKIQDSRFKNEEKTQSR

SEQ ID NO: 130085 - protein, 90 aa, Glycine max
  Coding DNA Sequence Number=SeqID_38400
MSHHSSSVNGKGRHRSHLRPHSHRREKERKPQEVNIKLSYFHGKDNVEANLDWEIRVEQQLKKKSTSKSDGSHSYPKKDQGQGILGGDTF

SEQ ID NO: 130086 - protein, 112 aa, Glycine max
  Coding DNA Sequence Number=SeqID_38401
  Subcellular localization annotation: CTP_CleavageSite=41; ConfidenceScore=5.08e-01
MTNTVVPVRSNKEKSTGPANGGPITLLAAIPGCGCCSSKCCCRRLSSQRVNLREGNIIVERGSKGGEVTRRRKEGKGFWMEREGRRVLFREKRGGGTARGGKEEGRGRGEKF

SEQ ID NO: 130087 - protein, 183 aa, Glycine max
  Coding DNA Sequence Number=SeqID_38402
MADAEPSSEREILAREEQQLDFVMSVGIVKECELSMPYRAQLTGDKSNLFLLRVPEFEDILLDFLEEREDVREGIEVNVYDRGGHEFQMMLRKCEGNGNVFYALNRVATCTQQNCWGTQQTVNGQLYPLRRLFSEELSSGTLSEDCVSGKVPEEFQKNFPKKCLPEDFRKSSLPEYFILLSEE

SEQ ID NO: 130088 - protein, 20 aa, Glycine max
  Coding DNA Sequence Number=SeqID_38403
MECEPRCMLAQDKQMGNEEC

SEQ ID NO: 130089 - protein, 107 aa, Glycine max
  Coding DNA Sequence Number=SeqID_38404
  Homolog annotation: Hit_ID=A7PEK8; Match level="QueryCoverage=72%, HitCoverage=46%, E-value=4e-07, Identity=42%"; Hit description =Chromosome chr11 scaffold_13, whole genome shotgun sequence
MPPFNDVESHFFSSGVWIVDLEIGQHCLLVQMSLPEYERTSIRYGDSQPTNTARWEHSTAQTRPLLNLYDSQHIDTKKHRSGSRGESSQNSESSDTQEPDLELRLSL

SEQ ID NO: 130090 - protein, 132 aa, Glycine max
  Coding DNA Sequence Number=SeqID_38405
  Gene Ontology: Mol. function=protein serine/threonine kinase activity; Biological process=protein amino acid phosphorylation
  Homolog annotation: Hit_ID=A5AGG9; Match level="QueryCoverage=63%, HitCoverage=10%, E-value=3e-16, Identity=54%"; Hit description =Putative uncharacterized protein
MTNVKQFARIIAFSLKQESKVCDEGLCVCVMRVMRVGVCDQGSFGVVVLESVSGLKAMDFRQPEVLLVKKVHQFKVRKRTLEALADMGLNGEYNLKELMTLVSLGAARTRSDPKLRPTTRQIVGSVKLKKKG

SEQ ID NO: 130091 - protein, 94 aa, Glycine max
  Coding DNA Sequence Number=SeqID_38406
MGGNLGLLPERLLQQRNNLIIQAMVERLSSVSMIYIPSGRVKLMQAPLELIGLGSSSSMDSFAPWKMNGSGMENEEREETPLQGEDESRRSSPP

SEQ ID NO: 130092 - protein, 66 aa, Glycine max
  Coding DNA Sequence Number=SeqID_38407
MGTTSCSIIGCQTKPLESLPPMPNAESEAVDIAGEKSVLEVKLQSKKERDKLKKTQNSQSATVGNI

SEQ ID NO: 130093 - protein, 184 aa, Glycine max
  Coding DNA Sequence Number=SeqID_38408
IITLAKSVLAAVPTYTMQNLWLPEGTYGKIDSYIRANVKALLMNIALHANTREIYMLRPGSDGIYTTPSAYRWISQEPNRKLKLDNSNDFHSVDVQHWLHSQFQLPSGILFACASWQLWKARNDAVFEDKHTKVRDGEEEIMRIQVCWFKVGMQCVQGETLGVASTGKKRQPLLFEWTSLEEEP

SEQ ID NO: 130094 - protein, 232 aa, Glycine max
  Coding DNA Sequence Number=SeqID_38409
  Gene Ontology: Mol. function=methyltransferase activity; Cellular component=cytoplasm; Biological process=metabolic process
  Homolog annotation: Hit_ID=A7PEL1; Match level="QueryCoverage=89%, HitCoverage=86%, E-value=2e-76, Identity=66%"; Hit description =Chromosome chr11 scaffold_13, whole genome shotgun sequence
  Pfam annotation: Domain name=MTS; Domain location=70-167; Score= -86.2; E_value=0.026; Accession=PF05175.5; Description=Methyltransfera se small domain
  Pfam annotation: Domain name=Methyltransf_11; Domain location=80-168; Score=2.3; E_value=0.051; Accession=PF08241.3; Description =Methyltransferase domain
  Pfam annotation: Domain name=Methyltransf_15; Domain location=44-209; Score=-124.5; E_value=0.041; Accession=PF09445.1; Description=RNA cap guanine-N2 methyltransferase
  Pfam module annotation: Pfam domain module=MTS::Methyltransf _11::Methyltransf_15; Domain location=70-167::80-168::44-209
MKLKQLEGLLGGLQQFPQPKVELEQYPTGPHIASRMLFTVFPLSLYLPWIRERWGGYVSFAVHENQAENSFEDVSDKVVADFGCGCALIRHVLGIDIDPESLEIASNNAEELEVDIDFIQSNVMDLGWRGRIVDTVIMNPPFGTRKKGADLDFLSVALKVASQAVYSLHKTSTRDHVKRTALRDFNASSAEVICELRYDVPKMYKFHKKKEVDIAVDLWRFVPAASHQSRNT

SEQ ID NO: 130095 - protein, 80 aa, Glycine max
  Coding DNA Sequence Number=SeqID_38410
KNPFQEGGSDEDTTKGKDHEALEGPMTRGRLKQAQHSDEDTTKGKDHEALEGPMTKGRLKQAQHITETRLVICIAAIEDD

SEQ ID NO: 130096 - protein, 61 aa, Glycine max
  Coding DNA Sequence Number=SeqID_38411
  Homolog annotation: Hit_ID=A5BT02; Match level="QueryCoverage=83%, HitCoverage=23%, E-value=5e-14, Identity=68%"; Hit description =Putative uncharacterized protein
MAIAEASKETVWFHKIKELMTSGQILLRKVHTSDNAVDMLTKAVTTNKFKHCLDLLNIVEC

SEQ ID NO: 130097 - protein, 93 aa, Glycine max
  Coding DNA Sequence Number=SeqID_38412
  Gene Ontology: Mol. function=peptidyl-prolyl cis-trans isomerase activity; Cellular component=spliceosome; Biological process=protein folding
  Homolog annotation: Hit_ID=Q9LPC7; Match level="QueryCoverage=88%, HitCoverage=51%, E-value=1e-32, Identity=80%"; Hit description =Peptidyl-prolyl cis-trans isomerase
  Pfam annotation: Domain name=Pro_isomerase; Domain location=2-93; Score=6.0; E_value=5.3e-09; Accession=PF00160.12; Description =Cyclophilin type peptidyl-prolyl cis-tr
MSVTLHTNLGDIKCEIFCDEVPKTSENFLALCASGYYDGTIFHRNIKGFMIQGGDPTGTGKGGTSIWGKKFNDEIRESLKHSIDMLEEAEHSI

SEQ ID NO: 130098 - protein, 46 aa, Glycine max
  Coding DNA Sequence Number=SeqID_38413
MEEEFSLQEKNITMKIIYFSTLSSGNRLHFLVIDYQSLACLESTLF

SEQ ID NO: 130099 - protein, 29 aa, Glycine max
  Coding DNA Sequence Number=SeqID_38414
MGFPRLVWTKWMDITEMRYVIASRYIEGS

SEQ ID NO: 130100 - protein, 33 aa, Glycine max
  Coding DNA Sequence Number=SeqID_38415
MAASGVEEGTKKRRKKPESKFEKKKSKFSAATT

SEQ ID NO: 130101 - protein, 833 aa, Glycine max
  Coding DNA Sequence Number=SeqID_38416
  Gene Ontology: Mol. function=microtubule motor activity; Cellular component=microtubule associated complex; Biological process =microtubule-based movement
  Homolog annotation: Hit_ID=A5BIN7; Match level="QueryCoverage=49%, HitCoverage=43%, E-value=0.0, Identity=85%"; Hit description =Putative uncharacterized protein
  Pfam annotation: Domain name=Kinesin; Domain location=65-402; Score =459.2; E_value=5.4e-135; Accession=PF00225.14; Description=Kinesin motor domain
  Pfam annotation: Domain name=RRM_1; Domain location=487-555; Score =15.0; E_value=0.0061; Accession=PF00076.13; Description=RNA recognition motif. (a.k.a. RRM, RB
  Pfam module annotation: Pfam domain module=Kinesin::RRM_1; Domain location=65-402::487-555
  Subcellular localization annotation: CTP_CleavageSite=47; ConfidenceScore=5.75e-01
MAYRNGVALAQRGSAVKFERPNHLRTPSSPKPRFPHSPGSAVRRSTSAAARSGDGVPGRVRVSVRLRPQNTEEMMADADFADCVELQPELKRLKLRKNNWDSDTYEFDEVLTEFASQKRVYEVVAKPVVESVLDGYNGTVMAYGQTGTGKTFTLGQLGEEDTSDRGIMVRSMEDILADISPGTDSVTVSYLQLYMETLQDLLNPANDNIPIVEDPKTGDVSLSGATLVEIKDQPSFLELLRVGETHRIAANTKLNTESSRSHAILTVHVKRSVVDSEDVVSTENNDASHLTKPSKPLVRKSKLVVVDLAGSERIHKSGSEGYMLEEAKSINLSLSALGKCINALAENNSHVPFRDSKLTRLLRDSFGGTARTSLIVTIGPSPRYRGETSSTILFGQRAMKVENMLKIKEEFDYKSLSRRLEVQLDNLIAENERQQKTFEEEVGRLNLEAQCRISEVERKFADALEYERKVERETVSGWGDASDVQSIYFTRFLEEMSENELWYEFKKWGDMREVFIARNRNGRRYGFVRFKGVGNVRRLERQLDNLILGMLKLHVNIPKHGRVRMLRGETNRNVKYRIEVTLDKSCDGGKHQGNLEGVTEQQPQRRQMTTSYARAMVSGNKIVGQRLNLMRASPSGTNSYSLVHLNIPAEKWTWLSNSWVGRLKNLAMFDRVGDKLLWNGGEDIKPKYLEDDMVLLVGFTDDKAIQLVQGSRACPQDKEGDRPLMGLTKNTNTGISEGADGNMVGKANGPASAMKVYSKIKGCRKQMGYIRVDGLVDEISTKSNRKDQKEARSTPNTCDKYSPVTRGNGLKEVAEWEEQDKGQHAPRALPNSK

SEQ ID NO: 130102 - protein, 531 aa, Glycine max
  Coding DNA Sequence Number=SeqID_38417
  Subcellular localization annotation: CTP_CleavageSite=47; ConfidenceScore=5.25e-01
MAWACAASRRTSGGISRPRRRTRPFTAFREPILVIVIFPYFASGGVRRGSGGGDVRASPRTGLSSSTPVVASYEWVKLASPEDTCKLVVQACGSDDFPFWKAASGSPPSSFMYMCLFEVLGLILPLIAFPYALLEHLNVASSQLHPNIWDMPDPTRFKLFDEDLLTLIERVKKASFSASDPLTTEDGIIGDFAWRPLVKQVTSSAPSSILEKRKQNYGVGSSSRNKSKVFMSLRALRQAVGLAHSAGHPSIMEDVSLAPSTIEAPTTVVSAVLVQKATPATGVNVPATSAGSVVVPSSTITASLFSSCSVGVATASAHIVSPPPSSAPPFVVLAMASPSSSSCPHVSLDHLYTSSDTNSLWGCKLRQKFDSVSRGAECYKFCQCLSPEKFGDSRGEQTTSLKGFAPGGVLRGGGCQMKEIKDLAGKVEGIVAKRDKLTKVVADLEAQLKELESSLEGQARFFTKDLDLGLFDAFKDVKDGFLLDEEEITANEEVVDEEQGSEEQGDDATVRLPFVYLLFFCMVGFLAIQAL

SEQ ID NO: 130103 - protein, 151 aa, Glycine max
  Coding DNA Sequence Number=SeqID_38418
MREAQRQRMGRGRGEWTWQWSRAGTSIISPIPDLDSPNMFPYPYPIPDELKFIISSLYPLGIGGGTGSGWELGADAVIPYSTFGYQRKSELEPIPDQLGYYSSKSGHIRMDTYGYGFSCMCRGEGEPFKILSEVKDKFATSLKIMVHVRCT

SEQ ID NO: 130104 - protein, 74 aa, Glycine max
  Coding DNA Sequence Number=SeqID_38419
MCASNSQHSPQPLKDEGGKGSGVVEEGWWVGDHNGGYILMKPPQVVYNGRIVGKEGRYFLQKDRTDKLIPSYLT

SEQ ID NO: 130105 - protein, 56 aa, Glycine max
  Coding DNA Sequence Number=SeqID_38420
MARILDKIQDINGSKETLKLAVRITDLWFVGTPNKPEQAEMGDQIHAVCKRDQLKS

SEQ ID NO: 130106 - protein, 181 aa, Glycine max
  Coding DNA Sequence Number=SeqID_38421
  Gene Ontology: Mol. function=helicase activity; Biological process =viral genome replication
  Homolog annotation: Hit_ID=Q9LX60; Match level="QueryCoverage=96%, HitCoverage=25%, E-value=5e-17, Identity=49%"; Hit description =Putative uncharacterized protein F4M19_60
MREWFAFRLQCRSNEAQTLLHSRKLFQQFVVEGYTMVESERLSFIRNNQNKLRVDNYCNLQESLDTGSTRGLHKVDDENDASLHVASHHDEIKEYLDCIYISPCEATWRIFGFPIHGRKLAVERLHFHLPGQHAVFYQDHDDIDDVLSKPSIFDSKFISWMNTNKKKDIGNSGKNDTLLGG

SEQ ID NO: 130107 - protein, 92 aa, Glycine max
  Coding DNA Sequence Number=SeqID_38422
  Homolog annotation: Hit_ID=A5B5Y8; Match level="QueryCoverage=73%, HitCoverage=9%, E-value=1e-09, Identity=49%"; Hit description =Putative uncharacterized protein
MENAKVVNTPLATHFKLSSKQSPSIETEKLDMQRVPYAYAMESLIGSCDLAVQAVEVCSFVYYKGKIHVYYLSMQGVAMGEEILVGVWFCSG

SEQ ID NO: 130108 - protein, 135 aa, Glycine max
  Coding DNA Sequence Number=SeqID_38423
  Subcellular localization annotation: CTP_CleavageSite=13; ConfidenceScore=5.32e-01
MSMPHIFNYNVVVLMRTPNTHGLGSTSKTTLGINANFTSFSGKKEKNWKVQQLHALSALSARPTSQLSILVLRMPGSLSQSSLTRAKRENGTKRTFEDRKPFLKPKVKNQKEEEESAENREQRHKTEQGSKNLSF

SEQ ID NO: 130109 - protein, 155 aa, Glycine max
  Coding DNA Sequence Number=SeqID_38424
  Homolog annotation: Hit_ID=A7PMM7; Match level="QueryCoverage=27%, HitCoverage=11%, E-value=1e-12, Identity=76%"; Hit description =Chromosome chr14 scaffold_21, whole genome shotgun sequence
MLQPYEISIGLKEHSNPVTPKAYTPKSPSGPLPPDSDSSGFLRERKRLQCEGFFSQFRHDIEIPNGENARNCVANMILKFHDDPTVNGFEIVVFLRLGSRSFRQRLLLSTLSSTPILIEDIRADETWPGLRNHEISLLRLFETVCDDCHVEINET

SEQ ID NO: 130110 - protein, 295 aa, Glycine max
  Coding DNA Sequence Number=SeqID_38425
  Gene Ontology: Mol. function=RNA-3'-phosphate cyclase activity; Cellular component=nucleolus; Biological process=biological_process
  Homolog annotation: Hit_ID=A7PMM7; Match level="QueryCoverage=87%, HitCoverage=68%, E-value=6e-91, Identity=64%"; Hit description =Chromosome chr14 scaffold_21, whole genome shotgun sequence
  Pfam annotation: Domain name=RTC; Domain location=1-235; Score=-1.2; E_value=1.9e-10; Accession=PF01137.12; Description=RNA 3'-terminal phosphate cyclase
  Pfam annotation: Domain name=RTC_insert; Domain location=64-182; Score=101.9; E_value=1.9e-27; Accession=PF05189.4; Description=RNA 3'-terminal phosphate cyclase (RTC), insert domain
  Pfam module annotation: Pfam domain module=RTC::RTC_insert; Domain location=1-235::64-182
ITNDSKDPSIDTFKSTTLPILKRFGVPFEDLELKVESRGLPPNGGGEVVLSVPVVQNLTAVSWIDEGFVRKIRGTTFSTRVSVQFEYSMIKSARGIINPLVSDVHIFSDHRSGPEAGNSPGYGISLVAETTSGCFISADTAVSQARDEDTSGLADDAKRDLMPPDDIGVGIANALVGEIAQNGVVDSTHQGLLFLLCALCPQDVSKVRVGKLSQHGVETLRNLRDFLDLKFIIKPDPNSQSVFLKCIGYGMKNLSQKNISLLCSECYHREVFRESITVNECVDLFLEAEYDSVHE

SEQ ID NO: 130111 - protein, 144 aa, Glycine max
  Coding DNA Sequence Number=SeqID_38426
  Homolog annotation: Hit_ID=A7PY94; Match level="QueryCoverage=94%, HitCoverage=61%, E-value=9e-38, Identity=58%"; Hit description =Chromosome chr15 scaffold_37, whole genome shotgun sequence
  Subcellular localization annotation: CTP_CleavageSite=26; ConfidenceScore=5.36e-01
MASMASSSSFCNLKFITKPNNNGRTNASSLPRIVFCQKHNDDTPTDQINRRELILRSSEIATIGAIFNFGGKKPDYLGVQKNPPALALCPATKNCVSTSENISDRTHYAPPWNYNPEGRKKPVSREEAMEELIDVVINATELKS

SEQ ID NO: 130112 - protein, 108 aa, Glycine max
  Coding DNA Sequence Number=SeqID_38427
  Subcellular localization annotation: CTP_CleavageSite=57; ConfidenceScore=5.01e-01
MVKLKLGSRENKKSRLGLRVEEGVPTGIHTTTSLNATTAMAISPTRVVRSLSPARMRASIGNAMIERATPMKTRMPQMKGREVLTAVMQNSYRPLRRMEWRSSSRPKS

SEQ ID NO: 130113 - protein, 268 aa, Glycine max
  Coding DNA Sequence Number=SeqID_38428
  Gene Ontology: Mol. function=phosphoprotein phosphatase activity
  Homolog annotation: Hit_ID=Q2HTA0; Match level="QueryCoverage=77%, HitCoverage=32%, E-value=2e-20, Identity=30%"; Hit description=IMP dehydrogenase/GMP reductase, related
  Pfam annotation: Domain name=DUF1723; Domain location=161-210; Score =57.7; E_value=4.1e-14; Accession=PF08330.1; Description=Protein of unknown function (DUF1723)
MVRIRGLGRVLGAGRGRGISEDAHQADDPRRRRPTASACRQRVHLCEDVTERPEDVPQLHEDVSHVSDATPEMIGAADAVQTKEVATDGSLGSPTADEGFLGGPRDPSILTAFAEHVAHSIWSGQVSHGRKVDKIGRPALEIEGMIAATGLSPLIRCSVITTDLGLISAFIERWHRETSTFHLPVGELTITLDDVASLLHVPITGALHKFEPLVTSDAIGLLMELLEVSHEESTFETRQAGGPHVRLGWLQDLYESQCRARRRVVAAL

SEQ ID NO: 130114 - protein, 165 aa, Glycine max
  Coding DNA Sequence Number=SeqID_38429
  Gene Ontology: Mol. function=transcription factor activity; Cellular component=nucleus; Biological process=regulation of transcription, DNA-dependent
  Homolog annotation: Hit_ID=A7P573; Match level="QueryCoverage=69%, HitCoverage=49%, E-value=7e-35, Identity=67%"; Hit description =Chromosome chr4 scaffold_6, whole genome shotgun sequence
  Pfam annotation: Domain name=AP2; Domain location=27-78; Score=46.9; E_value=7.1e-11; Accession=PF00847.11; Description=AP2 domain
MLETEPKSKKIKRIHGGVDEDLSNKHPLHHDVRMRNWGKWVSEIREPWKKSRIWLGTFPTPEMAVWAHNVAALSIKGSAAILNFLHFANSLPCPTYLTPQDVQAATAKVVHMDPSSLSSLVIKFYHCKVKKMQCFPVNHSDVDTWQSTSEVNGQRSIGTFRTNFA

SEQ ID NO: 130115 - protein, 117 aa, Glycine max
  Coding DNA Sequence Number=SeqID_38430
MSSREQHGHAPTRQPRSGKKVFSWRRAVLAWSVGSVNLGFMEKIGLEKGDFDLWVKVAVFSVAAVVDDIRGGSDTEMQHLMKLLERDQYIHWHRIKDEDVVRDIFWCHPNAVKLVNA

SEQ ID NO: 130116 - protein, 111 aa, Glycine max
  Coding DNA Sequence Number=SeqID_38431
MCPEEHDAAFETGPASFRWPEGGVWSSRAGMGASWWRRVAGNLATRLAGKFTSIVVVLAATKDMCMMRNPKTLSAKARFKTAGVPGISPSLKNVMKCGSKDAVTRVVSRKV

SEQ ID NO: 130117 - protein, 166 aa, Glycine max
  Coding DNA Sequence Number=SeqID_38432
MEEGTGWGGKNKCSTEELATAVAVVAAPKKANEIEFEKHGDLDCGKTKLRCMEIGIHGSLGYGEVALGCGEVGHGGLQAIQAGGGRIEGAPWLSPNRIVGLRQFLIGLVVARLLLLSQSNSRYANPEFEPILVRKSAHTFPSLKECFNTTFQVFLKSSCTLAIMEA

SEQ ID NO: 130118 - protein, 158 aa, Glycine max
  Coding DNA Sequence Number=SeqID_38433
  Homolog annotation: Hit_ID=Q5VNV0; Match level="QueryCoverage=55%, HitCoverage=28%, E-value=3e-14, Identity=47%"; Hit description =Glycine-rich protein-like
MQKTNREKGIVIEELDTDDEGADNGPETGEKDFDKKTKKLTQQLARQHIGSLEESMTRRLDSDGNVDTTQTLHNLNEDELVGFEEAWKGNNMAQFPGFNVHRKEEHNNVADSSSGKHNRNPVWPLQYLEPAGRSRGFPSNYEAGTNSGGRTKKVAHAA

SEQ ID NO: 130119 - protein, 139 aa, Glycine max
  Coding DNA Sequence Number=SeqID_38434
MGLAWQMVIGGLDCESTTEIENKEKKLKSKGWRWCRIVEGPRIGSNSEQGHELANLSSRTSSPRGGDVGGGDVAPSPLKLHLDGGLNTNPAHDSDIAEQGGVIVVGDLVTMVVAEKGIEFGDRGGLSCSEFDNDVLKAV

SEQ ID NO: 130120 - protein, 57 aa, Glycine max
  Coding DNA Sequence Number=SeqID_38435
MHALVLGVRCSTEGRTAARDIAPINLEIEATCRRKNVGRRREQEAQGSSHTSPPPSP

SEQ ID NO: 130121 - protein, 88 aa, Glycine max
  Coding DNA Sequence Number=SeqID_38436
MEFLVGEVEEHTVLVIVVEVGLALGLDELEDEGAARADVVAAGEEVAANKGFEDAGLVVAPVADNDDLGEVDGGLAFDTGEDVLNLAR

SEQ ID NO: 130122 - protein, 84 aa, Glycine max
  Coding DNA Sequence Number=SeqID_38437
MNQIQIHAPDEGKTTFITEDFNFYYKSIAQHVAYLEEVFGELHKYDMRLNSEKCTAILEMHSPTNIQEVQKMNGKLASLTRFLP

SEQ ID NO: 130123 - protein, 223 aa, Glycine max
  Coding DNA Sequence Number=SeqID_38438
  Subcellular localization annotation: CTP_CleavageSite=48; ConfidenceScore=5.02e-01
MEVALVGLAGLSLVIDCIFVIVFLSSSMFCFVSSSICVVIPILLLMVSFESRSYLYLVASNPGLGGFIGGSLMGTSKLKASSRIIVQLVIKDVLSDFILEYGHFFRLDVAFGSFAQLVDATRDLDNNASKPIYEFMERFIISLLQTDQESTIPGQCRPFKGRMEDMTHDCIVIAWYFSFHDEVDKWVSMSSPPYRTAMCERNARRLGGIWHEPPADHGQSSAF

SEQ ID NO: 130124 - protein, 76 aa, Glycine max
  Coding DNA Sequence Number=SeqID_38439
MDEFIELINEHNWEMLGCLSAHLAVAMTNFARCFQIIIVTRALWNNMEVQPEIDTLIPKFDSPQISRLGSHDKRPH

SEQ ID NO: 130125 - protein, 84 aa, Glycine max
  Coding DNA Sequence Number=SeqID_38440
MTSRDQVWSFCTLVSSRGGGPDDTRRYLTVIRTLLSSRGGGPDDKQRPKTKFGHSAHMIRGDTLRLSAPLCHSDTVVSVGKQRP

SEQ ID NO: 130126 - protein, 141 aa, Glycine max
  Coding DNA Sequence Number=SeqID_38441
MRQRQTHLHHLKLRSLKQNQPQQNNYDLSSNKYNPRWRNHPNLRWSSPSQKQQQQQQPYFHNVAGPSRPYVPPPIQQQQQQQQQQPQKQQTVDAPPQPFREELVRQMTMQNMQFQQETRASIQSLTNQMGQLATQLNQQQS

SEQ ID NO: 130127 - protein, 116 aa, Glycine max
  Coding DNA Sequence Number=SeqID_38442
  Subcellular localization annotation: CTP_CleavageSite=51; ConfidenceScore=5.67e-01
MYPLLFSVTTTQVDVPSTFTTKDVSSSVLRQSSQAVSPSKLCEGGNKRILRREESKEFSDRVVLNSLTREKGDTKEFRRLVLHSFGKGRRETQKEFRRLVLGEFFLAKGEGNEKDE

SEQ ID NO: 130128 - protein, 183 aa, Glycine max
  Coding DNA Sequence Number=SeqID_38443
MRILLPRSSNLAQVSEEDLVIMWAFHTERQLDWAHLVRYRMHKALQLNAPLPYPHLVTLFFRHFQIPLDSEPYVPIKRSFLIGAAVIASFGYRKEHDGSWVKKGAQPADDEGNLPTEDSSSLLRKLLDKFDGLQAFVGDKFDAMELQVDMRFDAMESRITKVEEDVSFIRTCFDPPPPPPSSS

SEQ ID NO: 130129 - protein, 294 aa, Glycine max
  Coding DNA Sequence Number=SeqID_38444
  Homolog annotation: Hit_ID=Q6WAY6; Match level="QueryCoverage=42%, HitCoverage=21%, E-value=3e-12, Identity=33%"; Hit description =Putative uncharacterized protein
VDWDQHLAGIGGGTVNWFPRWKEGKEGVLFSCGSYPNILLIGTRGCINYNPALAIRQLGYPMRGAPTEESMSPFLVRDFGAQNFKAIQRVHKAWGSPLRKDKELWGIRNGIIGGYHEWLKVRTRGLDWLAMLKIINEENFEAPEEDEETSEKECVGLREENAATGKALEQEIKRARKEEHGRDKFRGALSKRNLSQRLCETETNMLAIITKYQEELSLATTHEHRVADEYAQVYAEKEARERVIDSLHQETTMWMDRFALTLNGSQELPRLLAKAKAMADTYSALEEIHGLLDY

SEQ ID NO: 130130 - protein, 79 aa, Glycine max
  Coding DNA Sequence Number=SeqID_38445
  Gene Ontology: Mol. function=peptidase activity
  Homolog annotation: Hit_ID=A5BSF6; Match level="QueryCoverage=88%, HitCoverage=21%, E-value=2e-12, Identity=42%"; Hit description =Putative uncharacterized protein
MASSNFLFPEANSINRPPIFNGVGYHYWKTRMQIFIEAIDLNIWEAIETSPYIPTMVARNATIEKLREQWDEEETKMVQ

SEQ ID NO: 130131 - protein, 40 aa, Glycine max
  Coding DNA Sequence Number=SeqID_38446
MLLKYWRLELPFLGLKGLSYPNFVRGPLLDDMRPFFGPCE

SEQ ID NO: 130132 - protein, 27 aa, Glycine max
  Coding DNA Sequence Number=SeqID_38447
ASKIHRRLGSDLLKPGLTWPIPTPSHH

SEQ ID NO: 130133 - protein, 85 aa, Glycine max
  Coding DNA Sequence Number=SeqID_38448
MVSQTNFHWDLKGKRLPLHLCLQVRENTEVDGKRSSKFVKAFSESNKQAQLQSIHDNLKKSLLSSLGFRAGIGTTIEVEDEVGVE

SEQ ID NO: 130134 - protein, 138 aa, Glycine max
  Coding DNA Sequence Number=SeqID_38449
MLKNGRESSRNYSRKRYGSASAWIFFMEIIFLSNFERERSAKKVELEILIPMTDVVPDVTTSRFRTCRLCLTGNIKVAHKTLKSQNSQNNSSIPDLVQNSCSLHVYIAVCVSGLQQLALDEIYHSPEKSALKELKDKV

SEQ ID NO: 130135 - protein, 543 aa, Glycine max
  Coding DNA Sequence Number=SeqID_38450
  Homolog annotation: Hit_ID=Q6WAY6; Match level="QueryCoverage=54%, HitCoverage=50%, E-value=1e-33, Identity=32%"; Hit description =Putative uncharacterized protein
MVPTIEEFEEILGCPLEGRKPYLFSGFLPSLSKIAAVVGVSAKELDRMKQTRNSVVGLPQKYLEDKARDMASQEQWGPFADILALLIFGVVLFPNVNGLVDLAAIDAFLAYLHSKESPVVAILADLFDTFDRRCEKNSARIVCCLPALCVWLISHLFQQDTRHPCPLQSYRSCTEKGRVVWDQHLAGIGGSTINWFPRWKEGKEGVLFSCGDYPNIPLIGTRGCINYNPVLAIRQLGYPMRGAPTEESLSPFLVRDLGAQGLKVIQRIHKAWRSPLRKDKELRGIRNGVIGGYHGWLRIHTRGLGWLSKLKGVNEEKFEAPEEDEEVRALKLELGKARLAKEKFKSAATHIQKECTELQEENAATAKALEQETKRARKEEYGREKFRGALWGSNNELKLRREERDRSRVHGMILKEELVACARSKRNLDQHLETTEQSMLAIIGQYKEELNQSTAHEQKLVEGYAQVYAEKEARGRVIDALHQEATMWMDRFAFTLNGSQDLPRLLAKAKAMAEVCTGPEEIHGLVNYCQHMIDLMAHILRTR

SEQ ID NO: 130136 - protein, 107 aa, Glycine max
  Coding DNA Sequence Number=SeqID_38451
MKAQVEKDEGPEAETLSRLLIVAEGPNLSSFTGSGVYPDLSSFTGSGVYPDLSSLTGSGVYPDLSSFTGSGVIQIFVACIKRSAPTQVHITSFGQTESIAARRPNIL

SEQ ID NO: 130137 - protein, 37 aa, Glycine max
  Coding DNA Sequence Number=SeqID_38452
MNKQVGPGPPSDCEASTAFPDYNSDAEGDRFSWWAFP

SEQ ID NO: 130138 - protein, 120 aa, Glycine max
  Coding DNA Sequence Number=SeqID_38453
MVYPADGLSSVSDVLVFVGEYLSGVQVSGPCPSISGASAHWPFESGDVVACTDSHRDWVGLQCTACVAYAKRTSKGLRRKPRSRIRLFGYKIEKNALDGCPGIEKEGRFQRRKAMGRYRL

SEQ ID NO: 130139 - protein, 311 aa, Glycine max
  Coding DNA Sequence Number=SeqID_38454
  Homolog annotation: Hit_ID=Q6WAY6; Match level="QueryCoverage=34%, HitCoverage=19%, E-value=3e-12, Identity=36%"; Hit description =Putative uncharacterized protein
WFPRWKEGKEGVLFSCGRYPNVPLVGTRGCINYNPALAIRQLGYPMRGAPTEESMSPFLVRDFGAQNSKTIQRIHKAWETPLRKDQELRGIRNGIIGGYHEWLKVHIRGLDWLAKLKVVSEESFEAPEEEEEVQALKSELGKAKLAKEKFKLAATHVRKECAGMAGTNFAELYGVAIVNSSCEGKKGDQSRAHSMVLKEELIACSKSKRSLSQRLCETETNMLAIIAKYEEELGLATAHEHRIADEYAQVYAEKEARGRVIDSLHQEATMWMDRFALTLNGSQELPRLLAKAKAMADTYSTPEEIHGLLGY

SEQ ID NO: 130140 - protein, 92 aa, Glycine max
  Coding DNA Sequence Number=SeqID_38455
MPKSSPNMHGKQEVSTRVKPRLLCKQSTGQNTQNKIDDDGSNSHQGTINKEQSINLDKCNKSKEGDRKRKLPKSWWKRSRVKYGGLLHHYIH

SEQ ID NO: 130141 - protein, 889 aa, Glycine max
  Coding DNA Sequence Number=SeqID_38456
  Gene Ontology: Mol. function=5'-3' exonuclease activity; Cellular component=nucleus; Biological process=nucleobase, nucleoside, nucleotide and nucleic acid metabolic process
  Homolog annotation: Hit_ID=P0ADS0; Match level="QueryCoverage=46%, HitCoverage=90%, E-value=0.0, Identity=84%"; Hit description =Uncharacterized protein ygdH
  Pfam annotation: Domain name=5_3_exonuc; Domain location=551-650; Score=111.2; E_value=3.1e-30; Accession=PF01367.11; Description=5' -3' exonuclease, C-terminal SAM fol
  Pfam annotation: Domain name=5_3_exonuc_N; Domain location=423-539; Score=-9.4; E_value=2.9e-08; Accession=PF02739.7; Description=5'-3' exonuclease, N-terminal resolvase-like domain
  Pfam annotation: Domain name=Lysine_decarbox; Domain location=158 -300; Score=195.3; E_value=1.5e-55; Accession=PF03641.5; Description =Lysine decarboxylase family
  Pfam module annotation: Pfam domain module=5_3_exonuc::5_3_exonuc _N::Lysine_decarbox; Domain location=551-650::423-539::158-300
LFRNCSLAVLNSGSQTDSSHELLSRFENFDINVLRRERGVKLELINPPEEAFVDGRIIRSLQANLFAVLRDILFVNGQLSAADRLQNQDVTDSAHITNQVFSILRNARALHVGEYPNTVVCWGGHSINAVEYQYCRNVGTQMGLRELNICTGCGPGVMEAPMKGAAVGHAQQRYHDSRFIGLTEPSIIAAEPPNPLVNELIIMPDIEKRLEAFVRIAHGIVIFPGGVGTAEELLYLLGILMNPQNSDQVLPLILTGPKESADYFRVLDDFIVNTLGEAARRHYKIIIDDAAEVARLMKKAMPQVKEYRRETGDAYSFNWSIRIAPDLQVPFLPTHENMANLKLFPNQPAEKLAADLRRAFSGIVAGNVKEMGIREIREKGPYQLQGDADLMHRMDELLQGFVAQQRMKLPGSSLRAAGITMSRHLLIIDALNLIRRRAHRAGHDRQPGWRHQLLPDYKAGRPPMPDDLQQEMASLQRPLRPAGVSCWVAEHDEADDLAATLAVKMADAGHQATIVSTDKGYCQLLAPSIRIRDYFQKRWLDVPFIEQEFGVAPAQLADYWGLCGISSSKIPGVPGIGPKSARELLLQFGSLEALYQQLDQVPEKWQKKLRDHRATAEVCRQVSTLKRDLVLQGNLNTLRYQGAANAAIVQRMKQKFCEIICATAGRQARAGQAGFSPIPHRRSQRRDSAKYEAGLAFVAPSADCRPDPAHMHGHFFAVVIQLARLDLRVYALLLQRRVHHCQVLRNFFIALFHWQLEVEDRLTAPAVDQPFGHQAGDAHRFFHHVAHQPADVAARRAEFETVFAAVRNLSGIHQAWRHRAVIHRVDPHAALHQLIGPAAGAGTEIDRIHAAAQPFVPLIGRHEHMECFFQLQRRAAWRIGRELQARNAH

SEQ ID NO: 130142 - protein, 329 aa, Glycine max
  Coding DNA Sequence Number=SeqID_38457
  Gene Ontology: Mol. function=acyl-[acyl-carrier-protein]-phospholipid O-acyltransferase activity; Cellular component=integral to membrane; Biological process=metabolic process
  Homolog annotation: Hit_ID=Q5PEN7; Match level="QueryCoverage=49%, HitCoverage=22%, E-value=1e-68, Identity=76%"; Hit description =Bifunctional protein aas [Includes: 2-acylglycerophosphoethanolamine acyltransferase (EC ...
  Homolog annotation: Hit description=2.3.1.40) (Acyl-[acyl-carrier -protein]-- phospholipid O-acyltransferase) (2-acyl-GPE acyltransferase); Acyl- [acyl-carrier-protein] synthetase (EC 6.2.1.20) (Long-chain-fatty- ...
  Homolog annotation: Hit description=acid--[acyl-carrier-protein] ligase) (Acyl-ACP synthetase)]
  Pfam annotation: Domain name=Acyltransferase; Domain location=2-102; Score=37.4; E_value=5.3e-08; Accession=PF01553.12; Description =Acyltransferase
MSFLDGVLLALFLPIKPVFAVYSSISEQWYMRLLRPVIDFVPLDPTKPMSIKHLVRMINEGRPVVIFPEGRITVTGSLMKIYSGAGFVAAKSAATVVPMRIEGAEYTPFGRLAGVFKRRLFPRITLTVLPATVIPMPEAKRARDRRVLAGEHLHHVMMEARMALHRAAEKSARRRTHSGALQPAGRIRWPAAAERYGDRGSDSRGFTARSRAGHAQLHRRHQRHARGADRLAGENRVYLAPVPRERQPVAPAAGADGGAVDLSGGSEGYRHAAGQTVDPRAPAAATPAQVAQQPEDAAMVLFTSGSKGNPKGVVHSHKSLLANVSRFAP

SEQ ID NO: 130143 - protein, 420 aa, Glycine max
  Coding DNA Sequence Number=SeqID_38458
  Gene Ontology: Mol. function=exodeoxyribonuclease V activity; Cellular component=exodeoxyribonuclease V complex; Biological process=response to DNA damage stimulus
  Homolog annotation: Hit_ID=A8GIH2; Match level="QueryCoverage=76%, HitCoverage=28%, E-value=1e-130, Identity=70%"; Hit description =Exodeoxyribonuclease V, gamma subunit
MLLLAMTISTLLQYHRALALGFSQQWQQRQAWQVAGQALLGRDTTGWHIVHQPQSLPGSCVLDRVTVTGPHQRTASLARLNCREGDAGGSFMFRVYHSNRLDLLKDLAVELIKLQPLADPLAAEQVLVQSPGMAQWLQMELANRFNIAANIDFPLPASFIWSMFVKVLPDIPEESAFTKASMSWKLMHRLPVLLEQEAFQPLRSYLHDDDDQRKLYQLSARVADLFDQYLVYRSDWLNRWERGEQVDGLSDAQQWQAALWRDLVEFTRSLGQPMWHRANLYARFIQALEQASTPPPGLPQRVFICGISALPPVYLQALEALGRHIDIHLLFTNPCRHYWGDIQDYAFLAKLQSRQRLRLHSQETQPLFRDPDAAPALFNELGEQQLTNPLLASWGKLGRDNLFLLSQMESAANDIDASVE

SEQ ID NO: 130144 - protein, 872 aa, Glycine max
  Coding DNA Sequence Number=SeqID_38459
  Gene Ontology: Mol. function=metalloendopeptidase activity; Cellular component=periplasmic space; Biological process=proteolysis
  Homolog annotation: Hit_ID=A8GIH1; Match level="QueryCoverage=100%, HitCoverage=90%, E-value=0.0, Identity=67%"; Hit description =Peptidase M16 domain protein precursor
  Pfam annotation: Domain name=Peptidase_M16; Domain location=1-100; Score=61.2; E_value=3.4e-15; Accession=PF00675.11; Description =Insulinase (Peptidase family M16)
  Pfam annotation: Domain name=Peptidase_M16_C; Domain location=121 -304; Score=98.7; E_value=1.8e-26; Accession=PF05193.12; Description =Peptidase M16 inactive domain
  Pfam annotation: Domain name=Peptidase_M16_C; Domain location=590 -767; Score=44.1; E_value=4.8e-10; Accession=PF05193.12; Description =Peptidase M16 inactive domain
  Pfam module annotation: Pfam domain module=Peptidase_M16::Peptidase _M16_C::Peptidase_M16_C; Domain location=1-100::121-304::590-767
MVLMGSKNYPQPDNLAEFLKKHGGSHNASTASYRTAFYLEVENDALQPAVDRLADAIAQPLLDPTNADRERHAVNAELTMARSRDGLRMAQVGAETLNPAHPGSRYSGGNLDTLSDKPDSNLHQALLDFYHRHYSANLMKAVIYSNKPLPEMATIAAETFGRVANHQASVPDITVPVVTDAQKGIIIHYVPAQPRKQLKIEFRIANDSDQFRSKTDTLISYLLGNRSKNTLNDWLQQQGLADGVNAGADPMTERNSGVFAISVSLTDKGLAQRDRVVAAVFSYLDMLRKQGIDKRYFDEVAHVLALDFRYPSITRDMDYIEWLVDTMLRVPVTHTLDAPYLADRYDAAAINARLAEMTPQNARIWYISPAEPHNKQAYFVNAPYQVDKITAAQFSDWQQQAQQIPLSLPTLNPYIPSDFALIPSDGKHYDHPVALTSGDSMRIYWMPSQFYASEPKAAITLALRNKSAISDARQQVLFGLNDYLSSLALDELNSQASVGGISFSTGEDDGLVFNASGFTQRLPELLKKLVEGYASFQPDAQQLEQAKSWYLDRLEAAEKGKAFEQAIQPMQMLSQLPYTQREARRQLVKQITLQEVMDYRDALIQHATPEMMVVGNLSADRVRQLGEELKQQLHSTGHGYWHSDYVVVDKPIKANLQKTGSSTDSALATLYVPLGYSEYQSMANSTMLSQIVQPWFYNQLRTEEQLGYAVFAYQMPIGRQWGIGFLLQSNSKPPAYLLQRFQAFYPQAEQRLRSMKAEDFAQYQQALINDLKQRPQTLDEEANRYSRDFNRQNFAFDTREKAIAQIQQLTPASLADFFHQAVLAQQGMAMISQIGGSHDGTHDADYAPLPGFTTWDEVARLQQSLSVKSDAP

SEQ ID NO: 130145 - protein, 243 aa, Glycine max
  Coding DNA Sequence Number=SeqID_38460
  Gene Ontology: Mol. function=nucleoside-triphosphatase activity; Cellular component=exodeoxyribonuclease V complex; Biological process=viral genome replication
  Homolog annotation: Hit_ID=A8GIG9; Match level="QueryCoverage=85%, HitCoverage=33%, E-value=2e-69, Identity=63%"; Hit description =Exodeoxyribonuclease V, alpha subunit
LAAAVNAGEAQAVEAAFQAGFSDIVRQPLNDAEAYQAMLTQIAEGYRPFLQLINQRAAPAEVIAAFGRYQLLCALREGPFGVQGLNQRIEHKLMQLQLIRRPAGGSRWYQGRPVMVTRNDSALGLFNGDIGITLFDEEGLLKVFFPLPDGSIKAVQPSRLPAHDTAWAMTVHKSQGSEFDHTALVMPAQFLPVLTRELIYTAITRARSQLTLFSDEAVFRRAVQLRTQRRSGLLDRLGGEEGR

SEQ ID NO: 130146 - protein, 338 aa, Glycine max
  Coding DNA Sequence Number=SeqID_38461
  Gene Ontology: Mol. function=N-acetylmuramoyl-L-alanine amidase activity; Cellular component=extracellular region; Biological process=peptidoglycan catabolic process
  Homolog annotation: Hit_ID=A8GIG7; Match level="QueryCoverage=99%, HitCoverage=81%, E-value=1e-128, Identity=70%"; Hit description=N -acetylmuramoyl-L-alanine amidase precursor
  Pfam annotation: Domain name=Amidase_3; Domain location=112-327; Score=337.1; E_value=3e-98; Accession=PF01520.9; Description=N -acetylmuramoyl-L-alanine amidase
NLHINSALKGIDKLVRVDDPYIKTARVGQFDPTTVRVVLELKRSVAPKTFTLDPVAGIRHRLVVDLYPSQSSQEEDPLLALLKDYNQGELERDQPAQAPLPGKAGRDRPIIIMIDPGHGGEDPGAHGKYKTREKDIVLKIGRYLKALIDKERNMKAYMTRNEDVFIPLRVRVAKARKQRADLFVSIHADAFTSRAARGSSVFALSTSGATSAAARFLAQTQNEADLIGGVSMSGDRYLDHTMFDMVQRQTISDSLKFGKEVLTRMGHINHLHKRTVDQAGFAVLKAPDIPSILVETAFISNVEEERKLRTPRYQHQVAEAILHGIKAYFDKGGVLARR

SEQ ID NO: 130147 - protein, 726 aa, Glycine max
  Coding DNA Sequence Number=SeqID_38462
  Gene Ontology: Mol. function=hydrolase activity, hydrolyzing O -glycosyl compounds; Cellular component=outer membrane; Biological process=peptidoglycan turnover
  Homolog annotation: Hit_ID=A8GIG6; Match level="QueryCoverage=48%, HitCoverage=92%, E-value=1e-148, Identity=71%"; Hit description=MltA domain protein
  Pfam annotation: Domain name=3D; Domain location=278-356; Score =101.4; E_value=2.8e-27; Accession=PF06725.2; Description=3D domain
  Pfam annotation: Domain name=MltA; Domain location=125-259; Score =250.6; E_value=3.3e-72; Accession=PF03562.8; Description=MltA family
  Pfam annotation: Domain name=ThiF; Domain location=400-535; Score =209.2; E_value=1e-59; Accession=PF00899.12; Description=ThiF family
  Pfam module annotation: Pfam domain module=3D::MltA::ThiF; Domain location=278-356::125-259::400-535
MKGHWAKYALTGAFLALLAGCSSKPTDRGQQYIDGKLEQPLGLVNEPNAKGRPVNGRDFGLQVQQIQSASSGLYGRNLGTYSAIQNWLLSGADTRQLRQFGLNAYQMEGTDSYGNVQFTGYYTPVVEARYTRQGEFQYPIYRMPPRPRGQKLPSRASIYSGALDERYVIAWSNSLIDNFMMDVQGSGYVDFGDGRPLRFFGYGGKNGWAYHSIGKELIDRGEVKREDMSMQAIRQWAQEHSPQEVRNVLETNQSFVFFKPEEYVPVRGASAVPLIAKASVASDRSLIPAGTALLAEVPQLNEKGKFNGKYEMRLMVALDVGGAIKGQHFDIYQGVGPDAAHLAGFYNHYGRVWAAHPGFVGCASAHRTKRLAMKVVSDAWRQRFGGTARLYGQEALQRFADAHFCVIGIGGVGSWAAEALARTGIGKITLIDMDDVCITNTNRQIHALQGHVGQAKTEVMAQRIHAINPECEVICIDDFITPDNTAELMAAGFDYVIDAIDSVRPKAALIAWCRRNKIPLITTGGAGGQIDPTQIQVSDLAKTIQDPLAAKLRERLKSDFGVVKNSKGKLGIDCVFSTEALVYPQPDGSVCASRSTAEGPKRMDCAAGFGAATMVTATFGFVAGRGRFSFHRCQQHRQQSAHNAPLTVAVKMQRAVGPLLAAEPDAVFAAGELNVRRFQRFRQRRQLAAELNQLAVAIFPLMKMGKFLRQAGFGNQVTKRMGGKQG

SEQ ID NO: 130148 - protein, 120 aa, Glycine max
  Coding DNA Sequence Number=SeqID_38463
MKQIRKATCLRSLATRPVGVEKPLVHVDLTTGKAYDPHKKKLRTYLGIVTQDKVDVTYDNCKQGPTAQKDLIWGGYSANKNNVDDTACEKYNISKEKWTQFCQSRRDPLCEDVRKKAHAI

SEQ ID NO: 130149 - protein, 208 aa, Glycine max
  Coding DNA Sequence Number=SeqID_38464
  Gene Ontology: Mol. function=chitin binding; Cellular component =extracellular region; Biological process=chitin metabolic process
  Homolog annotation: Hit_ID=UPI00006A17C9; Match level="QueryCoverage =91%, HitCoverage=100%, E-value=1e-19, Identity=31%"; Hit description= UPI00006A17C9 related cluster
  Subcellular localization annotation: CTP_CleavageSite=41; ConfidenceScore=5.20e-01
MLVRMIRTRLFAAARVKSCPGMHSSCVIASLSGCARTVGPSSNIRGTLNSFKVVDVEHTEKRTRSPLKVRACSPLLARTCSPFKVRACSPLTVRVTSTKVRACSPLKARTCSPLKVRACSPLKARTCSPLKVTACSPLKVRTCSPLKARTCSPLKVRACSPLKARTCSPLKVRACSPLMARTCSPLNGEVPKVRACSPLKARTCSPLE

SEQ ID NO: 130150 - protein, 87 aa, Glycine max
  Coding DNA Sequence Number=SeqID_38465
MKHKEHESGDPTVMWLRMPPVSWDTVTKSGVVDKSRAFAPTYPQFVMRNSDLRSSCQLISFLNDHLEETLGPTKIGENHSKCINLTQ

SEQ ID NO: 130151 - protein, 250 aa, Glycine max
  Coding DNA Sequence Number=SeqID_38466
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPLALDIRNLHVEDNSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130152 - protein, 139 aa, Glycine max
  Coding DNA Sequence Number=SeqID_38467
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=73%, E-value=1e-24, Identity=67%"; Hit description=LacZ protein
MILNSFMQKYYYLILSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130153 - protein, 290 aa, Glycine max
  Coding DNA Sequence Number=SeqID_38468
  Gene Ontology: Mol. function=structural constituent of ribosome; Cellular component=mitochondrion; Biological process=translation
  Homolog annotation: Hit_ID=Q6YSR1; Match level="QueryCoverage=22%, HitCoverage=57%, E-value=6e-33, Identity=98%"; Hit description =Putative uncharacterized protein orf115b
MSRGPPPPTRYISRLWAAITIQEDTRNWKDKQTHPVDCRATSPTTQERDSLKSQGRGWPRGPTWRLGISAGNAKIQSLLLQTGPSRSFSACGLGGSPHNYSLCLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQVVFERRHMICGFLFYPEGHALSENDYAGYLTKIANFGTRQSIPYQRVIRTVHNSHPFLD

SEQ ID NO: 130154 - protein, 120 aa, Glycine max
  Coding DNA Sequence Number=SeqID_38469
MRDGKRSSYVIGIGVNSGVGLGGKFLIALEPAPKWALPAGRVGVGAGAWGASLWMGAGALGCTGAELEESPARAEKHSCSDPPSIGTCGGDVIELPSLQTNFDSLPGEYQVREAGGHVAH

SEQ ID NO: 130155 - protein, 68 aa, Glycine max
  Coding DNA Sequence Number=SeqID_38470
MSDKENACALLVMGKLGGVDGGPVLRGTRIRATSEYVSSAEGGQLGMVGSCLICGCGRVDLHHRPIAT

SEQ ID NO: 130156 - protein, 58 aa, Glycine max
  Coding DNA Sequence Number=SeqID_38471
MELERLIKRLSESGIDDGRFCKHKHLTMKESWSCCTWMSNDYVKGNKIGLLLNARRQD

SEQ ID NO: 130157 - protein, 220 aa, Glycine max
  Coding DNA Sequence Number=SeqID_38472
  Gene Ontology: Biological process=transposition, DNA-mediated
  Homolog annotation: Hit_ID=Q1J7G7; Match level="QueryCoverage=15%, HitCoverage=48%, E-value=2e-11, Identity=97%"; Hit description =Transposase
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRFLYNLVRQRARQDILMDCVIAILALRIDSFGNAAIDSSIKLIDTVDLEGGPVGKPVVPAALMNRPTRGERRFAYWALAECILAYYVGTDEGEKKGCTGASAEYVIQDIFRFLAH

SEQ ID NO: 130158 - protein, 117 aa, Glycine max
  Coding DNA Sequence Number=SeqID_38473
  Homolog annotation: Hit_ID=A5AZ66; Match level="QueryCoverage=56%, HitCoverage=7%, E-value=1e-08, Identity=41%"; Hit description =Putative uncharacterized protein
MWIIACKGLYKVEKKSQEPHVAWGLDVGTGCCRTRNSIHRSPIFNGEGYHYWKTRMQIFIEAIDLNIWEAIEIGPYIPTVVDVSTAPQHKNLETSGLKKIEEESSMILKPKTLLLQP

SEQ ID NO: 130159 - protein, 20 aa, Glycine max
  Coding DNA Sequence Number=SeqID_38474
MAFTFSGSTLIPFWLTDETQ

SEQ ID NO: 130160 - protein, 136 aa, Glycine max
  Coding DNA Sequence Number=SeqID_38475
  Homolog annotation: Hit_ID=Q6WAY4; Match level="QueryCoverage=76%, HitCoverage=19%, E-value=1e-09, Identity=33%"; Hit description =Putative uncharacterized protein
MGSSQASSLKKRFYQVKVKSLGVTSLKELGQFMGQLQRQAFRKAYGKIWDLAMAEVSTEAIASLAQYYDQLLRCFTFGDFQLSPMVEEFEEILGCPLGGRKPYIFSGFYPSLARISKIVRISTRELDHRKQVENGV

SEQ ID NO: 130161 - protein, 104 aa, Glycine max
  Coding DNA Sequence Number=SeqID_38476
  Gene Ontology: Mol. function=nucleic acid binding
  Homolog annotation: Hit_ID=A5BEG7; Match level="QueryCoverage=93%, HitCoverage=14%, E-value=3e-12, Identity=38%"; Hit description =Putative uncharacterized protein
MEEGDDNPPRVILNHVFWAFNPCIKGFKYCKTLVQVDETFLTGKYHDRGTGLLAALQSERVGWNGPDVSSVYCIRHIASNFNKQFKNIDLKKQVINMGYEMRKP

SEQ ID NO: 130162 - protein, 217 aa, Glycine max
  Coding DNA Sequence Number=SeqID_38477
  Gene Ontology: Mol. function=motor activity; Cellular component=cell projection
  Homolog annotation: Hit_ID=UPI00016621D1; Match level="QueryCoverage =98%, HitCoverage=40%, E-value=3e-24, Identity=35%"; Hit description =UPI00016621D1 related cluster
GLHVLAFRGLHALTFRGLHVLTIRGSRTLTFRGQHVLAFRGLHVLAFRGQHVLASRGPHTLTFRGLHVLTFRGLRVLTFRGLHALTFKRLYTLTLRRLHVIAFRGLHALTFRELHILTFRRLHALTFRGLHVLTFRGLHALAFRGLHILAFRGLHALAFRGLHVLAFRGLHVLPFRGLRVLTFKGLHILSFRGLHVLTFKGLHAFAFRGLHVLTFRR

SEQ ID NO: 130163 - protein, 102 aa, Glycine max
  Coding DNA Sequence Number=SeqID_38478
  Subcellular localization annotation: CTP_CleavageSite=6; ConfidenceScore=5.26e-01
MAPLPSLQNGQDGPSGTSTLVFRGLHVLANRGLHGLTFRGLRVLTFRGLHVLTFRGLHALAIRGLHALTFRGLHALAIRGLHVLTFRGLHVLTFVGLHRPHL

SEQ ID NO: 130164 - protein, 157 aa, Glycine max
  Coding DNA Sequence Number=SeqID_38479
  Gene Ontology: Mol. function=nucleic acid binding; Biological process= DNA integration
  Homolog annotation: Hit_ID=P93251; Match level="QueryCoverage=24%, HitCoverage=31%, E-value=5e-09, Identity=78%"; Hit description =Putative uncharacterized protein
MGELKYFLGLQIKQLKKCKTHVYTDNGVRALIVNLDKENLEAQSIPSTKHYWCMIGDILILILPDLKLIEKVQVELVNLLDRLLSHGIVRNKTGIYLLLKRSICSGSCKIEAIRMLLAYASIMNFKLYQMDVKSAFLNGLIQEEVYRLNNLQVLNPG

SEQ ID NO: 130165 - protein, 132 aa, Glycine max
  Coding DNA Sequence Number=SeqID_38480
MAAQLIRDRVEMECLEGAWETLEGNTRCRFRGTIRFTATSLRTVEWILPTPTPYRLAEPVQVIEVTSSEEDPEEDLAELPPEPAVDALDFLEGDEDPLLEVDSPEEVMSTSEADSTEDSSLGEMAISGGSSS

SEQ ID NO: 130166 - protein, 272 aa, Glycine max
  Coding DNA Sequence Number=SeqID_38481
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDEHAHEPTTHEMISSAWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130167 - protein, 444 aa, Glycine max
  Coding DNA Sequence Number=SeqID_38482
  Homolog annotation: Hit_ID=Q2HW90; Match level="QueryCoverage=77%, HitCoverage=70%, E-value=2e-43, Identity=33%"; Hit description =Putative uncharacterized protein
MGTNQNGKRFYQVKVKSLDVISLKELGRLMRPLQRQAFRKVYGKILDLATAEVFTEAVVSLAQYYDQLLRCFTFGDFQMVPTIEEFEEILGCPLGGRKPYLFSGFLPSLSKIAAVVGDSAKELDRTKQTRNGVVGLPQKYLEDILALLIFGVVLFPNVDGLVDLAAIDAFLAYHHSKESPVVAILADLFDTFDRRCEKNSARIVCCLPALCVWLIPHLFRQDTRHPCPLQSYRSCAEKGRVDWDQHLAGIGGSTINWFPRWKEGKEGVLFSCGDYPNVPLIGTRGCINYNPALAIRQLGYPMRGAPTEESLSPFLMRDLGAQGLKVIQRIHKAWRSPLRKDKELRGIRNGVTGGYHGWLRIHTRGLDWLSKLKVIDEENFEAPEEDEEVRALKLELGKARLAKERFKSAATHIRKECTELQEENTATAKALEQETKRARKEEYG

SEQ ID NO: 130168 - protein, 155 aa, Glycine max
  Coding DNA Sequence Number=SeqID_38483
  Homolog annotation: Hit_ID=Q69F85; Match level="QueryCoverage=47%, HitCoverage=4%, E-value=4e-08, Identity=39%"; Hit description=Gag -pol polyprotein
MAQPIMRSTREGWLSQLGDIWLSAPLLRSADALKAFNELKLIQLPPIAPPRLGLDKTKHCRYHRSHGHNTGDCWALKDKMEKLIQVGYLAQFMKKPDDNPTRGRRETIVAKVEMPAEEGTKWIKEADKGVTRKGVNINLSKSKKMSLPSGFSYEG

SEQ ID NO: 130169 - protein, 49 aa, Glycine max
  Coding DNA Sequence Number=SeqID_38484
MEELINKTKLSPKIIPMPSRRLDGSSTESHFLHPTAIILLPRTSFAIIT

SEQ ID NO: 130170 - protein, 139 aa, Glycine max
  Coding DNA Sequence Number=SeqID_38485
VSVEAIASLAQYYDQPLRCFTFGDFQLVPIVEKFEGILGCPLGGRKLYLFSGLYPSMARVTKVVKISMQELNQVKQNRNGVVEIPKKHLEEKAKALADQGEWTSFIDVLELLVFNASHSKYGWASGSSGNRCFSCLSPQ

SEQ ID NO: 130171 - protein, 150 aa, Glycine max
  Coding DNA Sequence Number=SeqID_38486
MVMGDPIKQTLLPCWNICLFAKACLHFSGENTETFSSLTSYPELRRSEFLIGGYVGARASLLSTAPLFVTMIQELVARGDTLRLSAPRHLVTPSVIDEQRPMWSSAPFPEMSAFSDGDFSSLTSYPELHRSEFLIGGYVGARALLLSAAP

SEQ ID NO: 130172 - protein, 122 aa, Glycine max
  Coding DNA Sequence Number=SeqID_38487
MALRKLSSKRSRKNAAAAGTSAAPEFDSHRFRSVEHQQHFEAIKGWFFHRERRVQLRDDEYTDFQEEIARRRWTSLVTPMAKFDPDIVLEFYANAWPTEEGVRDMRSWVRGQWIPFDADALS

SEQ ID NO: 130173 - protein, 181 aa, Glycine max
  Coding DNA Sequence Number=SeqID_38488
  Pfam annotation: Domain name=zf-CCHC; Domain location=115-132; Score =14.2; E_value=0.011; Accession=PF00098.14; Description=Zinc knuckle
MKREKHASYSSHHSCKSLSEELRDYYEGRHRSHLRPHSHRREKERKPQEANIKLSYFHGKDNKSTSKSYGSHSYPKKDQGQGILGVTPSKPKDDKGKTIEKQAPKASMQEKTSSIKCFKYLGRGHITSQCPTTKTMIMRGQDIYSSKMRLLLHLSLVKVKKQKGKNLVKKSTPRRRTTISG

SEQ ID NO: 130174 - protein, 79 aa, Glycine max
  Coding DNA Sequence Number=SeqID_38489
MAACSGYRWLWVVDKKLGALRKGFGRKKEKGMEKKLFSHTKRHIVDRNDQVVEICPMNLQTKFREDLTINDCRRALLPR

SEQ ID NO: 130175 - protein, 174 aa, Glycine max
  Coding DNA Sequence Number=SeqID_38490
  Homolog annotation: Hit_ID=A1JPV0; Match level="QueryCoverage=67%, HitCoverage=47%, E-value=3e-42, Identity=71%"; Hit description =Putative exported protein precursor
MPPLIRLFTSAGDFMVRKALLAALLLAAAQAHADYQCSVNPKDDVIIKPQSVQVVGSNGNLEITPQGDVQFNGKSVSVDNATRQQAIDYQNALRRDLPWVDSGATTRLERGRVALDKVIVEKLGSDSNVRNRLTTLNGQLKQQMNRIIEHRRQRQQSAAGADGQPRRATAVDSD

SEQ ID NO: 130176 - protein, 258 aa, Glycine max
  Coding DNA Sequence Number=SeqID_38491
  Gene Ontology: Mol. function=monooxygenase activity
  Homolog annotation: Hit_ID=Q5CEG7; Match level="QueryCoverage=40%, HitCoverage=99%, E-value=3e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGIKAPKGPFPIRPPTGTRRPALAAEAARAVHRQPTGSGLGPPVPSPQSQSFSRGYGSILPTSLAYIVPSTRGCSPWRPDAVMSTTGRGRHSVLRIFKGRRGRTGHHATCGALPAAGPYLRLSRFQGGQAVKQKR

SEQ ID NO: 130177 - protein, 335 aa, Glycine max
  Coding DNA Sequence Number=SeqID_38492
  Homolog annotation: Hit_ID=Q84VI1; Match level="QueryCoverage=99%, HitCoverage=59%, E-value=5e-73, Identity=83%"; Hit description =Envelope-like protein
IKEFNIQPIQIIRGQASVPEKLGPRRQQGVKIYENPSLATSPREVDTEMDKKIRSIVSSILKDASVPDAGEDVPTSSTPNVSVPDVEKDVPTSSGPNAEALPSPSEEESTEEEDQASEETPAPRAPETAPGDLIDLEEVESDEEPIANRLAPGIAERLQGRKGKTPIKRSGRIKTMAQKKSTPVTPTTSRRSKELGRAAMDCKEIVDLIKAAGLLKTVSKLGDCYEGLVREFIVNIPSDISNRKSDDYQRVFVRGKCVRFSPAVINKYLGRPTDGVIDIDVSEHQIAKEITAKRVQHWPKKGKLSAGKLSVKYAILHRIGAANWVPTNHTSTVAT

SEQ ID NO: 130178 - protein, 200 aa, Glycine max
  Coding DNA Sequence Number=SeqID_38493
MSIHVAQLIADAIYLFAGMAPTRHPLDPDKSNRALGFPALITGLCQSFGVPVAPSKVIWPPITRAFIEKYCTQRQAQGDAPQAADAPPPHQAGLAGSFDTEQYLRHLVRQQAANHRAHVQTHDCLYQMSLSLQSQGFTSFLCPTPDQFRAEVTWPGDWPEARAGEAPAEAPAEAPDEADEAREDEEMTDLLDFLGGSGAT

SEQ ID NO: 130179 - protein, 83 aa, Glycine max
  Coding DNA Sequence Number=SeqID_38494
PLGPSGIFLQKAVASGGSNPARLGELGGNHLPYFAINRGGSEEGRAEALPKRFRNVFREESRKGFNRSSTFFIRSSSFFDLQR

SEQ ID NO: 130180 - protein, 96 aa, Glycine max
  Coding DNA Sequence Number=SeqID_38495
MMQSYPARALDRKLQVDWARDARAGPRVLMSLRVDFGPMAKYEPTYLVNIDKISELLLSTKFRALLSLSLHSSPSSSKLLSMASYGGELLLDSSSP

SEQ ID NO: 130181 - protein, 232 aa, Glycine max
  Coding DNA Sequence Number=SeqID_38496
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130182 - protein, 109 aa, Glycine max
  Coding DNA Sequence Number=SeqID_38497
MTGRLLTGSLALESRILYYLIIRILLLRSSNLTQRSFLIGAAVVASFGYRKERDGSWVKKGTQPNDDEGQLPVEGDSSLLQSLMLWNNKWTCDSMQWTQGSQRLKKMPP

SEQ ID NO: 130183 - protein, 291 aa, Glycine max
  Coding DNA Sequence Number=SeqID_38498
MKDKRDKEEKLENQKKKKDSKALSSKAKGKEKEEKDSSKKIVKKENHFATKCDIKRALLLKKSFYLLLSRETSLSTAIPLELEVIPQVKELLDEGLVRKSLNPCALLVPKIDIIRHQIPMIGGMMNVLSGATLFSKITHATNIFMICVHRDSLGRNNQHENKEKGMFDSITFLDFLNSDQGLPRDPKGIKVIPECLTPPCIREIWGFNDLTNFYKRGHIASQCPTKKTMILSGQDIYSSQEETTSSPSSSGSEDEVRGEESSEEVYPHEEGGLLMVRRLLGGQSCDLSQSQ

SEQ ID NO: 130184 - protein, 33 aa, Glycine max
  Coding DNA Sequence Number=SeqID_38499
NWNEEWCHPLKNLSQEERGPTTLRAIGLRSTLN

SEQ ID NO: 130185 - protein, 82 aa, Glycine max
  Coding DNA Sequence Number=SeqID_38500
ACDVSSIGACRPRIFFINGFLCFLEDEWQRNDERKRERRHHFKEKMSLEEAHHHRRPWIRAWRKKERKRRARNFVLYMSFEI

SEQ ID NO: 130186 - protein, 149 aa, Glycine max
  Coding DNA Sequence Number=SeqID_38501
MGVGRNTEEKYFGRESSFQMWMGWWTWQRSTFFSPIITTRKVRLSLCLPTYTPPSPEDVKKAMQGLFAVLQLSMWGWFHTFFSKKVGPSIRYKVTARASKKERRIGTNSWLAWGGVCYLVPSLEGRKNQDSIFVRRMSKCSLDGNKGLY

SEQ ID NO: 130187 - protein, 22 aa, Glycine max
  Coding DNA Sequence Number=SeqID_38502
MEDKLACGAAMEAGSLSFNEVL

SEQ ID NO: 130188 - protein, 272 aa, Glycine max
  Coding DNA Sequence Number=SeqID_38503
  Homolog annotation: Hit_ID=Q84VH5; Match level="QueryCoverage=98%, HitCoverage=43%, E-value=1e-104, Identity=69%"; Hit description =Envelope-like protein
KERSTEEDDQAVEETPAPRAPEPAPGDLIDLEEVESDEEPIANKLAPGIAERLQCRKGKTPIKRSGRIKTMAQKKSTPITPTTSRRSKVAIPSKKRKEISSSDSDDDVELDVPDIKRTKTSGKKVPGNVPDAPLDNISFHSIGNAERWKFVYQRRLALERELGRAALDCKEIMDLITAAGLLKTVTKVFVRGKCVRFSPAVINKYLGRPTDGVVDITVSEHQIAKEITAKQIQHWPKKGKLSAGKLSVKYAILHRIGAANWVPTYHTSNCCH

SEQ ID NO: 130189 - protein, 74 aa, Glycine max
  Coding DNA Sequence Number=SeqID_38504
DTQIRILLDQIQIVSQRALRGQARARLTGALSKGGKMRGVATNEGISISHVDKSEAFAPTYPPLERKSDLRSSF

SEQ ID NO: 130190 - protein, 16 aa, Glycine max
  Coding DNA Sequence Number=SeqID_38505
MENCTKQSLSIAPNSK

SEQ ID NO: 130191 - protein, 153 aa, Glycine max
  Coding DNA Sequence Number=SeqID_38506
  Homolog annotation: Hit_ID=Q9AXI7; Match level="QueryCoverage=79%, HitCoverage=47%, E-value=2e-07, Identity=28%"; Hit description =Putative POL3-like reverse transcriptase
MKLCFYIKELLDEGLVRQSLNPCALLVPKIGIIRHQIPMIGGMMNMLSGATLFCKITHASNIFMVCVHRDSLGSNNQHENKEKGMFYSITFLNFLNSDQGLPMDPKRIKVIPEWPTPPSVEEKSPEFHEPQDLRSNPFQGEGNDTILPRKGIG

SEQ ID NO: 130192 - protein, 92 aa, Glycine max
  Coding DNA Sequence Number=SeqID_38507
MDVKSAFLNGLIQEEQSGPHGPSRFFLQKAVASGGSNLAHLSELGGKLLPYFAINRGRSEEGRGSAFLALLILSKLLRKIVSVKKIQAEALP

SEQ ID NO: 130193 - protein, 66 aa, Glycine max
  Coding DNA Sequence Number=SeqID_38508
MASGLECKRWKMSVNISRENCFREVIPLGINSQEEEVVGAAEYQGLDHFQRNNPHAFNGGYNPVGA

SEQ ID NO: 130194 - protein, 214 aa, Glycine max
  Coding DNA Sequence Number=SeqID_38509
  Gene Ontology: Cellular component=mitochondrion
  Homolog annotation: Hit_ID=A6H595; Match level="QueryCoverage=35%, HitCoverage=83%, E-value=7e-28, Identity=82%"; Hit description =Putative 23S ribosomal RNA
MDVDKILPSSSTLGWHSLKVKGEVQTKKGLWWIPRHPETRKGVVSDEMLRGVENKPKWEQPNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGGQGRPVKTMGDKLHRREGKQPGSPAKAP

SEQ ID NO: 130195 - protein, 76 aa, Glycine max
  Coding DNA Sequence Number=SeqID_38510
MALSQHALLRACEARVTGVLSKGGKMRGVATNVYLWKMSEKPKETGRNENSKFGSCRQKRGSCSYVPSIEEEIRPT

SEQ ID NO: 130196 - protein, 183 aa, Glycine max
  Coding DNA Sequence Number=SeqID_38511
MATMMEAMMSMKKIMEANAVAVAATSTVAKVNPMLPSDLSQMNNPTSDMVGKDLGRPHDVQIQNKHAFPPYGLPPNYTPPNVVYTPNEDVNNSVLILIESRQPHHVHVSQPMGEIHEIPHHNLADFEPCLGYATEGQAVGGIPLQNTLEGPQFCPQPQPFYGKMVGYTPSSFADLVFTGKRIK

SEQ ID NO: 130197 - protein, 167 aa, Glycine max
  Coding DNA Sequence Number=SeqID_38512
  Homolog annotation: Hit_ID=Q5XM22; Match level="QueryCoverage=79%, HitCoverage=89%, E-value=3e-31, Identity=47%"; Hit description =Resistance-like protein HAAS-2
MLVDLLMVSPESARAETVQCREPYVRLQWVRDIYQRRCQAGHWTAVARAYLLHLLGCTLFANKSATNVHVVYLEVLRDLSMTERYAWGVATLVHMYDQLNDASMSHSRQLDGYITLLQCWIYEHFPSVVESTADQDYDEASPRACRWIATKKTVKRIRTPSYRERLD

SEQ ID NO: 130198 - protein, 416 aa, Glycine max
  Coding DNA Sequence Number=SeqID_38513
  Homolog annotation: Hit_ID=Q6WAY6; Match level="QueryCoverage=29%, HitCoverage=21%, E-value=4e-14, Identity=34%"; Hit description =Putative uncharacterized protein
RRIDWDQLLAGIGGRTISWSSRWKEGKEGVLFSCGRYPNIPLVGTRGCINYNPALAIRQLGYPMRGAPTEESMSPFLVRDLGAQNSKTIQKIHKAWETPLRKDQELRGIRNGIIGGYHEWLKVRIRGLDWLAKLKVVSEENFEAPEEDEEIQALKSELGKAKLAKEKFKLAATHVRKECAGLREENAITARALEQETKRARKEEYGRNKFCGALWGSNNELKLRREERDQSRAHSMLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPALGMLPQPNIAASPIVLSMEGPPPATEERRKLDLLEERLRAVEGFGDYPFADMTDLCLVPDVVIPP

SEQ ID NO: 130199 - protein, 106 aa, Glycine max
  Coding DNA Sequence Number=SeqID_38514
  Homolog annotation: Hit_ID=A5BEV8; Match level="QueryCoverage=99%, HitCoverage=14%, E-value=1e-09, Identity=35%"; Hit description =Putative uncharacterized protein
MGEESWSLEHNHMHKELESWSKEYINLLGGIERFKKLKCSLLVDELSMVHMGYVIVSRYNVIIVSLSKQQSMTFFSFRSQPSPDSSVHRVICIGHLYENHFVQVIA

SEQ ID NO: 130200 - protein, 115 aa, Glycine max
  Coding DNA Sequence Number=SeqID_38515
MAHGRQALTFNKVELVIALHSPVYLWPIGGGVMMLDLEIPEHFLHHFVIQIGAIVSNDFPKEFVLTNQLLLYESDHHIPRDIGIRSHFDPFGEIIYRHENEAMTIRSFGFDVVEH

SEQ ID NO: 130201 - protein, 173 aa, Glycine max
  Coding DNA Sequence Number=SeqID_38516
  Homolog annotation: Hit_ID=A2Q6B4; Match level="QueryCoverage=80%, HitCoverage=59%, E-value=5e-15, Identity=30%"; Hit description =Ribosomal protein L33; Nucleic acid-binding, OB-fold
MDLKENCTYVMHNFKVLKNNGQYRVCDHQFKLVFIGVTVIRECVLEDIPFRKYMFAGFADVVAGQFEPGLLVDVIGVVEEVVFRQVSGKGRRVVLKLKDLSQQSLSCTLWDDYCLQFLKFLDDYEGDGPIIVLLSHCRIKEAQGSYPASINNSFKASKLIINQPVIEIQEFNE

SEQ ID NO: 130202 - protein, 81 aa, Glycine max
  Coding DNA Sequence Number=SeqID_38517
MVPMFDTLDVVYVRGGCIELVGWPIRGELEWLKNLSIYEGMLRRFNWSMVIALDGAHIHTSYVVYVHGGCIDLVGWPIRGD

SEQ ID NO: 130203 - protein, 72 aa, Glycine max
  Coding DNA Sequence Number=SeqID_38518
IQRTNRLRILCLNTLEGTSFVVQVEDTSTWVVELRIREENKGRYIPCGSLACKGFYKVERNLKNHRLLGDWM

SEQ ID NO: 130204 - protein, 124 aa, Glycine max
  Coding DNA Sequence Number=SeqID_38519
GYEHPVGLIEARNQSWKPQGPVGLFRVHWVSLGGRLALRSLGRMLLSSNVIYICVRVVMLVRMIRTRLFAVARMKSCPRMHSTCVIASLSGCARAVGPPPISGGGPGTVKRKLLCPLTRSASLG

SEQ ID NO: 130205 - protein, 87 aa, Glycine max
  Coding DNA Sequence Number=SeqID_38520
MELIENMTASDQAILHDRTYVPIKRSLLELSTQDATLAQNKLLTRQIEALTETLSKLPQQLQAKDAPHEEGHMSLDNVQANKTPLEK

SEQ ID NO: 130206 - protein, 62 aa, Glycine max
  Coding DNA Sequence Number=SeqID_38521
MVIFSHGIAAKDKGEEEKLHHQESGLDKKLKEEASMEEENTRERGGGGGGEVWELKEIRERS

SEQ ID NO: 130207 - protein, 86 aa, Glycine max
  Coding DNA Sequence Number=SeqID_38522
MEYAMQFLMGLNESFSTIRGQILSMDPFPSITKDRCFKLHGYPPNYQRTSFSSEVKKHFSSSEPPHKVAQQVSVDMSHSPSSSGDS

SEQ ID NO: 130208 - protein, 43 aa, Glycine max
  Coding DNA Sequence Number=SeqID_38523
MEVLLSPIALKVVFPLLLDSKFFKDMAPILLSNSLYGNSQARK

SEQ ID NO: 130209 - protein, 337 aa, Glycine max
  Coding DNA Sequence Number=SeqID_38524
  Homolog annotation: Hit_ID=A5B5V0; Match level="QueryCoverage=77%, HitCoverage=57%, E-value=3e-11, Identity=23%"; Hit description =Putative uncharacterized protein
  Subcellular localization annotation: CTP_CleavageSite=32; ConfidenceScore=5.20e-01
MAEPSKKRKGTSSQSQRHSGPQETPIPSSIPSGSLFSSEEQRIRYTNLFSSRSIIDQKFIDMDFFPNESFECFQAFENSNLIPFMSLKLPVYSDLVKAFYSNLEINEGTLMSEFYGIKMVIDLSLFNDLTKLPSEGVPFEGTVIDDWKFDFSVHDARRLVCTNQADMTGRLIAGSLAFQSRILHYLIVRILLPRSSNLAQVSEEDLIVMWVFHKGLQIDWAHLVRYRKHKALRLNAPLPYPHLVTLFLQHFNIPLDSEPYVPIKRSFLIGASVIASFGYQKEHDGSWVKKGTRHVGEEGHDGEDSSLLSKIMDRFDGLQPLLVKGLTLWNYSGYVLQ

SEQ ID NO: 130210 - protein, 83 aa, Glycine max
  Coding DNA Sequence Number=SeqID_38525
  Subcellular localization annotation: CTP_CleavageSite=50; ConfidenceScore=5.02e-01
MRLHCYQASRRLSMTIDSPLLPMFPWTRGRQKWGFCSYISSIVMRNLDLRSSLENRRTMKNERRTVKNVHGIGHRNVTEAPQP

SEQ ID NO: 130211 - protein, 110 aa, Glycine max
  Coding DNA Sequence Number=SeqID_38526
MVEAESSQNLQSTQDSTDWTNDIYSKVKGPEKRGRVRCLGKLPHQASSSQSSYTNNRIQKLENLLGNLVAVLKVRFAEDPQINQVLEAIDQEVPTNDSTGKDHQTTNNLS

SEQ ID NO: 130212 - protein, 144 aa, Glycine max
  Coding DNA Sequence Number=SeqID_38527
MNPVYGILEIPHALLPYPQLITLFLRHFQIPLDDEPFVQVKRSFAIGAGAVTSFGYRKDRNGQWLKKDALPPQDERTPSPPPQRDDSALMTEVLSELRGLHSYVGERFDSLDTRFARMDIRLTQLEDVGYIRQSFDLPPPPPPS

SEQ ID NO: 130213 - protein, 101 aa, Glycine max
  Coding DNA Sequence Number=SeqID_38528
MGAKYLEVVKRGSYPNKRMAQNDHNLSLRAFGHNRAWVARHIMTIICLCVPPDTIASGWWKGVGNDHNLSPPTSRLIVPELQRAQNDHNLSLRVYHSTCEI

SEQ ID NO: 130214 - protein, 113 aa, Glycine max
  Coding DNA Sequence Number=SeqID_38529
MSAIVFSIQSLNNIWMMSIRKCAIGAIRAGDEDMTKSKGKDPLEGLGGPIDEDMTKSKGKDPLEGLGGPMTRARARKAKEALQQVLSILFEYKPKFQGEKSKVVSCIMAQMED

SEQ ID NO: 130215 - protein, 48 aa, Glycine max
  Coding DNA Sequence Number=SeqID_38530
IPIGVNPKRKVVWDPIISKFQDRLNRWKMGRANQILSRKMLGLRMGFP

SEQ ID NO: 130216 - protein, 81 aa, Glycine max
  Coding DNA Sequence Number=SeqID_38531
MKNKRLQREGFSSKLRHNIKIPNGDNARNWVANVVFKFHNDLTVNEPEIVIFLRQVWCATGKRKGFERRMGKTKMRPKRGI

SEQ ID NO: 130217 - protein, 96 aa, Glycine max
  Coding DNA Sequence Number=SeqID_38532
MESGDMRGYRMVTRTFRQPGSNEPVDAQRLTSSSAPFAIQGQRVRWQEEIPYGHPHLSSTEGNEFDGIRMMLVAGTIKFDGVGKFRGCPALSLSKC

SEQ ID NO: 130218 - protein, 81 aa, Glycine max
  Coding DNA Sequence Number=SeqID_38533
IVLSLTNFDDSFNEQIMVRIRGLGRALGRIIRRALGREVNCDVDDAPQRRRPTASARRQWEVALVAEDVDNMDHADKEVHE

SEQ ID NO: 130219 - protein, 64 aa, Glycine max
  Coding DNA Sequence Number=SeqID_38534
MDEYFREHEMELQRLNQHEENDKKKKGIALKVSSSIQEESDMEDSIDLDDDEKLSLCQKIQQIS

SEQ ID NO: 130220 - protein, 108 aa, Glycine max
  Coding DNA Sequence Number=SeqID_38535
  Homolog annotation: Hit_ID=A5B326; Match level="QueryCoverage=98%, HitCoverage=8%, E-value=8e-08, Identity=30%"; Hit description =Putative uncharacterized protein
MEGKAFVWQRHYTAHNSNKRKSWQQILQDMASRFDMGNYDDPISELSKPRQEVRVDVTKEMAINFFLGGLHASFEKLVCIHNPRSLQDAMRLARLQDEVLQELERKLA

SEQ ID NO: 130221 - protein, 130 aa, Glycine max
  Coding DNA Sequence Number=SeqID_38536
  Homolog annotation: Hit_ID=A5B5H1; Match level="QueryCoverage=51%, HitCoverage=17%, E-value=8e-07, Identity=42%"; Hit description =Putative uncharacterized protein
QWKSYTVIWAVLSDIVVDSLLAQFFGSATKRLKESDIVCDSTNGFGSAMAILDITGLNNNDLNKPFRFEGYHFKRWQQKMMFSMRKVAYVLNTDILVVPEDAEKEVKDKMTMELALWNENDYLCNNFILN

SEQ ID NO: 130222 - protein, 319 aa, Glycine max
  Coding DNA Sequence Number=SeqID_38537
  Gene Ontology: Mol. function=oxidoreductase activity; Cellular component=fatty acid synthase complex; Biological process=metabolic process
  Homolog annotation: Hit_ID=A8GGD2; Match level="QueryCoverage=53%, HitCoverage=24%, E-value=6e-87, Identity=93%"; Hit description =Phenylacetic acid degradation protein paaN
  Pfam annotation: Domain name=MaoC_dehydratas; Domain location=38-159; Score=123.7; E_value=5.4e-34; Accession=PF01575.10; Description=MaoC like domain
MQRTAIQGSPAMLAAIGGEWVRGAPVAEHPVHPFRKYFEQLQLGDSLLTARRTVTEADIVNFACLSGDHFYAHMDKIGAADSLFGERVAHGYFVVSAAAGLFVDAAVGPVIANYGMENLRFIEPVKIGDTIQVRLTCKKKIRKPQKTAEDRPHGVVVWDVQVLNQQQQPVALGTSKRDARLPPPAPGGGKSFRSAADRAAVQALSAVNAADPASYSPAAGREANPAAARRERQRQLRPPLLIIAVGLHGVMQLQHQVVIMAAAGFGDAHLVLQPTAEGGVASETRHKACRQLRARLADPPLAMLAVRVDVGEMRRMRSP

SEQ ID NO: 130223 - protein, 47 aa, Glycine max
  Coding DNA Sequence Number=SeqID_38538
MTTNLSLRAINTTVPEWKRNDHNLSLRAIDTTVSEWQKDTTVPEWQK

SEQ ID NO: 130224 - protein, 169 aa, Glycine max
  Coding DNA Sequence Number=SeqID_38539
  Subcellular localization annotation: CTP_CleavageSite=76; ConfidenceScore=5.22e-01
AATSAVAKVNPMLPSGLKQMNHPTSNMVGKDLGSTDDPMMCKFKTSTPSHPMACLPTIHHPMWHTLSMKISITPLRYSLRTNKPHQAHISQTMGETHEIPHHNLADFEPWLGYATEGQAVGGIPFENTLEGPQFSPTTTTIAFCGGEESLLLWPKKGKDGSSKGKAQGH

SEQ ID NO: 130225 - protein, 50 aa, Glycine max
  Coding DNA Sequence Number=SeqID_38540
MFAYSPFAKRKPRAKRISVHALSCESQALSAQPLHLRLIWSAKLAKVELS

SEQ ID NO: 130226 - protein, 97 aa, Glycine max
  Coding DNA Sequence Number=SeqID_38541
MKLAKYRLKAQVEKDEGPSGEGQSPQTYQGNPCGVYPDLSSFTGSGVYPDLSSFTGSGVYPDLSSFTGSGVIQTFVACIKRSAPTQVHIIWYQSFSS

SEQ ID NO: 130227 - protein, 169 aa, Glycine max
  Coding DNA Sequence Number=SeqID_38542
MRLHCHQASRRPIMTTDRPPFLMAYIDLVPSGVTNCRDLHTGGGTTRGSRLHFLKKEKSAESPPMFIQGKRQKNQKMEKVKGLRISKMRVRKLFTHREGCFPRFYISLGAMRNSDLRSSLRTEAVATCPSRASEGEAHGCAFQRRKDTRSRHQRLFVENVRKTEGNQSK

SEQ ID NO: 130228 - protein, 77 aa, Glycine max
  Coding DNA Sequence Number=SeqID_38543
MPVCGRARRGSRVRFPREERCAESPPTFICGKRRKNRRKPVKKKIPSSGVVFTFEEGRQKWGSCSYVPSIEEEIRPT

SEQ ID NO: 130229 - protein, 26 aa, Glycine max
  Coding DNA Sequence Number=SeqID_38544
MGIFAKIFSRSSTFFVRSSSFFDLQR

SEQ ID NO: 130230 - protein, 86 aa, Glycine max
  Coding DNA Sequence Number=SeqID_38545
ALKGLDDAPQPKSKAPTRWIVVKCNRQKGSTECGYYVMHWMSTTILGSFKNNWEVYINDPRSLEPERLKALRIQWAHYYLRVRAES

SEQ ID NO: 130231 - protein, 169 aa, Glycine max
  Coding DNA Sequence Number=SeqID_38546
MWGIPFILEPNQTLTCIMSSHSTSLEPKSRLTINLDPGENVKPYPRKQKKKKERKFPIKEKAKKEGKEIPNQRESKKGRKGNSQSKSGRKRKKKRKEISNQRVGEREKRKERKFPIKEWEKEKRKERKFPTKEWEKVKKKEAPGQRNQKKCAERSLDQTISEQYRIVIK

SEQ ID NO: 130232 - protein, 190 aa, Glycine max
  Coding DNA Sequence Number=SeqID_38547
MEPLQNWGDVREVYIVKRLNKDGRRYGFMRFKGVSDAKGLEKKNPIRRKYPDEASKPCGITTGALRRSYVDVMTKGGGCQGDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVCGIL

SEQ ID NO: 130233 - protein, 111 aa, Glycine max
  Coding DNA Sequence Number=SeqID_38548
  Homolog annotation: Hit_ID=UPI00005545B3; Match level="QueryCoverage =36%, HitCoverage=21%, E-value=2e-07, Identity=77%"; Hit description =conserved hypothetical protein
MADFRLCSTSRSHSQAGLYHYAHEQNLSLSLPSHTSDWSFCVITSHLSYTFDQGCQCEAIVKVHGVLPSSRRYLCDKEFRYLRTVRVTAAVYRGFHSKLITLLLPTFQHRA

SEQ ID NO: 130234 - protein, 128 aa, Glycine max
  Coding DNA Sequence Number=SeqID_38549
MGNVEEAQEQMKADMEAMKEQMATMMEATMSMKKIIEANTVAVAATNAVAKAKIWEVGAAPMMCKFKTSTPSCHMACLSTIRHPMWRTLPIRMSITPLLYPLRANNPKLIMHMSLKPLGRHMKLPTTI

SEQ ID NO: 130235 - protein, 186 aa, Glycine max
  Coding DNA Sequence Number=SeqID_38550
MAPTRHPLDPDKSNRTLGFPALITGLCQSFGVPVAPSKVIRPPITRAFIEKYCTRRQAQGDAPQAADTPPPHQTGPARSFDTEQYLRHLVRQQAANHRAHVQTHDCLYQLSLSLQSQGFTSFPCPTPDQFRAEVAWLGDWPEARAGEAPAEAPVEAPVEAPDEADEAREDEEMTDLNDFLGGSGAT

SEQ ID NO: 130236 - protein, 79 aa, Glycine max
  Coding DNA Sequence Number=SeqID_38551
MGGQFALLIGQKHLSGWRGKQVNVQRDGLRLSIFWILYPNDAKPQAVHSTEAMEPHRGAHQRMEFLLIVMLPRIRIQGM

SEQ ID NO: 130237 - protein, 105 aa, Glycine max
  Coding DNA Sequence Number=SeqID_38552
  Homolog annotation: Hit_ID=A6R7Q4; Match level="QueryCoverage=52%, HitCoverage=3%, E-value=6e-08, Identity=43%"; Hit description =Putative uncharacterized protein
MGKEECKEVSDSSKRYYEASNPYDRCDQGFPLNPKRIKVIPKWPIPPSIRKIWGFHDLANFYKRFVPYFSILVAPLIELVFIEGAQSMKNLKIRGQILSKVEGMK

SEQ ID NO: 130238 - protein, 67 aa, Glycine max
  Coding DNA Sequence Number=SeqID_38553
MVLASQVMQAPLELRNEERKRERRRHFKEKMSLEEAHHHRRPWIRAWRKKEMNEGRGREEHEILCSK

SEQ ID NO: 130239 - protein, 93 aa, Glycine max
  Coding DNA Sequence Number=SeqID_38554
MSEHGSGSFSATTEDGSEFSENKTNEGVLKISDEKVVEKEQKNEVLAKEEEQEISKVEKQKLTASNKGKVVLDHSPIQHLPYPNAPSKKDKEK

SEQ ID NO: 130240 - protein, 159 aa, Glycine max
  Coding DNA Sequence Number=SeqID_38555
  Homolog annotation: Hit_ID=A4W9G0; Match level="QueryCoverage=56%, HitCoverage=89%, E-value=4e-39, Identity=84%"; Hit description =Putative uncharacterized protein
MALIVGARTASGRRNIGKSVELFGLCQPGLRFVNPVNGVMTQLPATADRALWLVTGDVYAFDNQHGFAFVRAEHLMPLNPDEAPQILGELTEPFMEHLPVKTTLRIALVGDYNPAVIAHQAIPLAIDDAAAVLDLTADYDWLATTELTSPEDLVGYDAI

SEQ ID NO: 130241 - protein, 97 aa, Glycine max
  Coding DNA Sequence Number=SeqID_38556
MGQDQQMLAVRLKKSRSEDADISGTGADNRKASLHAIELSGRWIAKVCGQITIGCLRMPLDLWVTIAKGGVVDKSGAFAPIYPQFVMRSSDLRSSCK

SEQ ID NO: 130242 - protein, 273 aa, Glycine max
  Coding DNA Sequence Number=SeqID_38557
MAKFDPEIVMEFYANAWPTEEGARDMRSWVRGQWIPFDADALSQFLGRPLILEEGQHCEYKQRRSQVSGFNEDAIAQLLCIPGQDFAWTAAGRRVQIMRSSMTTLTQIWMMLLLNNILPSDHNSDLPLPKCQLVYAILAQMRRAPTRHHVDPEKSNRALGFPALITGLCQFYRVSVAPSKVIRSPITRAFIEKYCIPRLAQGKAPQQPGDDRQPTIGVRCGCMRLSTSTRATVEAAVAWPGDWPEDQTGPTSAPRGEDEAEDDQDMADLIDFL

SEQ ID NO: 130243 - protein, 38 aa, Glycine max
  Coding DNA Sequence Number=SeqID_38558
MSEMATRKLATKRSRKDTIGEGSSAAQPANTDYDSRRF

SEQ ID NO: 130244 - protein, 91 aa, Glycine max
  Coding DNA Sequence Number=SeqID_38559
MLIDVGNALACACCVCSWGAKCTDLPRSLALALGHVHTLDVVYVHGGRSALTFQGLWHLLWAMFICRMECMSWGVSALTLLDGPGVGDKRG

SEQ ID NO: 130245 - protein, 266 aa, Glycine max
  Coding DNA Sequence Number=SeqID_38560
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSIFRNVTEPYGLRNHPLFGVRNVTEPHGLRKEGMVTYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130246 - protein, 73 aa, Glycine max
  Coding DNA Sequence Number=SeqID_38561
MRIKRSFKVVMGPRTRLVVSFKTRKGKQGSKRAIKGINSRTHQQESSQGYCASNQWGKTHQMIMMMDGSNSHK

SEQ ID NO: 130247 - protein, 57 aa, Glycine max
  Coding DNA Sequence Number=SeqID_38562
MSRNFTDYLTMGVKYLEAVKRRLHATKQWFPDEIRVQVVILIARFPDPNYGVKMVNL

SEQ ID NO: 130248 - protein, 102 aa, Glycine max
  Coding DNA Sequence Number=SeqID_38563
MEKEKHVSYSSHDSCKSLSEELSDYYRGRHRSHPRPHSHRREKERNPHEANINLPYFHGKDNVEQLFACHHTSKERKVPLATLSFQGYALYWWTSFVRGGIL

SEQ ID NO: 130249 - protein, 93 aa, Glycine max
  Coding DNA Sequence Number=SeqID_38564
MPSPSEDYTASHLEDYTSSPLEDYTSLPLKGYTPSPLEDYTSSPSEDYTSSPSEDYMSSPLEDYTSSPSEDYMSSPSEGCTPSPSEGCMPLPS

SEQ ID NO: 130250 - protein, 173 aa, Glycine max
  Coding DNA Sequence Number=SeqID_38565
MVSRGGDERDGCLFHLGESHDMETCPVVEELLQRLMDCGQLEVSIGGKEEPQICMQSEEKKIPLTPKALVICFTRKGIGSTPIYPRTAPKPTPFAYQSNKAVPWKYTSLVSSERITTKVDSLSAKVSQPTLRREGDARLAGCVFHERNTRGVATNVYSRKTSKKPEKTRSTNF

SEQ ID NO: 130251 - protein, 84 aa, Glycine max
  Coding DNA Sequence Number=SeqID_38566
MIPTSSMTMKFCGELEISIIKLGKKDSFQNILSMSEEFRIRLSNQVVVKLDISNIKLRKGFHSQTYIPNSEEFRIWLPNQVVFK

SEQ ID NO: 130252 - protein, 198 aa, Glycine max
  Coding DNA Sequence Number=SeqID_38567
  Homolog annotation: Hit_ID=Q6WAY6; Match level="QueryCoverage=87%, HitCoverage=35%, E-value=3e-22, Identity=34%"; Hit description =Putative uncharacterized protein
MARVAKVGKIMVQELDHVKQNRNEVVRIPRKHLEGKTKTLADQGEWASFIDAFALLIFGVVLFPNMEGLVDLAAIDAFLAYHHSKESPVIVILADVYDTFDRRCEKSGARIICCTPTLYVWLVLHLFHQESKPTYPLKGFPNVPLMGKRGCINYNPVLAIRQLSYPMRGAPLEESITPFIARGFSDPNARVLQGVRKA

SEQ ID NO: 130253 - protein, 250 aa, Glycine max
  Coding DNA Sequence Number=SeqID_38568
  Gene Ontology: Mol. function=protein binding; Cellular component =periplasmic space; Biological process=cell wall catabolic process
  Homolog annotation: Hit_ID=A4W9C7; Match level="QueryCoverage=100%, HitCoverage=78%, E-value=1e-126, Identity=88%"; Hit description =ErfK/YbiS/YcfS/YnhG family protein precursor
  Pfam annotation: Domain name=ErfK_YbiS_YhnG; Domain location=93-234; Score=232.9; E_value=7.2e-67; Accession=PF03734.5; Description =ErfKYbiSYcfSYnhG
  Pfam annotation: Domain name=LysM; Domain location=41-85; Score=31.5; E_value=3e-06; Accession=PF01476.11; Description=LysM domain
  Pfam module annotation: Pfam domain module=ErfK_YbiS_YhnG::LysM; Domain location=93-234::41-85
MTRWITLFALAATVAVALPARANTWPLPAPGSKVVGENRFHVVENNGGSLEAIAKKYNVGFLALLQANPGVDPYVPRAGSVLTIPLQTLLPDAPREGIVINLAELRLYYYPPGKKEVTVYPIGIGQLGGDTLTPTMVTTVSDKRANPTWTPTANIRARYKAQGIDLPAVVPAGPDNPMGHHAIRLAAYGGVYLLHGTNADFGIGMRVSSGCIRLRDDDIKTLFNVVTPGTKVNIINTPIKVSEEPGGVRL

SEQ ID NO: 130254 - protein, 91 aa, Glycine max
  Coding DNA Sequence Number=SeqID_38569
MERKTREKRVEEISQDERDKIREEERRKILKELRKEKHASYGSHNSCKSLSEELRDYYEGRHRSHLRPHSHRREKERKPQEANTNLPYFHG

SEQ ID NO: 130255 - protein, 207 aa, Glycine max
  Coding DNA Sequence Number=SeqID_38570
  Gene Ontology: Mol. function=helicase activity; Biological process =viral genome replication
  Homolog annotation: Hit_ID=A2Q378; Match level="QueryCoverage=57%, HitCoverage=11%, E-value=8e-21, Identity=32%"; Hit description =Putative uncharacterized protein
  Pfam annotation: Domain name=DUF889; Domain location=30-185; Score= -64.9; E_value=4.5e-07; Accession=PF05970.5; Description=Eukaryotic protein of unknown function (DUF889)
MCHKFAFEALDKSLKDIMQNNLPFGGKIMVFGGDFRQILPIVPKGDGKIGQYNDGFSEITIPDEFLIKNYDDPIHAIVEATYPSLIDNYSDTNYLQKRVVLASKKEIVDKITTFSKFLSPITDNGCATTPNMFYSTMMARYISLGRAHNLNESVILRLVAGDKNTTFTVHIDGPAHHHSSLKPIIYRRRYIFIVDITDDMLQQNLPL

SEQ ID NO: 130256 - protein, 123 aa, Glycine max
  Coding DNA Sequence Number=SeqID_38571
DTSGDATPPSPKTARLMPEIIKLGDQMRRMSYDNEERMERMRKENGQSLGRIHRSKEVLSVRIENIERRKKIRGMKRMREDGRMRGIGREEIIEDMEVDKERKGVKVKIPTLKGTYDPEVYLE

SEQ ID NO: 130257 - protein, 39 aa, Glycine max
  Coding DNA Sequence Number=SeqID_38572
  Homolog annotation: Hit_ID=A7NXL0; Match level="QueryCoverage=92%, HitCoverage=13%, E-value=1e-09, Identity=80%"; Hit description =Chromosome chr5 scaffold_2, whole genome shotgun sequence
MAGHMGRGVIEEQVWRKGPWTAEEDRLLVEYVRLHGGIL

SEQ ID NO: 130258 - protein, 184 aa, Glycine max
  Coding DNA Sequence Number=SeqID_38573
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=72%, E-value=3e-24, Identity=70%"; Hit description=LacZ protein
MKHFTDTLISANIAERCNLPRYKADTNPINKTTLTLKLIPIQPNRSQTNPPKLPSKLEPISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130259 - protein, 195 aa, Glycine max
  Coding DNA Sequence Number=SeqID_38574
  Gene Ontology: Mol. function=transferase activity, transferring glycosyl groups; Cellular component=peptidoglycan-based cell wall; Biological process=peptidoglycan-based cell wall biogenesis
  Homolog annotation: Hit_ID=A4WD97; Match level="QueryCoverage=86%, HitCoverage=21%, E-value=9e-90, Identity=91%"; Hit description =Penicillin-binding protein 1C precursor
  Pfam annotation: Domain name=Transgly; Domain location=41-195; Score =219.3; E_value=8.8e-63; Accession=PF00912.13; Description =Transglycosylase
MARLIRSRWLWLAGALLILWGLILAADRLWPLPLKEVNPARVVVDEKGTPLWRFADSDGIWRYPVTIEEVSPRYLEALIQYEDRWFWDHPGVNPLSVLRAAWQDLTSGKVVSGGSTLTMQVARLLDPHPRTLGGKIRQLWRALQLEWHLSKRDILTLYLNRAPFGGTLQGVGAASWTYLGKPPSQLSYSDAALLA

SEQ ID NO: 130260 - protein, 210 aa, Glycine max
  Coding DNA Sequence Number=SeqID_38575
  Gene Ontology: Mol. function=nucleoside diphosphate kinase activity; Cellular component=cytoplasm; Biological process=nucleotide metabolic process
  Homolog annotation: Hit_ID=A7ZPW1; Match level="QueryCoverage=66%, HitCoverage=97%, E-value=3e-70, Identity=94%"; Hit description =Nucleoside diphosphate kinase
  Pfam annotation: Domain name=NDK; Domain location=30-164; Score =314.7; E_value=1.8e-91; Accession=PF00334.10; Description=Nucleoside diphosphate kinase
MAGLLIIIRATPYSGMQNNRTLTEVIMAIERTFSIIKPNAVAKNVIGSIFARFESAGFKIVGTKMLHLTVEQARGFYAEHEGRPFFDGLVEFMTSGPIVVSVLEGENAVQRHRDLLGATNPDNALAGTLRADYADSFTENGTHGSDSVESAAREIAFFFAEGEVCPLNTSEVAIPAVPNKNGKINLLDLNRQQMREFFKEMGEKPFRADQ

SEQ ID NO: 130261 - protein, 130 aa, Glycine max
  Coding DNA Sequence Number=SeqID_38576
  Gene Ontology: Biological process=transposition, DNA-mediated
  Homolog annotation: Hit_ID=Q1J7G7; Match level="QueryCoverage=23%, HitCoverage=42%, E-value=2e-10, Identity=100%"; Hit description =Transposase
MVKVGTSYVPINVSFSPKSWPRASRYQQGHQDLFILRSDLPSQWLLFLSAVPPVQLLTGWCVTAKAPPDISAGKCSGHAARNHHTPPRLMRRYRARPIRHSGCATVGKGDRCGPLRYYASWRKGDVLQGD

SEQ ID NO: 130262 - protein, 211 aa, Glycine max
  Coding DNA Sequence Number=SeqID_38577
  Gene Ontology: Mol. function=phosphoprotein phosphatase activity
  Homolog annotation: Hit_ID=A7UQU7; Match level="QueryCoverage=68%, HitCoverage=24%, E-value=8e-24, Identity=41%"; Hit description=IMP dehydrogenase/GMP reductase, putative
MTERYAWGMAALVHMYDQLNDASISHNRQLGGYITLLQCWIYEHFPSVADSTTDQDYDEDSPCACRWIVTKKIVKSIRTPAYRECLDRLQIPDVCWISYGDYRLVRDFHIRSCYSGLLRWGPVAVYYRPERVVRQFGYTQTIPAPPVDSWVSYDDINDRWMHYSDHIIPTGDVCAVPGQCASDYMDWFFRISHPFMTPGHASDPLHDGHAP

SEQ ID NO: 130263 - protein, 147 aa, Glycine max
  Coding DNA Sequence Number=SeqID_38578
MVSRKRARADDIPSPSNPAPPLATIGPDVQNSQTLVLMLKSLFQGHVIIMHNLRELAHQRPIITMEQFLEQVAWPGALPSVVRPNEVAPPEPTPARVEPVPANPQSPVVNPPSPELEVVPYLHLLLSSPIPHLEKLLLPLIPSWRSC

SEQ ID NO: 130264 - protein, 63 aa, Glycine max
  Coding DNA Sequence Number=SeqID_38579
GLGFAPFACPTPDQFRAEVAWPRDWPEAQTEEAPVGAPDDAEEARMDEEMTDLLGFLGGSGAT

SEQ ID NO: 130265 - protein, 59 aa, Glycine max
  Coding DNA Sequence Number=SeqID_38580
MRPYLYGEVNLSLSQPTLRREGDAGLAGASSMGGKCAESPPTFIQGKRRKNRKGVVYEL

SEQ ID NO: 130266 - protein, 92 aa, Glycine max
  Coding DNA Sequence Number=SeqID_38581
MERYLQHLVRQQVANHRGQVQIHECLYHRGQGFVPFVCPTPDQFMAEVAWPGDWPEAQVGEAPAGSPGNAEEACMDEEMTNLLDLLGGSEAT

SEQ ID NO: 130267 - protein, 209 aa, Glycine max
  Coding DNA Sequence Number=SeqID_38582
  Homolog annotation: Hit_ID=Q6WAY4; Match level="QueryCoverage=95%, HitCoverage=43%, E-value=2e-26, Identity=33%"; Hit description =Putative uncharacterized protein
MEVFTEAVVSLAQYYDQPLRCFTFGDFQMVPTVEEFEEILGCPLGGRKPYLFSRFLPSLSKIAAVVGDSAKELDRMKQTRNGVVGLPWKYLEGKARDMASQEKWVSFADILALLIFGVVLFPNVDGLVDLAAIDAFLAYHHSKESPMVAILADLFDTFDRSAINWFPRWKEGKEGVLFSGGDYPNVPLIGTRGCINYNPALAIRQLGYP

SEQ ID NO: 130268 - protein, 131 aa, Glycine max
  Coding DNA Sequence Number=SeqID_38583
  Homolog annotation: Hit_ID=Q6WAY6; Match level="QueryCoverage=55%, HitCoverage=12%, E-value=2e-07, Identity=41%"; Hit description =Putative uncharacterized protein
MKQTRNGVVGLPRKYLEGKARDMASQEKWGPFADTLALLIFGVVFFPNMDGLVDLAAIDAFLAYHHSKESPVVAILADLFDTFDRRVPHEGSTNRRKSLAFPCEGFGRAKSQGYTKSPQGVEKSVEERQGA

SEQ ID NO: 130269 - protein, 276 aa, Glycine max
  Coding DNA Sequence Number=SeqID_38584
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINIYNRYGFFLIIDPEARIQGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130270 - protein, 76 aa, Glycine max
  Coding DNA Sequence Number=SeqID_38585
MDNEEGVQKQMKVDLSALKDQMASITETMLKIQKTIEDNATAAASNTAREAEPVLQPVINLGRDRNAMGFNRRYNP

SEQ ID NO: 130271 - protein, 275 aa, Glycine max
  Coding DNA Sequence Number=SeqID_38586
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRKCFYFLNFESLLMWQTAVSSRSRLPLWVPVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGE

SEQ ID NO: 130272 - protein, 107 aa, Glycine max
  Coding DNA Sequence Number=SeqID_38587
MEDECSEATIPEPFTTEEEADDTQTTQVAAATPERSLEAILEPSTPSVDPSSPQHATNPSTPVLEIPEGQTTPVLTLDTSPPATPVLHLTDEEDVQTQDTQDQSHEF

SEQ ID NO: 130273 - protein, 187 aa, Glycine max
  Coding DNA Sequence Number=SeqID_38588
  Homolog annotation: Hit_ID=A2Q274; Match level="QueryCoverage=49%, HitCoverage=47%, E-value=4e-10, Identity=39%"; Hit description =Ovarian tumour, otubain, putative
MQCKKCILFFHKRLKDEDVVRDIFWCHPDAMKLCNACFTSTRMSSVWDAMNNMIMQQHTEIKASFDTSTHAAGHVFKITLYKRLLGMISRYALNQIATEYEHVHYANKNPSRCGCVMRTTRDLPCACELSKYVLGTILSYPNFVQGLLFDDIQPLIGRFEILGTLCCTICEVPRRAENQKEAGLCDP

SEQ ID NO: 130274 - protein, 97 aa, Glycine max
  Coding DNA Sequence Number=SeqID_38589
  Subcellular localization annotation: CTP_CleavageSite=24; ConfidenceScore=5.18e-01
MSLPSAIHVSSNFECGAPRMSLPSAVHEFTTFESGAPRMSLPSAVRQFSILPFFSEPYECHCLALFMFPPPSSLEPREYHCLALFANSPFSPFFGAP

SEQ ID NO: 130275 - protein, 39 aa, Glycine max
  Coding DNA Sequence Number=SeqID_38590
MDPEHIPFLLPAPHCTKLSSRLCIHREDALATSWGYSCE

SEQ ID NO: 130276 - protein, 111 aa, Glycine max
  Coding DNA Sequence Number=SeqID_38591
MVMFPLKKRQVSSPGRAELAWASNPCTKILKTREGNIFALKNFPPPHSKRARLTGLTVFAPLSHLWLHFAFIFGTPTHSNKPMLHPEAMGHATLPPLSCYSCLNMCPPSAR

SEQ ID NO: 130277 - protein, 51 aa, Glycine max
  Coding DNA Sequence Number=SeqID_38592
MNPKRIKVIPEWPARPSVKGRSPEYQEPQDLRTNPFQGGGNDAILLRKGIG

SEQ ID NO: 130278 - protein, 65 aa, Glycine max
  Coding DNA Sequence Number=SeqID_38593
EERDGKPCYFDIKRYVVRKEYPPEIADNDKRTLRREANHMIEEVHEGSFGTHANEHAMARKILRA

SEQ ID NO: 130279 - protein, 186 aa, Glycine max
  Coding DNA Sequence Number=SeqID_38594
LERQNLHKCLANLQEGSIDVAVVKEFYANFYSPADKAPKCARIRGHLIKIDADNLNEFLQTPVLRCDPREMEASLCIPGKGFILNTEGQPWKLLRKDLTTLAQTWSIFSYSNLAPTSRTSDLNTDRARSVYGLITRMDMNIGGLISGQMTMMAQPNSSRLGFPALITTLCRSRGVGSDALTSYENQ

SEQ ID NO: 130280 - protein, 186 aa, Glycine max
  Coding DNA Sequence Number=SeqID_38595
MVEEFEEILGCPLGGRKPYLFTGVYPSIARISKIVQISAQELDHRKASRKWGGWNTEKIFGGKSKNLAIDAFLAYHDHKESPVVAMLADLYDTFDRRCEKSSTRIVCCTPALYVWLVSHLFRQEVRHACPLESHRSCTEKGGANWDQLLASKEGASVNWFPRWKEGRTRVLISCEGFPNVPLMGTR

SEQ ID NO: 130281 - protein, 51 aa, Glycine max
  Coding DNA Sequence Number=SeqID_38596
MRAAAPKPPLLSFCFPFHALIHSPQGMALGLRCILKQWVMPHCPHSLAIHA

SEQ ID NO: 130282 - protein, 183 aa, Glycine max
  Coding DNA Sequence Number=SeqID_38597
  Homolog annotation: Hit_ID=Q84VH5; Match level="QueryCoverage=74%, HitCoverage=32%, E-value=2e-43, Identity=97%"; Hit description =Envelope-like protein
KVFVRGKCVRFSPAVINKYLDRPTDGVVDITVSEHQIAKEITAKQVQHWPKKGKLSAGKLSVKYAILHRIGAANWVPTNHTSTVATGKAAASGAVSKDALIVELKDTCKVLEATIKATTEKKMELERLIKRLSESGIDDGEAAEEEEAAEQEEEEAEEEEEEADDEDAAEDTESDDDDSEATP

SEQ ID NO: 130283 - protein, 32 aa, Glycine max
  Coding DNA Sequence Number=SeqID_38598
MVFFPKKPNVRSGCPPSPWPWLTIGEVPDSRS

SEQ ID NO: 130284 - protein, 143 aa, Glycine max
  Coding DNA Sequence Number=SeqID_38599
LHSPVHLWPIGGGVMMLDLEIPAHFLHHFVIQIGAIVRNDLPRESVSTNQFLLYESDHHTPRDIGIRSHFDPFGEIIYRHENEAMTVRSFGFDGPNDIYPPHGKRPRGGHDVQRMGRNIDIVCVRLTFIDGSLLVGLLWRLDL

SEQ ID NO: 130285 - protein, 184 aa, Glycine max
  Coding DNA Sequence Number=SeqID_38600
GAPFEGIIVDDWKFDYSSHNARHMVCIDQADMTGRLLAGSLTFDYRIMHYIITGRPIDWAHLIRYRMHKALWSSAPLPYPQLMTLFLQHFEIPLNFEPFVQVKHSFAIGAGADAQPPQDERAPSPPPQQDDSLALMHEVLSKLRGLRTYVGERFNSLGGRIDAIDACFAGMDTYITQLEEDISY

SEQ ID NO: 130286 - protein, 138 aa, Glycine max
  Coding DNA Sequence Number=SeqID_38601
  Homolog annotation: Hit_ID=UPI00006A2D9E; Match level="QueryCoverage =99%, HitCoverage=75%, E-value=2e-07, Identity=15%"; Hit description =UPI00006A2D9E related cluster
MTGPLDESISCFLIRVDPWVLVPITFRGLHAFDFRGLHVLALRGLHVLAFRGLHTLAFRGLHVITLRGLDALAFRGLHILAFRGLHVLALRGLDVLAFRGLHPLAFRWLHALTFRGLHVLAFRWLHALAFRGIHVLAP

SEQ ID NO: 130287 - protein, 141 aa, Glycine max
  Coding DNA Sequence Number=SeqID_38602
  Homolog annotation: Hit_ID=A5BEV8; Match level="QueryCoverage=63%, HitCoverage=11%, E-value=8e-07, Identity=36%"; Hit description =Putative uncharacterized protein
METISKRFEQLDVCGKIHLKSKLREIAYPDMNFMCPHPEKVKTKGALKQPLTKQQNWSEEYINLVGGIERFEELKRSLLVDDLSKVTMDKWVNITDMGYVIASRYNVIIVSLSQKQSMIFFPLRSQPPPDSSVHRVICTGH

SEQ ID NO: 130288 - protein, 254 aa, Glycine max
  Coding DNA Sequence Number=SeqID_38603
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGLVSPARLAIVLCKLSEHAKRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130289 - protein, 164 aa, Glycine max
  Coding DNA Sequence Number=SeqID_38604
  Subcellular localization annotation: CTP_CleavageSite=41; ConfidenceScore=5.13e-01
MAQLISDVHLLFAGIAPTRRPVDPKKSNRALGFPALVMGLCQSYRVPVPPVRDRAHKTPSGPEEVQQGPGVSSSGYGPLPVLQGAHSPQRGHAIESHPQRHPVDPEKSNRALGFPALVTGLCSPTGCPFPPARDRARMTPSEPEEVQQGRRRTKHHSSLGMAGS

SEQ ID NO: 130290 - protein, 163 aa, Glycine max
  Coding DNA Sequence Number=SeqID_38605
MKLAKYRLKAQVEKDEGPSGEGQSPRVEKDKGPSGEGRKPKWRRTKPPSNPCGVYPDLSSFIGSGVYPDLSSLTGSGVYPDLSSFIGSGVYPDLSSFTGSGVYPDLSSFTGSGVIQTFVVCIKRSAPSQIHIIWYRSLYQMIRPVRFTSSGIRALALDTDFVS

SEQ ID NO: 130291 - protein, 290 aa, Glycine max
  Coding DNA Sequence Number=SeqID_38606
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLDLKKVAEANKPSIYQTNKYAHWKGMYSDQPGESDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130292 - protein, 240 aa, Glycine max
  Coding DNA Sequence Number=SeqID_38607
  Homolog annotation: Hit_ID=Q6WAY4; Match level="QueryCoverage=80%, HitCoverage=34%, E-value=2e-20, Identity=31%"; Hit description =Putative uncharacterized protein
MGTNQTGKRFYQVKNKGIDITSIKELGRLMGPLQMQAFRKAYGKILDLTISEISTEAIASLTQYYEQPLRCFTFGDFQLVLTVEEFEEILGCPLGGRKPYLFSGFLPSLSKIAIMVRDSARGLDRIKQTRNGIVGLPRKYLEGKARDMVNQEEWVSFMDVLALLIFGVVLFPNVDGLVDLAVIDAFLAYHHSKESPVVAVLADLFDTLYLTEGAKRVVHGSSVVYPLFVYGWFRTYSNKT

SEQ ID NO: 130293 - protein, 135 aa, Glycine max
  Coding DNA Sequence Number=SeqID_38608
  Homolog annotation: Hit_ID=A2Q2H3; Match level="QueryCoverage=54%, HitCoverage=61%, E-value=2e-08, Identity=46%"; Hit description=IMP dehydrogenase/GMP reductase, related
  Pfam annotation: Domain name=DUF1723; Domain location=1-40; Score =10.0; E_value=0.035; Accession=PF08330.1; Description=Protein of unknown function (DUF1723)
MEWWHMETSSFHLLVGEVTITFDDVVSLLHLPIIGAFHSFDTIHVDKVVLMLVELLEVTGDEARAETVRCHGAYVHLSWLREIYHSKCEAEHWTVATRECNTCACGVLGRLSRPQSEWKLRMGVEASFMMMNQVD

SEQ ID NO: 130294 - protein, 93 aa, Glycine max
  Coding DNA Sequence Number=SeqID_38609
MFIIIYQYKEMMNLAATYGQMLEDEWAKVLALQIEREARERMIELLHREAMKWMNRFTLTLNESQEFRRLLSRAKAVTDMYSAPDKVHSLFDY

SEQ ID NO: 130295 - protein, 208 aa, Glycine max
  Coding DNA Sequence Number=SeqID_38610
GGARVDEGRHGGHERANGHNDGGHDEHEEDNRSQWVAIATTSAVAEVNPMPPSGLNQMNHPTSDMVGKDLGSTGDPHYVQIQNKHAFPQYGLPPNYTPPNVAYTPSENVNNSTPILIESRQPQTDHAHVSQTMGETHKIPHHNLADFKPCLGYATEGQVVGCILLQNTLEGPQFCPQLQPLHSTAGKIPPIMEGIGKVGSSRGKDHGR

SEQ ID NO: 130296 - protein, 178 aa, Glycine max
  Coding DNA Sequence Number=SeqID_38611
MSKSCGFGMTGPLDESISCFLIRVDPWVLVPITFRVLHVLANRGLHALTFRGLHVLALRGLHALTLVTLTVERTTRPRLERTTRPHHQRAARPHLQRTTCPRLERATRPHLGYQLPSPLRGLHVLALRGLHVLTIRGLHALTSRGLHVLALRGLHALTLGTSYPHRQRTTRPRLERTT

SEQ ID NO: 130297 - protein, 194 aa, Glycine max
  Coding DNA Sequence Number=SeqID_38612
GAVNAVESDRPHRSKPLRDVATPRRFIFEALQKGGVIPHSGCKEDSCLLHFGEMHDMETCLEVEELLQQMIDQAQTLGDIYFTKSAASQKPGHPLMAKPVPFPYQNSHAVPWRYTPPGKKEEEVTDVSSLSAKVTNITGLSGVTRSGRVFAPPDLPVQPADVKGKGKVVEEQDGEAPHASNKDIPAKGPPEKKD

SEQ ID NO: 130298 - protein, 189 aa, Glycine max
  Coding DNA Sequence Number=SeqID_38613
MEGLVDLAAIDAFLAFHHGKEIPVVAILAMHDTFDRRCDESNARIVHCTPALYVWLGKANWDQLLASMDRRLLTGSLARRKEESGFYLHLGYPMRGVPSDESITPFIARGFSDHNARDRELRGSSNGIIGGYHKWLRVRTQGLDWLPNLKTVRDDEVKASEESDEVQALKAELERARVVKEKFKSIAIK

SEQ ID NO: 130299 - protein, 49 aa, Glycine max
  Coding DNA Sequence Number=SeqID_38614
MGLRIKVENGELANSARQSIRRAPDSKREAINSPGSRLEGGGHMNSARQ

SEQ ID NO: 130300 - protein, 171 aa, Glycine max
  Coding DNA Sequence Number=SeqID_38615
  Homolog annotation: Hit_ID=UPI00016621D1; Match level="QueryCoverage =85%, HitCoverage=39%, E-value=1e-10, Identity=30%"; Hit description =UPI00016621D1 related cluster
MTGPLDESISCFLIRVNPWVLVPIAFRGLQVLTFRGLHALAFVGLHALTFRGLHALAFVGLHTLAFRGLHVLTFRGLDALAFVGLHALTFRGLHALTFRGLHALTFRGLHALAFRGLHFLVIRGPLALAFRGLHVLAIRGLRVLAIRGLHIVTLRGLHVLTFRGLLALAYR

SEQ ID NO: 130301 - protein, 114 aa, Glycine max
  Coding DNA Sequence Number=SeqID_38616
MYVNPAKEMCVMKWPRGSLPSKRSRKDKAAEGTSSAPEYDSHRFRSAVHQQRFEAIKGWSFLRERRVQLRNDEYTDFQEEIGRRRWAPLVTPMAKFDPEIVLEFYANAWPTEEG

SEQ ID NO: 130302 - protein, 126 aa, Glycine max
  Coding DNA Sequence Number=SeqID_38617
MDSCARSGPFGASPEIEVRTWWTLGDSVGRRGYVGKLPLLSTICRGSGGIIGNSFPILRGGTVMSPEWVWARTATGMPMWLTLGVTRTNMGWGMNPGNLEEGMHHQDSGQIGHGPVMLASVSQVSG

SEQ ID NO: 130303 - protein, 83 aa, Glycine max
  Coding DNA Sequence Number=SeqID_38618
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=A7R2J6; Match level="QueryCoverage=61%, HitCoverage=8%, E-value=8e-13, Identity=50%"; Hit description =Lipoxygenase
MAELGVEKLLDIFPDTLQLIRISVYLPCETPIGVKELREKELKQLRDKGDRFARPTLGGQHNPYPTRCRTGRPPSTVGQFHSS

SEQ ID NO: 130304 - protein, 66 aa, Glycine max
  Coding DNA Sequence Number=SeqID_38619
MALSLFRHGFVLNDEEVPWKLPRKDLITLAQTWSGEVSLWVGYEDGYGRGLTHITPDLTDGPIQLL

SEQ ID NO: 130305 - protein, 111 aa, Glycine max
  Coding DNA Sequence Number=SeqID_38620
MLSAPLGAQCNFLSIGIGLSAPLGAQRNFLSVGIALSALCALSERPKVIVLKIPTALHANALLPYPHLATLFLKHFKVPLTNEPSVKVKYSFTIGAAADASFGYKKDLDGQ

SEQ ID NO: 130306 - protein, 290 aa, Glycine max
  Coding DNA Sequence Number=SeqID_38621
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVIFRHSGFCFYQLSLLFQLLTGWCVTAKAPPDISAGKCSGPAARNHHTPPRLMRRYRARPIRHSGCATVGKGDRHDVVKRRPVNCNTTHYRANWSSTAVAAALELVDPPGCRNSILDRALPAPACPFYGDSRKAKPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130307 - protein, 127 aa, Glycine max
  Coding DNA Sequence Number=SeqID_38622
MTRGNPSDLQPFDPEIDRTFHRLVRHHFIPFDHPEHSITGESVHSVIGDFKHPDFEHYNFEHSDSEHSDFEHSENMAQPPPRERTLREMAAPDFTYESLCIQYLDEDVPYVLKTGLIHLLPKFHGLA

SEQ ID NO: 130308 - protein, 270 aa, Glycine max
  Coding DNA Sequence Number=SeqID_38623
VAQRFVAVAVDQHGAAGRRRIHADDLVGGGGAVGDQIALLSVEGARDILFGLQVRPGVIQQRTELGNRNRDVGLQGIGAEKVIEQAAHRAFLKRGAGHVARRAEGVLPFAHIVEQRLGQRRRNGIDVFCGVLLDALRDIVRRIQAILEEIEHHAHFMQADVEGGMGIDKGVQRQVFIQLVDFAAQLQAVVVPVEDHPANAGIGFDQLQQITAVFGVHQLESHGGQRRVELADRLIFVVDARRAHDGDDIHRQLLSVNGQVSITPRKSGGV

SEQ ID NO: 130309 - protein, 104 aa, Glycine max
  Coding DNA Sequence Number=SeqID_38624
MASNSQQFSARNDAIVLRGVHEVATDSSSSTENKKLEGKLDALVNLVTQLAMNQKSAFAPVARVRGWRNHPNLRWASPPQQQQPVPPFQNVAGPSKPYVPPPMQ

SEQ ID NO: 130310 - protein, 221 aa, Glycine max
  Coding DNA Sequence Number=SeqID_38625
  Homolog annotation: Hit_ID=A5BSS4; Match level="QueryCoverage=75%, HitCoverage=11%, E-value=3e-08, Identity=25%"; Hit description =Putative uncharacterized protein
VAVSPPKPPPKPHPEVDDPLYLMTLTIQELFLRPYQVRWDATVFGVVNPDFPLYIKHEDLFEIAHGGQCLSISVLQLWIQHLTETCMRAGNSDIYEFLEQQSIQRSGQSQFESESYIKSWMHSSQRDVYLGAYLNGWWSSCPRTLSCLVLFMHNRPDNYLKEIINSAIKGLDDAPQPKSKAPARWIVVKCNRQKGTIECGYYVMHWMSTIILGTFRNNWEA

SEQ ID NO: 130311 - protein, 62 aa, Glycine max
  Coding DNA Sequence Number=SeqID_38626
MEEEKKKEKMVEDDKQQLKKNERQEEKKKTKSELAREKRKDASPSKGEEVPYPLVPTKKDKE

SEQ ID NO: 130312 - protein, 179 aa, Glycine max
  Coding DNA Sequence Number=SeqID_38627
  Homolog annotation: Hit_ID=Q5NRP4; Match level="QueryCoverage=44%, HitCoverage=5%, E-value=1e-06, Identity=39%"; Hit description =Putative gag-pol polyprotein, identical
  Pfam annotation: Domain name=MAP7; Domain location=2-126; Score= -79.8; E_value=0.055; Accession=PF05672.2; Description=MAP7 (E-MAP -115) family
  Pfam annotation: Domain name=zf-CCHC; Domain location=159-176; Score =22.6; E_value=0.00058; Accession=PF00098.14; Description=Zinc knuckle
  Pfam module annotation: Pfam domain module=MAP7::zf-CCHC; Domain location=2-126::159-176
MSHHSSSVNGKGTSHKDPLSRILDELSSLKLWKEKQERKEKGKKRVEEISQDERKKIREEERRKIMKEKKREKHASYSSHNSCKSLSEELRDYYEGRHRVEQQLKKKSTSKSYGSHSYPKKDQGQGILGVTPSKPKDDKGKTIEKQAPKASMQEKTSSIKCFKCLGRGHITSQCPTTKP

SEQ ID NO: 130313 - protein, 289 aa, Glycine max
  Coding DNA Sequence Number=SeqID_38628
  Gene Ontology: Mol. function=methenyltetrahydromethanopterin cyclohydrolase activity; Cellular component=cytoplasm; Biological process=one-carbon compound metabolic process
  Homolog annotation: Hit_ID=Q9RQ04; Match level="QueryCoverage=41%, HitCoverage=37%, E-value=8e-38, Identity=65%"; Hit description =Methenyltetrahydromethanopterin cyclohydrolase
  Pfam annotation: Domain name=MCH; Domain location=172-289; Score= -130.4; E_value=1.5e-07; Accession=PF02289.7; Description =Cyclohydrolase (MCH)
MLIGVHALKQRPGQYTYAGAARLHERALIQAMQNLLQTLVPDSGLVGINSLDAIWHNGQLHVLEINPRLSASMRLYADLPLIQAHIASCQHDTMPAFQLNSKHASHCIAYARQAINDAQLDFPDWVEDRPNGHAAIAAGQPVCSLYAEGHSDSEVRQALQHKKTQLEKLWGTVQQYSAPLVAHLVANAPALGCLVSTHESGATIVDAGIQTPGGLEAGRIIAEICMGGLGSVALQQVPQFAHWPLSVVVTAKQPVIACLGSQYAGWALSHEKFFSLGSGPARAIAQREE

SEQ ID NO: 130314 - protein, 698 aa, Glycine max
  Coding DNA Sequence Number=SeqID_38629
QHDEQRRQHRGGGGHVDQRVHQILHAAGTQRWDQHQRDDDEELDPGGARRHAVPIQTNGFLAENALRDLGEENLHRRRRPHQQRAEHGGEGDDADKAVHQHRRQAEVRRQAFEHLHRAAGEMQVSAVDEHVDQQRRHRIQHADEQPGNDDHLHEGAAAAFHIVHVHRHRLRPARRLEDPGGNAEERPVEVRRHRLHVDRVGRFDAAQHRRARQNDVGKRQQQHQRRGHRGHRPQQFCAAVGDVGREGEQEDADDRRGQRGKHVVIAQERVRSVGDDARQQRGEEEQVHEPIGVGGDKRPAPAERAFHPGINAGLGVAVERDELGDDQAKGNEVNDGRHQEHRRRGDPELNIVVNHVVETEHCRKRHPTAGQTCRCLVVFEDRHVAFADPASLAFAAEKLAVGFVLIGRYRRQRPFVGDLDGLFPLKVIVHIEVAAVALQPTVLAAGADAQPIRQRVADRMAHVRADAIDIGDRLHAAQPLLAARETVAERRQIDPVGIQHFGAPGVGAEAEDLVVQVQRQAVARCQLVDVLGLVQHLGAVGPQAEIDRPPRLDEDPLARRVLQTQPAHVLPIAVVLRERIVFEQRVGALPVVANQVGPAAVTVVLARPAAVVFHLLEAAADAEIEADFRDNLAEIAVRLTGQIQADVALRGDAPAVGAAHAEVEHRRRDQAMYLDQQILALPLPIEAAEVLLHDGEVM

SEQ ID NO: 130315 - protein, 58 aa, Glycine max
  Coding DNA Sequence Number=SeqID_38630
MRARARVISEIEEVQEQIKADMEALKEQMVTMMEAMMSIKEIMEVNAVPIAATSTIVE

SEQ ID NO: 130316 - protein, 73 aa, Glycine max
  Coding DNA Sequence Number=SeqID_38631
  Homolog annotation: Hit_ID=Q61343; Match level="QueryCoverage=54%, HitCoverage=33%, E-value=3e-08, Identity=70%"; Hit description=Beta -D-galactosidase fusion protein
  Subcellular localization annotation: CTP_CleavageSite=65; ConfidenceScore=5.08e-01
MKHFTDTLISANIETAMTMITPSSKLTLTKGEQKLVPGPPSRSTVSISLMGRNYAFLGFACSLVRTSKRVRMV

SEQ ID NO: 130317 - protein, 91 aa, Glycine max
  Coding DNA Sequence Number=SeqID_38632
  Homolog annotation: Hit_ID=Q1J7G7; Match level="QueryCoverage=30%, HitCoverage=40%, E-value=6e-08, Identity=92%"; Hit description =Transposase
MVKVGTSYVPINVSFSPKVGPGRSRQQTIASDLLIHHRSLIDTVTGIFGQSASGDAPSFTDLVYDGVFEVLQWLLFLSAVLPVQLLTGWCR

SEQ ID NO: 130318 - protein, 122 aa, Glycine max
  Coding DNA Sequence Number=SeqID_38633
MYCRKMGAYAKDEELLIHSFQESLTGVVVTGERIDVGLKKGKFSHPAWTNEKTRANEEGGDEGEARAVTAIPIQPSFPPTQQCHYSANNQPSPYPPPSHPQRPSLKSTTKPTYRTSNDKHHL

SEQ ID NO: 130319 - protein, 142 aa, Glycine max
  Coding DNA Sequence Number=SeqID_38634
MIMRGQDIYSSQDETTTSPSSSESEEAKQEESIKEIYPQEEGQLLMVKEECKKASVSSKRLAKKERHFEIKTNIKEISPLRQPPHFLLCKKTLVSIATPLRLEFIPQVKELLDEGLVRKSLNPCALLVPKIGIIRHQIPMIG

SEQ ID NO: 130320 - protein, 184 aa, Glycine max
  Coding DNA Sequence Number=SeqID_38635
  Homolog annotation: Hit_ID=A0PAV3; Match level="QueryCoverage=35%, HitCoverage=31%, E-value=5e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSICGFTGMRARNTWPAQGRELLKGVLKPQTIAWAICALRIKLIDTVDLEGGPGTSFCSL

SEQ ID NO: 130321 - protein, 201 aa, Glycine max
  Coding DNA Sequence Number=SeqID_38636
HVLAFRGLHALTFRGLHALTFRGLHVLAFRGLHTLAFRGLHVLAFRGLHALAFVGLHALSFIGLHICAFREFKFLGPPDIGGRPTVRAQPEKEAIVQLLCIPGQDFTQRPQCRSPPTEVSVGLYRHDIGKDHTHKTPSGPGEVQQGPGVFSSGYRPLDRARKTPSGPGEVQQGPGVSSFDYGPLSVLRSARRPHQGHQAPD

SEQ ID NO: 130322 - protein, 156 aa, Glycine max
  Coding DNA Sequence Number=SeqID_38637
MVMGDPISRLSFPGHVTCTLVSSRGGGPDDTRRYLTVIRTLLSSRGGGPDDKQRPSLVILHPCIIPEVAGPMIRGDTLRLSAPFCHPEAAGPMTSRDQVWSFCTLVSSRGGGPDDTRRYLTVIRTLSSSRGGGPDDKQRPSLVILHPCIIQRRRAR

SEQ ID NO: 130323 - protein, 51 aa, Glycine max
  Coding DNA Sequence Number=SeqID_38638
AAVPWGGRTFPQINVGGDSARIPFMEHASRESRVALPPKGRLGQLATPLGT

SEQ ID NO: 130324 - protein, 337 aa, Glycine max
  Coding DNA Sequence Number=SeqID_38639
  Gene Ontology: Mol. function=protein binding; Cellular component =viral envelope
  Homolog annotation: Hit_ID=O24293; Match level="QueryCoverage=91%, HitCoverage=40%, E-value=2e-98, Identity=51%"; Hit description =Chloroplast inner envelope protein, 110 kD (IEP110) precursor
MGTKTYYIRLSRGSEALEDLPDVNHFARGGEYDGDRKIEDLKLLYRAYVVNALSSGRMEINKIAELNQLGNIIGLVKREAEAITLDVTSRVYPKKLVQAVSNEIYRENLQHLGDDGELSDKDAAALLRLRIMLCVPQQTIDAAHSDICGSWFEKVVKDTIASGVDGYGADIWKSVRKAAHGLRLTRDTAMSIASKTIRKIFINFIQRARAAGNHKESAKELKKMIAFNTLVVTELVNGIKEESDDESTEEPGKEETRVPFGAQIITKKDDSEYVLLNQLGGILGLSSKEIVKVHKNLAEQAFRQQAEVILADGQLTKARVEQLNNLQNQVGLPEEYS

SEQ ID NO: 130325 - protein, 133 aa, Glycine max
  Coding DNA Sequence Number=SeqID_38640
MVHGFDHMAMRRVLIVVCVGNKVGWRSRGAYLVGLARGSGGDLWCDDVMGDDDARQWCQRDACGGERDKSQSIGFVVLRRERHNVTNATSRGNEGGISGAQTRGHVAELGGERRSTRLKITNSKLAEYVWSRK

SEQ ID NO: 130326 - protein, 264 aa, Glycine max
  Coding DNA Sequence Number=SeqID_38641
MKCFLDAQVASQWSSMELNEEHGQERMARGKPNSFAIKDEVALDHLVWEGEIGHGQSETMWGWKKEAGQSIGGGVAGAWTTPMAVTEAPVSSVKGRMKLGGANTRASVKARFNWSKATWASLDQWNWSFRSSERIGKAKWHHLIFVVVSPKSNFRNIIFSHADLVEALTKRGVVEWCVPEIRGLNGEEDWKVLGVDDDPGSCWETDDTRLHEIVRAATVHQYCDSVVHRVEMTEGGCGVCVSLDGKGGVDIIISDQKTVFRESS

SEQ ID NO: 130327 - protein, 266 aa, Glycine max
  Coding DNA Sequence Number=SeqID_38642
MMNLNEEWVIGLNVAYILCGTSRAYIYLGCDTENKRGYISYGSVQVERTSTWLFKENKGGYIPCGSLLVKDFTRLLEISRIGGCLGTGCRHGPLDPTSGIEAGFLRKVSQLQDSWPPQILCFLKETPSIGHPSLMVTAIPESKDLSSMYLATLFGKLQEHEMELQRLNQNEETDKRKRSIALKASSSMQEEEEKEESDDEEDFSLFAHCPTYESWPEKNEKKSHEEIRSKKAYITWDDNDSSDGSKKEINLLSKNYESDENISQED

SEQ ID NO: 130328 - protein, 67 aa, Glycine max
  Coding DNA Sequence Number=SeqID_38643
  Homolog annotation: Hit_ID=A6YGE8; Match level="QueryCoverage=89%, HitCoverage=23%, E-value=3e-16, Identity=70%"; Hit description =Putative uncharacterized protein
MWTNRKRCMFHSEHGLMSFGNPSKKMKEMPRTDSEGFMCRANFNVDSQSMFKVMPCVGSEANWATWS

SEQ ID NO: 130329 - protein, 525 aa, Glycine max
  Coding DNA Sequence Number=SeqID_38644
  Gene Ontology: Mol. function=phosphoprotein phosphatase activity
  Homolog annotation: Hit_ID=A7UQU7; Match level="QueryCoverage=81%, HitCoverage=85%, E-value=8e-43, Identity=29%"; Hit description=IMP dehydrogenase/GMP reductase, putative
  Pfam annotation: Domain name=DUF1723; Domain location=159-208; Score =51.1; E_value=3.7e-12; Accession=PF08330.1; Description=Protein of unknown function (DUF1723)
RGRQDEHDAVDVPRRRRSTASACRQWVHIAVDEGIPQVTEDVPQMTEDIPHMANDVPQMSKDAPQMTVDVDATVAEDLGRDGAEGSHADEGFPGGPHDPSVLTSFAEHVAHAIWTGQERPEQLVSHGRKVALIGRLVLEIEGLVAATGLSPLIGCSIVTDDPGLISAFVERWHRETSTFHLPVGELIITLDDVSSLLYLPTSGAFHNFEALSVDEAVLLLMELLEARRWIVVARAYLLHLVGCTLFSNKSATNVHVVHLEAFRDLGQSGGYAWGATALVHMYDQLDETSRTTTRQIGRYLTLLQCWIYEYFSSVHQCVTDDAYEETSPRASRWLTTKAHMKGIIGASYRARCDALTVIDVCWLPYSDHRGMGPMVVTVQPERVLCQFRYIQSIPPPPVSASLSYDDMDDRWMHFSDHVAAVGDICVMPRQYRHPPSPDHEDYIQPDIPEVPMTFDPPQHDDYEGYEAIAESLERVLNLRMVTAGTELQISCKIASGSPGGVLAQMEVLGLDKDGAQSIDDVFYVL

SEQ ID NO: 130330 - protein, 134 aa, Glycine max
  Coding DNA Sequence Number=SeqID_38645
MSSGDHVHAEGPLMGSLDGHSLTAQGYTTVWPRDPPRVPLIQQYDIFVEPDVSQQSVAAAAPDEAEVDVHSPRHAVDGYVAIADKLERLLNMRILTEGTKVYIVVEKCLSIARSYIGQPIVGHSSRRRRHMDDH

SEQ ID NO: 130331 - protein, 83 aa, Glycine max
  Coding DNA Sequence Number=SeqID_38646
MPVERVLVMTPTLIPTTKGGDITQTSLGKSREIRGKEERRPTLQDMAMEHIDKSDERFKSLKSIMSNLLTLLSQRTPGTSFPK

SEQ ID NO: 130332 - protein, 37 aa, Glycine max
  Coding DNA Sequence Number=SeqID_38647
MVIFHHGDAAEDKGDEGMVVMISMMDLEIKIEQRRQQ

SEQ ID NO: 130333 - protein, 111 aa, Glycine max
  Coding DNA Sequence Number=SeqID_38648
  Subcellular localization annotation: CTP_CleavageSite=70; ConfidenceScore=5.72e-01
MTLSSWQNKLNRPMATTPASPPLPPPAVASASPSTLKLTHKATQLQSLATRPPETKRLVVHIDPATGKANSPHKKKLRTYLGIVARDKVDVTYETWKEVPTAQKDLIWEDI

SEQ ID NO: 130334 - protein, 125 aa, Glycine max
  Coding DNA Sequence Number=SeqID_38649
MAPPPLALPRRSCRVALETPVAPVRCPSAYVARETQGALARSAWESEGTSQTGVLPLQQGQQLWQTRSSFGRQEQYTMNSVITVLYFNGRVYEDNDDVIFEGSKKAIQIKCGFSFNALKEKIGDK

SEQ ID NO: 130335 - protein, 55 aa, Glycine max
  Coding DNA Sequence Number=SeqID_38650
MRGSGKEESPREEVLSRGGFRCGGCVVEEGISSRVERREKKGGARFKLASVGFKS

SEQ ID NO: 130336 - protein, 176 aa, Glycine max
  Coding DNA Sequence Number=SeqID_38651
  Subcellular localization annotation: CTP_CleavageSite=55; ConfidenceScore=5.50e-01
MGLISGNQFGPLGNNENSNRVKNNTHNATPSSIHMKQQKSTTPKQSLVRKTRKASSSKKAKANNTKCEPIVNEVSLKKELFEHIIVGKDFGLFSNVEPLHYATYDGMTTTIDIPMWLPMTFRSPPKMILDEVHSLVAIYIFGRNKDDKDSGKEILVMTMAKTFADMKALRSLEPKG

SEQ ID NO: 130337 - protein, 493 aa, Glycine max
  Coding DNA Sequence Number=SeqID_38652
  Gene Ontology: Mol. function=methyltransferase activity; Biological process=metabolic process
  Homolog annotation: Hit_ID=A7NY60; Match level="QueryCoverage=100%, HitCoverage=100%, E-value=1e-179, Identity=61%"; Hit description =Chromosome chr6 scaffold_3, whole genome shotgun sequence
MEPPAAKHGSLWNILVRLFSFAVLIFAARFAIIVTVRGGTCDSADFCFFSDNLTLSATSRISDAEDPYSGMNWRRSVEHYAAVFQDLIAEGFLSPNSRALCIDTPSGEDVLALKEVGVIDSVGIFKKPSPPLILHGDPRRHPFSGDAFDFEFSGNGGLERSPRPAEFAAEVCRTLRPGGFAAVHAAVRDAYSFDSFLELFNCFELIRTREINSVDSSPVLEILMKKKNKNPNFEIKTLISGNFVKKCSVKGYKREIIENAEALIEEEPLKPWIILKKIVKNIKYLTSLVDISFKNRYVYVDVGARSYGSSIGSWFRKQYPKQNRTFEVYAIEADKSFHEDYREKRGVTLLPYAAWVRNETLFFEITRDPIKNVMMRGRGMGRINPVQTSSSHMGDKDKIQGFDFAEWLMSTVTKRDFVVVKMDVEGTEFHLIPRLIQTGAICLIDELFLECHYNRWQRCCPGQRSAKYHKTYSQCLDLFTSLRNYGVLVHQWW

SEQ ID NO: 130338 - protein, 457 aa, Glycine max
  Coding DNA Sequence Number=SeqID_38653
  Gene Ontology: Mol. function=GTP binding; Cellular component =intracellular; Biological process=barrier septum formation
  Homolog annotation: Hit_ID=A7NY25; Match level="QueryCoverage=92%, HitCoverage=78%, E-value=4e-66, Identity=38%"; Hit description =Chromosome chr6 scaffold_3, whole genome shotgun sequence
  Pfam annotation: Domain name=MMR_HSR1; Domain location=370-450; Score= 26.5; E_value=4e-06; Accession=PF01926.14; Description=GTPase of unknown function
MPSEDSLRKKLRKNATKPVVSTSRNFIRAKKDENSFEKNGAFGRGNESEGKLKKRGNFKGMRSGEEVLERGKLRTLDSGGKKKRIYAKKGGDKNVKLENGMEVSKKRTLIRNGEKRVKDVPVEGNDGHHTMWDHDKTRNGGFKVKRSTQMRKERKEDVVLAIAKQKGKAEDAGKIGLVGTEDQGSGSVKRSRDKKTELSKGKNQEVVSGSSFAKKKARDRTGLDDDDAEMLHDRPKKKKRVIKIDPHDISNKRLDDGIGVNGSKEEKEKEKESEKEPKMSKNAQYFDFYYGYYSQLLGRRRMIDLKRAGYNIDLSAPLDNIPFSSSSEREKIEENVSSSFPPPNLPEIAFAAYPFTGKNTSEPPENNNGGRSNVGKSSLLNALTRQWGVVRTSDKPGLTQTINFFNLGTKHCLVDLPGYGFAYAKEEVKESWEELKEAPGDGGTLIQFWDCFINPPR

SEQ ID NO: 130339 - protein, 75 aa, Glycine max
  Coding DNA Sequence Number=SeqID_38654
MMITKDDDKGDDKKLKGQSKNEFKMFKNESRTIQDSRGKVEEHLKIQGSSFKNQDQDSRIKIKIQDSRFKNQEKT

SEQ ID NO: 130340 - protein, 380 aa, Glycine max
  Coding DNA Sequence Number=SeqID_38655
  Gene Ontology: Mol. function=nuclease activity; Cellular component =intracellular; Biological process=DNA repair
  Homolog annotation: Hit_ID=A7NY27; Match level="QueryCoverage=99%, HitCoverage=100%, E-value=1e-81, Identity=47%"; Hit description =Chromosome chr6 scaffold_3, whole genome shotgun sequence
  Pfam annotation: Domain name=GIY-YIG; Domain location=35-120; Score =48.2; E_value=2.9e-11; Accession=PF01541.15; Description=GIY-YIG catalytic domain
MRKRKVASVIEEEESVQNHGHNNQNENEDCEGNGFFACYLLTSLSPRFKGHTYIGFTVNPRRRIRQHNGEIGCGAWRTKKRRPWEMVLCIYGFPTNVSALQFEWAWQHPVESLAVRKAAVEFKSLSGIANKIKLAYTMLTLPSWQSMNITVNFFSTKYMKHCAGCPSLPVHMKTKFGSLDELPCYNKGIDGLSENEDDTIDEVQFDDNNISTSGSVPDVSDDLVTPDSPQNPNDGDKISEAFEWNKESEAREPPLGNSFASQEQSQLFSSTTPLTMKSSSTTSLQRAEIIEEDDFMSVMNKSDADLSQPEPEQSGATTLVANKNRDVGRTFVVPHETEIIDLSTPSPSCRSVLDRKKRRVSSSVGTDFIDLTNSPNFIEL

SEQ ID NO: 130341 - protein, 245 aa, Glycine max
  Coding DNA Sequence Number=SeqID_38656
  Gene Ontology: Mol. function=solute:hydrogen antiporter activity; Cellular component=integral to membrane; Biological process =regulation of pH
  Homolog annotation: Hit_ID=A7NY61; Match level="QueryCoverage=71%, HitCoverage=27%, E-value=6e-32, Identity=41%"; Hit description =Chromosome chr6 scaffold_3, whole genome shotgun sequence
MLNLLAAFTPTEASPIDLVVLHLIKLVGRASSLVAHVPQKKLSRHPTQTERIFNSFNKFEDAYKGKLNKNVLEKAPCSVGVLIDRGNQKMFWCGFRMGSIYQVVVLFFDGADDREALSYARRMLDQPYVHITLFHFSSSAKIVGGTKCCSNPDPFVDKSWYLEQGTIKKGSLSTTMASNGPFPANLPVLIGKNFSSHFEKIAGATIAKKAWDTLNKAYVGVDQVKKVRLQTLKRQLNCCRWTRMT

SEQ ID NO: 130342 - protein, 48 aa, Glycine max
  Coding DNA Sequence Number=SeqID_38657
MVKGHARHDSAYESHAGANLEEVAACDDGYEGCGGGACVAVEDGKGRK

SEQ ID NO: 130343 - protein, 30 aa, Glycine max
  Coding DNA Sequence Number=SeqID_38658
MEIFNNFEFYYLSTYFSIVPSLRKCDSTLI

SEQ ID NO: 130344 - protein, 345 aa, Glycine max
  Coding DNA Sequence Number=SeqID_38659
  Homolog annotation: Hit_ID=A7NY64; Match level="QueryCoverage=48%, HitCoverage=100%, E-value=5e-51, Identity=66%"; Hit description =Chromosome chr6 scaffold_3, whole genome shotgun sequence
MGNSLRCCLACVLPCGALDLIRIVHLNGYVEEITRPITAGEVLKANPNHVLSKPSSQGVVRRILILSPETELKRGSIYFLIPESSLPEKKRLAGKGRNVGGDNDIKKKPSTLKGNKGSSDDDYSSLSQGCLNKATHKGSKEKKSSCRDRRKGRIGIWRPHLESILEDYFEKWDAPEENHREGRRGRLKFFSEIINQEAQQPHPGEGNAPEKNPHCVVVVLEEARRGRATQSGEDHEAEEPMVAEHGSVSNDSDGDYDDDDELDEVFSFGTSFVDVVAADWLSQKGAEKYFKHGSHLKWPEGAVSRESISAVKKLGHLKDEVRNATKFDLPNKDRKDSQGICFLGK

SEQ ID NO: 130345 - protein, 102 aa, Glycine max
  Coding DNA Sequence Number=SeqID_38660
  Gene Ontology: Mol. function=binding
  Homolog annotation: Hit_ID=A7NY71; Match level="QueryCoverage=99%, HitCoverage=10%, E-value=4e-35, Identity=74%"; Hit description =Chromosome chr6 scaffold_3, whole genome shotgun sequence
MASKFGLAGGIPERKVRPIWDAIDSRQFKNALKHVSTLLAKHPNSPYALALKALVLERMGKPDEALSVALNAKELLYANESLLMDDLTLSTLQIVFQRLDHC

SEQ ID NO: 130346 - protein, 148 aa, Glycine max
  Coding DNA Sequence Number=SeqID_38661
  Gene Ontology: Mol. function=aspartic-type endopeptidase activity; Biological process=proteolysis
  Homolog annotation: Hit_ID=A5AZ88; Match level="QueryCoverage=68%, HitCoverage=13%, E-value=1e-17, Identity=36%"; Hit description =Putative uncharacterized protein
DVIQKILPPKHKDPGSVTIHCSIGEVIVGKTLIDLGASINLMSLSIKTFYLPADFVVMDICEDNDIPLILGRPFMLTASCVVDVGRKKLEMGFKDQRIDFDLFVKDKPVPEQNVCLQPALSAQTLASQADWLAKPSMGELSPIQFDLD

SEQ ID NO: 130347 - protein, 76 aa, Glycine max
  Coding DNA Sequence Number=SeqID_38662
MNCSTSLRIPGHMKFSLILAMVLVTPICPPTGEKWNSANNVEMKGEVLELHSRRSGRGLKNWSSTLNARSQLGGQA

SEQ ID NO: 130348 - protein, 192 aa, Glycine max
  Coding DNA Sequence Number=SeqID_38663
MQLWPRTTREQATSKGWDPSSADAGCTGKTSHLATPDPMIDRLLRWTLEMVAVVEVAAVHMRLAAADGPAPAAASTRFLGDQLALRQGKIKIMIAGEDVAEKQCHTNLCQGGHASTHDPHLSPRHTSSKVLPRNTQQLADEKVKFEWRWYLCEMKENAKKMKAKGHNGSLGLLQRVASISLLEALSFGKEMG

SEQ ID NO: 130349 - protein, 144 aa, Glycine max
  Coding DNA Sequence Number=SeqID_38664
  Homolog annotation: Hit_ID=A5C843; Match level="QueryCoverage=38%, HitCoverage=10%, E-value=3e-08, Identity=39%"; Hit description =Putative uncharacterized protein
  Subcellular localization annotation: CTP_CleavageSite=37; ConfidenceScore=5.54e-01
MFAHSIKRLPSLGADVWGANTFPVRKYNSRTFHLKVRRSRLFRFFRRFPQINVGGDSARIPFVEHASRESRVALPPKGRLRQLGFDCTKNIAEYEACALGIQAAINFKAYIKKLIEFFDDISFHHIPREENQMANALATLASMF

SEQ ID NO: 130350 - protein, 78 aa, Glycine max
  Coding DNA Sequence Number=SeqID_38665
MTGEGISPYIQTVLLKHQSSHVNQALYLVLEGHTLLYRMPRNTTLISTGCIGIVPSGEGGLIDLPGVHHDHLVADQRW

SEQ ID NO: 130351 - protein, 142 aa, Glycine max
  Coding DNA Sequence Number=SeqID_38666
MAGAGDNGDVYHQLDGSQHLFLDAMTIQMQRLLNRNKEELYRRIAKSSLFVLKPLSPREEIPPGLPPSRGIEHQDAHAKVEYVKRLYDQVNVQIAKKNESYNKQANKKRKEVVLEPGDDLGHLRANIFQEGGNDENPETDQI

SEQ ID NO: 130352 - protein, 122 aa, Glycine max
  Coding DNA Sequence Number=SeqID_38667
MTSKLQMLITLATVVRLRPTIYQNAQNSEENPDKGFDFFFDTKSERYKKQEQEQERNKDTNKNATRRKQERNKDKLQKKKDRIEPVPRAEALIPDNVNLTRSRSLDTGYYGDLDDATSKEGR

SEQ ID NO: 130353 - protein, 162 aa, Glycine max
  Coding DNA Sequence Number=SeqID_38668
MAAEQFYNCKLLEEEVGVCVEVVRGKIFETKCEDIVVLGIRGFFSLSANCFSSLLREQLLLLRKASAKLVFFFSANEDNNPRVEDERRRCWKKWGKDSRRRLPEDPLGVLPELPEEHVPETFQKKCSSGSNQTSSGRTLLSEVSRNTSFGYFPEEVVLPDDL

SEQ ID NO: 130354 - protein, 514 aa, Glycine max
  Coding DNA Sequence Number=SeqID_38669
  Homolog annotation: Hit_ID=Q5XM22; Match level="QueryCoverage=24%, HitCoverage=84%, E-value=6e-48, Identity=67%"; Hit description =Resistance-like protein HAAS-2
MARTRGLGRVIGRLVGRDRQDDHDAADVPERRRPTASARRQRVHQTTADARDMTEDIANMTNDVPDVAAEALEMRADIQGADGAEGSDADDAAEGFLGGPCDPLVLASFADHVAHAVWSGQEHPYLKLVSHGRKVTLIERSVPEIEGLVAATRLSPLIDCSVIIGDPGLISAFVERWHELLEVSAEEARAETALTRGAYVQLGWVRDIYETRCQARRWIVAARAYLLHLVGCTLFANKSATYVHVVHLDAFRDLAQSGGYAWGVAALVHMYDQLDEACRTTTRQLAGYLMLLQCWIYEHFPSVHQCMTDDTYQETSPRASRWLTSKAHMKGITGAPYRARCDGLTITDVSWLLYMEHRGVRAFQEIASFQGQLRWGPMMFGYIQSILPPPVSARLSRDEIDDRWMQFAEHLLPAGQLCLVPGQVTSREMHQLQTPMTTYNRPAPRFQWHLTPLYMWMITTDETIAQRLERVLNLRIVTAGTELYDIMQDCLTIAKGGPSADGTVRARQRRRTDH

SEQ ID NO: 130355 - protein, 113 aa, Glycine max
  Coding DNA Sequence Number=SeqID_38670
  Gene Ontology: Mol. function=catalytic activity
  Homolog annotation: Hit_ID=A7NY78; Match level="QueryCoverage=84%, HitCoverage=31%, E-value=1e-35, Identity=77%"; Hit description =Chromosome chr6 scaffold_3, whole genome shotgun sequence
MAIPMLRAAMISHSTSKKLNTGGEDAFLVSNYNGGVIAVAVSGWAEEDVDPSLFPRELLANASNFVGDEEVNYDPQILIRKSHAATSSRGSATVSIVAMLEKNGTLKIANVGD

SEQ ID NO: 130356 - protein, 488 aa, Glycine max
  Coding DNA Sequence Number=SeqID_38671
  Gene Ontology: Mol. function=[acyl-carrier-protein] S-malonyltransfera se activity; Cellular component=mitochondrion; Biological process =fatty acid biosynthetic process
  Homolog annotation: Hit_ID=Q2VA66; Match level="QueryCoverage=49%, HitCoverage=70%, E-value=1e-122, Identity=93%"; Hit description =Malonyltransferase
  Pfam annotation: Domain name=Acyl_transf_1; Domain location=179-477; Score=-95.4; E_value=4.6e-05; Accession=PF00698.12; Description=Acyl transferase domain
MVPTTHRHNNPHGGTMHEKKHGQRNDLDSFTRINIRPAMIWINNNTPEGHPEQQSFVVAIFLGALVMGFLTDMFGIAIANGPVFLGLVIPDGPRVGATIVQKTETIMADILLPFSFIMVGSYTDFYAMSASGWSSLEPLIVMVITGYVLKFFSTWIVLHFWRMPLREGLTLSLTLSLRGHIELILFVHWMDKNILHIPDFTLLVLMTTILQMQCLPSDSLLLQPAIYVTSLAAVELLRARDGGQQIIDSVDVTCGLSLGEYTALAFAGAFSFEDGLKLVKLRGEAMQDAANAAKSAMVSVIGLDSEKVQQLCDAANQEVPEAEKVQIANYLCPGNYAVSGGLKGVEVLESKAKSFKARMTVHLAVAGAFHTSFMKPAVSRLEAALATTEIRTPRIPVISNVNAQPHTDPDSIKKILACQVTSPVQWETTVQTLLTKGLKKSYELGPGKVIAGIIKRTDKGSVCHFAICRAPNIGSCIPKQQNKANREK

SEQ ID NO: 130357 - protein, 68 aa, Glycine max
  Coding DNA Sequence Number=SeqID_38672
  Gene Ontology: Mol. function=protein serine/threonine kinase activity; Biological process=response to abscisic acid stimulus
  Homolog annotation: Hit_ID=Q940H6; Match level="QueryCoverage=82%, HitCoverage=20%, E-value=4e-15, Identity=59%"; Hit description =Protein kinase-like protein
MTQIADVRSCGVTLYVMLRILNVQYSIPDYVHISSECRHLLSRIFVADPAKLIPVIKIIADAVSWLHK

SEQ ID NO: 130358 - protein, 169 aa, Glycine max
  Coding DNA Sequence Number=SeqID_38673
  Gene Ontology: Mol. function=[acyl-carrier-protein] S-malonyltransfera se activity; Cellular component=mitochondrion; Biological process =fatty acid biosynthetic process
  Homolog annotation: Hit_ID=Q2VA66; Match level="QueryCoverage=85%, HitCoverage=38%, E-value=1e-60, Identity=84%"; Hit description =Malonyltransferase
  Subcellular localization annotation: CTP_CleavageSite=32; ConfidenceScore=5.72e-01
MSSSLVLPSTPFFAHGTRTLPLTRSRLSMTVSAGSQPSLRDALFADYKASTSFLFPGQGAQAVGMGKEAQNVPTAAVLFNKANDVLGFDLLDICINGPKEKLDSTVISQMQCLPSDSLLLQPAIYVTSLAAVELLRARDGGQQIIDSVDVTCGLSLGEYTALAFAGAFR

SEQ ID NO: 130359 - protein, 122 aa, Glycine max
  Coding DNA Sequence Number=SeqID_38674
MISDVVFFDRSNTLFFFIEGHANLECIGWWCRWAANTLVIALVITLVIALVIDVIKELLILFLTKIIHVFLMKLGMNDGFVGQKRLLYEDTGSLRSRLLYDNCSGGGSCSCGHEGCGDDGCG

SEQ ID NO: 130360 - protein, 43 aa, Glycine max
  Coding DNA Sequence Number=SeqID_38675
MINFDSQYLEVVSEAKHLPCSHVVVACKSVNVDPMNYVPLLFT

SEQ ID NO: 130361 - protein, 45 aa, Glycine max
  Coding DNA Sequence Number=SeqID_38676
MEMKGSVRGTSGCMRFIGVQNLDDVKSREVEPQRQKDEEMKKREE

SEQ ID NO: 130362 - protein, 85 aa, Glycine max
  Coding DNA Sequence Number=SeqID_38677
MAKQAFCLSLILKAKLAMWLATALVGEDVAFYSLEINSFHSLELFGHPYCRLPFSRYISLQYKLVIYDNEKQQIKVDELIMKFRV

SEQ ID NO: 130363 - protein, 83 aa, Glycine max
  Coding DNA Sequence Number=SeqID_38678
MLCVIDYNDLGTSFVVQVEGTSTWVVVTENKRGYISCGSVLVEGTSTRLFKENKGGYIPCGSLLVKEFTRLKRNLKDRKSLGD

SEQ ID NO: 130364 - protein, 119 aa, Glycine max
  Coding DNA Sequence Number=SeqID_38679
MGHPPRTDTIHQHRPHLQQNDATLVITVEAEAENDAANRDLGCGSVEEELTEEAAVPMGAMVVVAEASWVFAIDQDNYELLLSRCIKEDLGFKNETHEEVAIKKVGNAFDNRIDAKRTL

SEQ ID NO: 130365 - protein, 64 aa, Glycine max
  Coding DNA Sequence Number=SeqID_38680
MSSLSVTTLRSSDDFTKGELSGQKQNQNVGHGEKGDDVGMELDGERGVALGELEPFPNSSCGYV

SEQ ID NO: 130366 - protein, 381 aa, Glycine max
  Coding DNA Sequence Number=SeqID_38681
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=A7Q314; Match level="QueryCoverage=90%, HitCoverage=70%, E-value=1e-151, Identity=75%"; Hit description =Chromosome chr12 scaffold_47, whole genome shotgun sequence
  Pfam annotation: Domain name=Glyco_hydro_17; Domain location=1-247; Score=37.8; E_value=4.8e-13; Accession=PF00332.9; Description =Glycosyl hydrolases family 17
  Pfam annotation: Domain name=X8; Domain location=266-348; Score =132.7; E_value=1e-36; Accession=PF07983.4; Description=X8 domain
  Pfam module annotation: Pfam domain module=Glyco_hydro_17::X8; Domain location=1-247::266-348
MVPSTYGSKYNSCRYVAVGDEPFLKSYGEQFHPFLIGAAMNIQAALKKAKLDSKVKVVVPCSFDSFESGFNLSSGVNFRPDLNKTMIELLAFLDKHGSPFFVTISPFITHLQTKNISLDFSLFKETARPHNLSHKTYKNSFDLSYDTVATVLSTAGYPNMDIVVAKIGWPTDGAANASSYLAETFIKGLINHLHSNLGTPLKPHKPPLETYILSLLDEDQRSITSGNFERHWGLFTFDGQAKYHVDLGQGSKSLVNAQNVEYLSSKWCVVNNNKDLSNATASALEACANADCTALSPGGSCFNISWPSNISYAFNSYYQQHDQRAESCDFGGLGLITTVDPSMDHCRFPIEIRVSHAEFHRMCNFLRVILLVTTLLASLTV

SEQ ID NO: 130367 - protein, 119 aa, Glycine max
  Coding DNA Sequence Number=SeqID_38682
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=A7Q314; Match level="QueryCoverage=72%, HitCoverage=17%, E-value=5e-31, Identity=74%"; Hit description =Chromosome chr12 scaffold_47, whole genome shotgun sequence
  Subcellular localization annotation: CTP_CleavageSite=91; ConfidenceScore=5.28e-01
MPTTTTTFSCFLFTFLITTSTMASMVGAVGVNWGTMASHPLPPHKVVKLLKSNSINKVKLFDANSDVLQALSGSNIAVTVGVPNTLLRSLNSSKKAADSWVHDNVTRYMPNGGTVTRIE

SEQ ID NO: 130368 - protein, 114 aa, Glycine max
  Coding DNA Sequence Number=SeqID_38683
MQAFAKRNTLGLSTRKNPEEDELYRFAKRTASVHKRLTNLADNNINLALVKEFYANLYSPEGPSPKQTASTPSWRHLWYWPRENPYPLTPDIAGCSLISERLRLLCVYPAEGLF

SEQ ID NO: 130369 - protein, 62 aa, Glycine max
  Coding DNA Sequence Number=SeqID_38684
MKKKESTEETSCSKPKMENLSKWKTQQETKAKIGNEAGRRKKANERSRLKLVRRSRKWRNLK

SEQ ID NO: 130370 - protein, 54 aa, Glycine max
  Coding DNA Sequence Number=SeqID_38685
MTGHASQWIRRPVRVTLFCENAPIMWDQHRLIGALKPDDPQGLHSEESVRAFPS

SEQ ID NO: 130371 - protein, 77 aa, Glycine max
  Coding DNA Sequence Number=SeqID_38686
MFVDRGSGRHHKWMITMNNGLSCVAEAWIHYLVDCHLKPGDEVVFFYNIDQHLWEVLYRKQTIDPTLTLGSAFLSAD

SEQ ID NO: 130372 - protein, 698 aa, Glycine max
  Coding DNA Sequence Number=SeqID_38687
  Gene Ontology: Mol. function=phosphoprotein phosphatase activity; Cellular component=membrane; Biological process=two-component signal transduction system (phosphorelay)
  Homolog annotation: Hit_ID=Q6D885; Match level="QueryCoverage=41%, HitCoverage=69%, E-value=2e-90, Identity=57%"; Hit description =Putative uncharacterized protein
  Pfam annotation: Domain name=CBS; Domain location=378-502; Score =15.1; E_value=0.0017; Accession=PF00571.19; Description=CBS domain
  Pfam annotation: Domain name=MCPsignal; Domain location=166-377; Score=28.1; E_value=3.4e-08; Accession=PF00015.12; Description =Methyl-accepting chemotaxis protein (MCP) signaling domain
  Pfam annotation: Domain name=PAS_3; Domain location=92-172; Score =45.1; E_value=2.5e-10; Accession=PF08447.2; Description=PAS fold
  Pfam annotation: Domain name=SpoIIE; Domain location=561-693; Score= -26.2; E_value=0.021; Accession=PF07228.3; Description=Stage II sporulation protein E (SpoIIE)
  Pfam module annotation: Pfam domain module=CBS::MCPsignal::PAS _3::SpoIIE; Domain location=378-502::166-377::92-172::561-693
MVQSPQYREFWQRLNRGEGFSDKFLRVAKHSRPIWLEANYVPVQDRHGRVIKIVKLASDITARIMDAQEQRAMTTAIERSMAVIAFNLKGEVLMANDNFFNTMGYRADEIIGRHHSLFCPPEMRTSEAYRRFWHKLNQGEYISGQFERVNKQGNTVWLRATYNPFATDVTAQVEKNQLEREAAQQAWQTALHTSESTQQGAAVIENSVQNINALASELHGISGDINDLSDSSDRIGAIVESIRRIADQTNLLALNAAVEAARAGHHGRSFAVVASEVRTLAANINRATSEIENRVRHNHLLADKAQKGIASNLKRADQGVVLAQQAGGVIAEIRGSSSEVVRAISHVADTLKAPQLFLMQQPDFRTGLSALTGRARARSLCIAVPFVTPAMDNTAVMALFSEHKDLIGLPVVENGTPFGMINRHIFLSQMTRPFFRELYDRKSCIAFMDKQPLVIDAETELDRVAQQVVASGDKSVTDGFIVTEQGRYIGIGLGIDLIRTVSDLQAQQHQQILQSIDYARVIQDAMLDRSRQQMAQQLSDWCLHWQPRDGVGGDYYAFHRDEHGWLALIADCTGHGIPGAFMTVILHAALERALQHNHRTPSALLQALNRHIKQTLGQLNASQQTSLSNDGCDAIALRLETASHQLSWASARMHAVLQPVQGKPPRCRPIASALATPIHRTTIAGRSSSAHCSPAMCC

SEQ ID NO: 130373 - protein, 690 aa, Glycine max
  Coding DNA Sequence Number=SeqID_38688
  Gene Ontology: Mol. function=phosphopentomutase activity; Cellular component=cytoplasm; Biological process=deoxyribonucleotide catabolic process
  Homolog annotation: Hit_ID=A7FMH3; Match level="QueryCoverage=56%, HitCoverage=99%, E-value=1e-180, Identity=77%"; Hit description =Phosphopentomutase
  Pfam annotation: Domain name=Glycos_transf_3; Domain location=1-195; Score=51.0; E_value=4.2e-12; Accession=PF00591.12; Description =Glycosyl transferase family, ab domain
  Pfam annotation: Domain name=Metalloenzyme; Domain location=559-668; Score=146.9; E_value=5.8e-41; Accession=PF01676.9; Description =Metalloenzyme superfamily
  Pfam annotation: Domain name=PPM_N; Domain location=301-393; Score =145.0; E_value=2.1e-40; Accession=PF08342.1; Description =Phosphopentomutase N-terminal
  Pfam annotation: Domain name=PYNP_C; Domain location=212-286; Score =115.1; E_value=2e-31; Accession=PF07831.4; Description=Pyrimidine nucleoside phosphorylase C
  Pfam module annotation: Pfam domain module=Glycos_transf _3::Metalloenzyme::PPM_N::PYNP_C; Domain location=1-195::559-668::301- 393::212-286
DDRFRQIIKQVGVAIIGQTNSLAPADKRFYATRDITATVDSIPLITASILAKKLAEGLDALVMDVKVGSGAFMPTFEASQQLAQAIVGVANGAGCKTTALLTDMNQVLASSAGNALEVREAVHFLTGEARNPRLLEVTLALCAEMLISGKLAANEAEARQKLQQVLDNGKAAEVFARMVAAQNGPTDFIEQMDRYLPAPMLSKAVYADRPGIVSAMDTRALGMAVVALGGGRQRASDSIDYSVGLSDMITLGSEVNAQQPLAVIHAASEAQWQQAAAAVKAAITLSDHAPEATPVETCMKRAFIMVLDSFGIGSSKDADKFGDEGSDTLGHIAEACFEGRANEGREGPLHLPNMTALGLGKAAELSTGRFPPGLDPQAEIIGAYALRQRTLFGQRYAVRPLGNRRGAGAELLDTLVKRADLPGYLGNCHSSGTVILDQLGEEHMKSGKPIFYTSADSVFQIACHEETFGLDRLYALCEIAREELTNGGYNIGRVIARPFVGDKAGNFQRTGNRHDLAVEPPAPTMLKKLVDEKGGEVISVGKIADIYAEQGITQKVKATGLDALFDATIEQMKKAPDNSIVFTNFVDFDSTWGHRRDIAGYAGGLELFDRRLPELMALVKEGDILILTADHGCDPSWHGTEHTREHIPILIYGPEVKPGSLGYRDTFADIGQTIASYFGLSSMDYGKSLR

SEQ ID NO: 130374 - protein, 810 aa, Glycine max
  Coding DNA Sequence Number=SeqID_38689
  Gene Ontology: Mol. function=endodeoxyribonuclease activity, producing 5'-phosphomonoesters; Cellular component=nucleus; Biological process=lipid metabolic process
  Homolog annotation: Hit_ID=A6THZ3; Match level="QueryCoverage=38%, HitCoverage=87%, E-value=1e-131, Identity=72%"; Hit description =Putative transcriptional regulator
  Pfam annotation: Domain name=Amidohydro_2; Domain location=534-808; Score=-21.5; E_value=0.024; Accession=PF04909.5; Description =Amidohydrolase
  Pfam annotation: Domain name=BON; Domain location=142-199; Score =59.0; E_value=1.6e-14; Accession=PF04972.8; Description=Transport -associated domain
  Pfam annotation: Domain name=BON; Domain location=63-126; Score=63.3; E_value=8.2e-16; Accession=PF04972.8; Description=Transport -associated domain
  Pfam annotation: Domain name=Patatin; Domain location=276-445; Score =87.1; E_value=5.5e-23; Accession=PF01734.13; Description=Patatin -like phospholipase
  Pfam annotation: Domain name=TatD_DNase; Domain location=564-807; Score=239.3; E_value=8.6e-69; Accession=PF01026.12; Description=TatD related DNase
  Pfam module annotation: Pfam domain module=Amidohydro_2::BON::BON::Pat atin::TatD_DNase; Domain location=534-808::142-199::63-126::276 -445::564-807
GLTDRRMISMNKTKIAKTLIAALAGTALLSGAAMAADTSSSAGSKIDSSMKKVDGFMDDSGITAKAKAALVDDEAIKSTDISVKTQQGVVTLSGFVTSQDQAEKAVALVQKVEGVKSVSDKLHVRDSKQSSLKGYAGDAATTSEIKAKLLADDIVPSRNVKVETTDGVVQLSGEVANQAQSDRAEKIAKAIEGVKSVKNDLKFDFHYGKGEAYVSLGYYLSGHRSDCCSIRFWRSGGASLRAANTEGHPLGIRIPVSLDTFEPLALTPFKSKKIALVCEGGGQRGIFTAGVLDEFQRAGFNPFQLMLGTSAGAQNLSAFVCAQPGYARRVITRYTTSKLFFDPLRFVRGGHLIDLDWLVDITKQEFPLALSSAESLFAKGSEFYMCACRSDDYSAQYFNPTNLTWHDIIKASSAIPGFYRSGVLMDGVSYLDGGISDAIPVREAARRGADTIVVIRTVPSQMAYTPKWFKRMERWLSDSALQPMINILHQHEESYRQIQQFIEQPPDNLRIIEIFPPKPLASMALGSRLASLNQDYHLGRRSGRYFLATLGQWLSDAEPLARPIAVTPPAAVANAPDNRPAGVERIIVPCVDASRFAVVSQLAQQHPALYSALGLHPINIAQHQDDDLDRLEQYLQTPDAKRVAMGEIGLDLYMEAPDFARQTRLLEAQLKLAKRYDLPVILHSRRTHDQLAQYLRRHDVPRRGVVHGFAGGQQQAERFIALGYAIGVGGTITYTRASKTRHTIASLPLQALLLETDAPDMPLHGFQGQPNRPERARNVFEVLCQLRPEPPDEIADALWHNSLRLFALPD

SEQ ID NO: 130375 - protein, 177 aa, Glycine max
  Coding DNA Sequence Number=SeqID_38690
MLAGAATFNGTGGLDRLSEQQDFFGDCGFTGVRVRDDRKGQRASGALRINHSGASPADNGANGDACASGHSRVCAIYIGGSPVIPSALRRHSIQYFSRRGNLRQDETMLAQFRTCLVNTKRCLAENACPEPSPRQGQQNDPTAQPTYLQPVAPKRRPGVARADVPQTRRDAADQRAG

SEQ ID NO: 130376 - protein, 520 aa, Glycine max
  Coding DNA Sequence Number=SeqID_38691
  Gene Ontology: Mol. function=transition metal ion binding; Cellular component=cytoplasm; Biological process=cellular iron ion homeostasis
  Homolog annotation: Hit_ID=A8GD55; Match level="QueryCoverage=30%, HitCoverage=90%, E-value=3e-65, Identity=76%"; Hit description =Ferroxidase
  Pfam annotation: Domain name=Ferritin; Domain location=2-139; Score =169.6; E_value=8.3e-48; Accession=PF00210.15; Description=Ferritin -like domain
MTSRLNDQLNLEFFSANLYLQMSAWCSDKGFEGAASFLKMHSREEMQHMQKLFDYVSDAGSLPVLGSIAAPAVSWTSLNDVLEEALKHEQLITSKINELVHAALTSQDYSTFNFLQWYVAEQHEEEKLFKTVLDKLALVGNKGEGLFLVDKDLGRMNRLQSELRRLWPAKQVALKQRTALFAQPDKLLITLHALCGDLNIQAAAHAGNRADDRQRLAAIAERRIAGAEVVERNLHAQRFQALQRTDIAERIIQQHRFGDLHLQPMRRQAGFAQRALHHRYQRAVLKLQRRQIDRDRLFGFPALRLAAGFVQRIGAEHMDQPGLFGNWNEVIRHDQSFDRMMPAHQRLIANDAGLVGDRLIVELQLPSGDRLAQIVLDHPAAARHIIHLQRKVLIAVTAVTLGFIQRHVGAAQHMFRRIGGLRGQRNADAQPDRQVVAFNIHRRADRLDQALRHDRGLIGIPHVGQHDGKLIAADARQRVLIAQYAAQPLRHYPQQIVTDLMPQRVVHVLEVIQIETQLER

SEQ ID NO: 130377 - protein, 291 aa, Glycine max
  Coding DNA Sequence Number=SeqID_38692
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIWTSKGFAPESKALLAAIVDQMPSSGSPAYERNLHLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130378 - protein, 163 aa, Glycine max
  Coding DNA Sequence Number=SeqID_38693
  Gene Ontology: Mol. function=oxidoreductase activity, acting on NADH or NADPH; Cellular component=plasma membrane; Biological process =photosynthesis, light reaction
  Homolog annotation: Hit_ID=Q98KR4; Match level="QueryCoverage=100%, HitCoverage=99%, E-value=7e-85, Identity=89%"; Hit description=NADH -quinone oxidoreductase subunit I
  Pfam annotation: Domain name=Fer4; Domain location=56-79; Score=25.9; E_value=3.1e-05; Accession=PF00037.18; Description=4Fe-4S binding domain
  Pfam annotation: Domain name=Fer4; Domain location=96-119; Score =33.6; E_value=6.9e-07; Accession=PF00037.18; Description=4Fe-4S binding domain
  Pfam module annotation: Pfam domain module=Fer4::Fer4; Domain location=56-79::96-119
MASFAQAAKSLLLKEFVGAFFLSMRQFFAPKATLNYPHEKGPVSPRFRGEHALRRYPNGEERCIACKLCEAICPAQAITIEAGPRRNDCTRRTERYDIDMVKCIYCGFCQEACPVDAIAEGPNFEFATETREELYYDKEKLLANGDRWESEIARNIAMDAPYR

SEQ ID NO: 130379 - protein, 110 aa, Glycine max
  Coding DNA Sequence Number=SeqID_38694
ARRLWMTQGCRKTKFCLCVSSGPPPLDDKKGADNRKGQYDKDYGAVDKSKALAPTYPPMRNSDLRADNRKVSPRATSSWVMVTESSVVDKSEAFAPTYPPMRNSDLRSSG

SEQ ID NO: 130380 - protein, 64 aa, Glycine max
  Coding DNA Sequence Number=SeqID_38695
MKKQQWKRSGRQRRRGERRRHPLGNKPWKKELHHQDEPWIRSLERMLQWRKRKRERKREGGARN

SEQ ID NO: 130381 - protein, 190 aa, Glycine max
  Coding DNA Sequence Number=SeqID_38696
MKSLVVSSPLYGNLFFCKRDIIVGGYMINDAFKTLHLDIVGYMGIIEDFYQQRTMRLVVYEQFKQRYPCWGFIQLLDYLKLALLDEVKELMGLFQSHRLSLKTFFLFSPSYHWRIYFFRGGGYVCGLLDHGRFPLGGQLCRVRGSEHPTTAGYATEAGDVVTLADRESTSVAILSPNAGGVYFHRTALLL

SEQ ID NO: 130382 - protein, 125 aa, Glycine max
  Coding DNA Sequence Number=SeqID_38697
MKGRHGGHERENGHNDGGHDEHEEDNGSQCGKDLGSTDDPMMCKFKTSTPSRHMACLPNYTPPNVAYIPNEDVNNSTPILIKSQQPQSDHAHVSRPMEETHGMPYHNLADFEPWLGYATEGQAVG

SEQ ID NO: 130383 - protein, 148 aa, Glycine max
  Coding DNA Sequence Number=SeqID_38698
  Subcellular localization annotation: CTP_CleavageSite=34; ConfidenceScore=5.37e-01
MKNKKNGPQHRGKWYSTPPKQYGNCPNNQRTVAVGFAAGSGSKPNTFPTQVTCYKCGMPRQKGYIQRDCPYPKKEQNDGGLNDQTGHPKATGRVFTLNDAKASKSKDLIQVSKDMMFISANQVMTSLKEDAQVYMILSNLEIETGFHV

SEQ ID NO: 130384 - protein, 87 aa, Glycine max
  Coding DNA Sequence Number=SeqID_38699
MDPKSSCRGNPTNYRTFIVLLNWIIDVQFSCMQRRSAAGDLIPIDLEINATCRRCNSERIIIFLQDIEAAVMQSYPSRALDRRLHED

SEQ ID NO: 130385 - protein, 449 aa, Glycine max
  Coding DNA Sequence Number=SeqID_38700
  Homolog annotation: Hit_ID=Q6WAY6; Match level="QueryCoverage=89%, HitCoverage=69%, E-value=3e-30, Identity=27%"; Hit description =Putative uncharacterized protein
MVPTIEEFEEILGCPLGGRKPYLFSGFLPSLSKIAAVVGDSTKELDRMKQTRNGVVGLPRKYLEGKARDMASQEKWGPFADILALLIFWVVLFPNVDGLVDLAAIDAFLAYHHCKESPVVAILADLFDTFDWRCKKNSARIVCCLPALCVWLVSHLFQQDTRHPCPLQSYRSCAEKGRVDWDQHLAGIGGSAINWFPRWKEGKEGVLFSCGDYPNVLLLGTRGCINYNPALAIRQLGYPMRGAPTEESLSPLLVRDLGAQSLKVIQRVHKAWRSSLRKDKELRGIRNGVIGGYHGWLRVHTRGLDWFSKFKVIDEENFEAPEEDEEVRALKLELGKARLAKEKFKSATTHIRKECTELQEENTATARALEQETKRARKEEHGREKFRGALWGSNNELKLRREERDRSRVHGMILKEELAACARSKRSLAQHLEATEQSMLAIIGQYKEE

SEQ ID NO: 130386 - protein, 345 aa, Glycine max
  Coding DNA Sequence Number=SeqID_38701
  Homolog annotation: Hit_ID=Q84VI1; Match level="QueryCoverage=98%, HitCoverage=49%, E-value=1e-126, Identity=72%"; Hit description =Envelope-like protein
MATSPKETSAPGSPSVPSSPHQEQPEFNIQPIQIIPGQAPVPEKLVPRRQQGVKIAENPSLATRPREVDTEMDKKIRSIVSCILKDASVPEADEDVPTSSTPNVSVPDVDKDVPTSSAPNAEVLSSPSKERSTEEDDQATEETPAPRAPEPAPGDLIDLEEVESDEEPIANKLAPGIAERLQSRKGKTPIKRSGRIKTMAQKKSTPITPTTSRRSKVAIPSKKRKEISSSDSDDDVELDVSTSKRAKKSGKKVPENVPDAPLDNISFHSIGNAERWKYVYQRRLALERELGRNALDCKETMELIKAVGLLKTVTKLGDCYESLVREFIVNIPSDITTERVMSIKK

SEQ ID NO: 130387 - protein, 121 aa, Glycine max
  Coding DNA Sequence Number=SeqID_38702
MMHAPDLNSQMQCGTYRIQYQGNSPKRVYMTPHLGNHAVFVEATQSCIVTPPLGDQLGATRSSLPGDTPPSTKYILPQFILFPVSYKFPTQETSDKVNAPPNGHTQHTMYKVGTIKYNGHG

SEQ ID NO: 130388 - protein, 120 aa, Glycine max
  Coding DNA Sequence Number=SeqID_38703
MSPYSSHDSCKRLSEELHDYYEGSHRSHLRPHSQRRKKERKPQEANINLPYFHRKDNVEAYLDWEIRVEQQLKRKGHITSQCPTKKTMIMRGQDIYSSQDEGIYPQEEGQPLMVKEECKE

SEQ ID NO: 130389 - protein, 59 aa, Glycine max
  Coding DNA Sequence Number=SeqID_38704
MQAQGSINQTSIQLKMGARDKSFMHTEGWAYPPLAQALRLQRPHPLPKEKAGLLAKPLG

SEQ ID NO: 130390 - protein, 67 aa, Glycine max
  Coding DNA Sequence Number=SeqID_38705
MKKQQWRKRIRGERRGHPLGNKPWKEELHHQESTLDKKLRGEATMEEKNDREKEGSTKLKEKKGERS

SEQ ID NO: 130391 - protein, 40 aa, Glycine max
  Coding DNA Sequence Number=SeqID_38706
DSLDEDENIDEISDTDNEAACLIEPLTVVQSGEGGSQTPF

SEQ ID NO: 130392 - protein, 132 aa, Glycine max
  Coding DNA Sequence Number=SeqID_38707
MAGMRKLDHLEERLRAIEGGEDYAFANLEELFLIPKRGHSQVQGAGLWQVQGDYSLQEPSKDDLMVAFIKQYQYNSDMVPDRMQLQNMCKKGDGSFKEHAQKVEGSGGPGGTPNNGKGDDNRDGRHIIGTLL

SEQ ID NO: 130393 - protein, 144 aa, Glycine max
  Coding DNA Sequence Number=SeqID_38708
  Homolog annotation: Hit_ID=Q9LHC7; Match level="QueryCoverage=63%, HitCoverage=11%, E-value=5e-07, Identity=31%"; Hit description =Retroelement pol polyprotein-like
MAERGGEGNRPPRRTLGDYAYQQGPKHYNIIAIPPFSNKVVELKPALLSPIGSHPFAGMDHEDPYTHVSSFMELCSTMGASDEDVKAIYLRAFPFSLTAGGTMMSKCPEEANVIIDSRVATDDQSHHDRAPTQRKGIMELGHSK

SEQ ID NO: 130394 - protein, 174 aa, Glycine max
  Coding DNA Sequence Number=SeqID_38709
GAEPGRSVVVQILVVVANIQMRTLKAEERKGFHGIGLKFLNRDVAADGNVRESGDVGGGPGKSYLFCLTACPPWKRLSRRTECLPRPVVLITASGLQVPNPSAVGGLLELLRGESGSSRAGRGRMGTALRGLFPGVEQSTQNCALNVKVKKFNQARVNGGSNYDSLKVAKCLVI

SEQ ID NO: 130395 - protein, 105 aa, Glycine max
  Coding DNA Sequence Number=SeqID_38710
MVSKVWSFNGQQWWMRRGEEKQREKLCHMSPFEWSKKGPTFSLDVTHTQPQGEKNLTFEMLKSCLGLCAISLVPVPRVSLHPSGPVFESKQYIYQNAQNETPSVF

SEQ ID NO: 130396 - protein, 107 aa, Glycine max
  Coding DNA Sequence Number=SeqID_38711
  Homolog annotation: Hit_ID=A7R5Q5; Match level="QueryCoverage=92%, HitCoverage=20%, E-value=7e-12, Identity=39%"; Hit description =Chromosome undetermined scaffold_1022, whole genome shotgun sequence
MAQPPPRERTLREMTAPDFPYESLCIQYPDEDVPYVLKTGLIHLLPKFHGLAGEDPHQHLKEFYIACSTMKPPDVQEDHIFLKAFPHSLEGVAKDWLYYLAPRSITS

SEQ ID NO: 130397 - protein, 141 aa, Glycine max
  Coding DNA Sequence Number=SeqID_38712
MEFNGGGGHNPLFEDSPSECGGGAATVGFPTVIFLTVIFCCYKMPIYISSLLSRNDRLRALVSFCQQFISFFSYTKLNFCESKSIGVHKVRGSFRCTRSEPTGCRILGEERNQNFLPVQWGRFLSKDSVYALQPRLFNSFP

SEQ ID NO: 130398 - protein, 136 aa, Glycine max
  Coding DNA Sequence Number=SeqID_38713
  Homolog annotation: Hit_ID=Q84VI1; Match level="QueryCoverage=70%, HitCoverage=14%, E-value=7e-35, Identity=81%"; Hit description =Envelope-like protein
MLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 130399 - protein, 76 aa, Glycine max
  Coding DNA Sequence Number=SeqID_38714
MGAKYLEAVNQRLHAIKQCSPDEIRAINSWGSRLDGGGCMNDNQFMGLRIRFDGGGCTNNARQSIRGAPDLMVEDA

SEQ ID NO: 130400 - protein, 185 aa, Glycine max
  Coding DNA Sequence Number=SeqID_38715
QGAPFEGTIIDDWKFDYSSHDARRMVCNDQAEMTAQASEEDLILMWDFLTGCQINWAHLVRYRMHKALRANAPLPYPHLITLFLRHFQIPLDDEPFVQVKRSFAIGAGADALPPQDEHTPSPPPQRDDSALMNEVLSELRGLHSYVGDRFNSLDTRFAGMDIRLTQLEEDVGYIHQSFDLPPPPS

SEQ ID NO: 130401 - protein, 56 aa, Glycine max
  Coding DNA Sequence Number=SeqID_38716
MEILENRRWMYQRLDDNKRWTNEFREGVFEFVQFVTSQDMFQMQGEQTRCPCNQGK

SEQ ID NO: 130402 - protein, 82 aa, Glycine max
  Coding DNA Sequence Number=SeqID_38717
  Subcellular localization annotation: CTP_CleavageSite=45; ConfidenceScore=5.27e-01
MADRGRGSGRRTFNYGTRHDSKHTSYSSRPTKSFVRESIPTTPVRDASPSAPDDSFTPEYPTNPNYEHIVDERPFIRAYKGE

SEQ ID NO: 130403 - protein, 157 aa, Glycine max
  Coding DNA Sequence Number=SeqID_38718
MEKTKKLKLGEWVNDKSRELAGNVYDLGTLSKRFSCSKSVPSTSIAHVKDQIEEMRETINKLNAELLTKANKEKTLEEKMLQMMENHDHQSQEMRQPMQQKNEQIRQQNERMQRILQHLHIQPIIPAPSLSPTIADGTDHHVNDTQVDRPHDMENDH

SEQ ID NO: 130404 - protein, 56 aa, Glycine max
  Coding DNA Sequence Number=SeqID_38719
MLLPPVLPLIPHLTGIKHTYCEHGESEYGTCVRRRSSEARVIFKEFYYFRWRLSYF

SEQ ID NO: 130405 - protein, 119 aa, Glycine max
  Coding DNA Sequence Number=SeqID_38720
MLPTGEDGEGVDVGTRDGPRASTEDGDGVDAVEGGDVVGATSGGLTGIDTEDGDGVDDVRLSRGGNSLTIHVTGVVTYPSARGRRETHGCIFQGRKTRGVATNVYLRKTLEKPKKVYGF

SEQ ID NO: 130406 - protein, 36 aa, Glycine max
  Coding DNA Sequence Number=SeqID_38721
MAMEWRRKKDDWRFHFMEKMSQEQAQPHRKPWIRAS

SEQ ID NO: 130407 - protein, 45 aa, Glycine max
  Coding DNA Sequence Number=SeqID_38722
MEEKRCSGRQRRRGEGRHHPLGNKPRKKELHHQELPWIRSLKRML

SEQ ID NO: 130408 - protein, 70 aa, Glycine max
  Coding DNA Sequence Number=SeqID_38723
MTKFCLCVSSGPPPPDDKRVRITVSYLRVSSGPPPLDDKKGADNRKGADNRKGADNRKVSLRVIGPAASG

SEQ ID NO: 130409 - protein, 94 aa, Glycine max
  Coding DNA Sequence Number=SeqID_38724
VVVIVKKGENVLMISKRICLTKGENVNRASFDNVEKKSHVCHHQKGGECESLFQDSLKTKLCLKTKCFQDMQGSGNRLPGSVIDYQKTGLRNSC

SEQ ID NO: 130410 - protein, 156 aa, Glycine max
  Coding DNA Sequence Number=SeqID_38725
  Gene Ontology: Mol. function=protein serine/threonine kinase activity; Cellular component=integral to membrane; Biological process=protein amino acid phosphorylation
  Homolog annotation: Hit_ID=A7PN67; Match level="QueryCoverage=61%, HitCoverage=11%, E-value=1e-26, Identity=59%"; Hit description =Chromosome chr1 scaffold_22, whole genome shotgun sequence
PDAGHHGLKADPSGFYSTKSEYRLLMTFNRPIPQRRILQTIEACNAHKKFSIETKWGTMMGSYPFLEEQPIPLTGRSHVYSFGVVLLELLTGRRPVGNFGEEGIDIVQCTKLQTNWSNDKVVKILDERLCHIPLDEAKQEQSVERPTMREVVEMLA

SEQ ID NO: 130411 - protein, 158 aa, Glycine max
  Coding DNA Sequence Number=SeqID_38726
MAPRKLSTKRSRRDAAAEGTSATPEFDSHCFRSAEHQQRCKAIKGWSFHRERRVQLRDNEYTDFQEEIARRRWTSLVTLMAKFDPDIVLEFYANALPTEEGVRDMRSWVRGQWISFDADALSQFLGDPLVLEEGQECEFSQRRNMADGFDEEAIAHLL

SEQ ID NO: 130412 - protein, 57 aa, Glycine max
  Coding DNA Sequence Number=SeqID_38727
MGTIKGDELATQLAQASSARPGELGCFLQKQPPSGGTSWKAQNFTYCATKGAKYLEA

SEQ ID NO: 130413 - protein, 229 aa, Glycine max
  Coding DNA Sequence Number=SeqID_38728
MAKFDPEIVLEFYANAWPTKEGVRDMRSWVRVLEEGQECEFSQRRNRANGFDEEAIAQLLCTPGQDFTRTAAGRRVWIMHTSMTTLTQIWMTLMLSNVFPSDHNSDLPLPKCQLVYAIQTRMSDHVAQLIADAIYLFVGMPPTRHPLDPNKSNRALGFPALITGLCQLFGVPVTPSKVIRPSITRAFIEKYCTPRQAQGDAPQAVDASPPPHQADPAGSLGMERYLQHL

SEQ ID NO: 130414 - protein, 129 aa, Glycine max
  Coding DNA Sequence Number=SeqID_38729
MDVMDWCEDFAQVQKNAMYLLGVERAVQSEFWMFACRSQRSKCRLMHYRLPSSLPCSVLLGCDSLCCLYVVLLGCCGSLGGLMEARGWWVYARIVDVENLLCTIARPPPSTTCDGYPIILQACDEEVLK

SEQ ID NO: 130415 - protein, 174 aa, Glycine max
  Coding DNA Sequence Number=SeqID_38730
MAVISPEKIYQPPFPKWYNPDATCAYHGKTLGHFIEKCLALKYKVQHLTDVGWLTFEEDRPNVKQTRSPIMEGEQLMPSSRVCTSKRKEEATDISSLSTKVTNITGLSGVTHSGRMFAPPDLPTQPANVKGKAKMVEEQNDKTTLTPNEDIPVTNLPEKRDGCGKKEVSLEEAG

SEQ ID NO: 130416 - protein, 85 aa, Glycine max
  Coding DNA Sequence Number=SeqID_38731
  Gene Ontology: Mol. function=nucleic acid binding
  Homolog annotation: Hit_ID=A5AYU6; Match level="QueryCoverage=85%, HitCoverage=13%, E-value=9e-14, Identity=47%"; Hit description =Putative uncharacterized protein
MDSSEDSENEVVNLSLMAKNYESDEEDSLKKSWYIDKGCSKHMTGDASKFTHISPKKNEHVTYDDNNKGRILGVGKNRYEFIYLH

SEQ ID NO: 130417 - protein, 108 aa, Glycine max
  Coding DNA Sequence Number=SeqID_38732
MAIGTISDHASPEEENSRRGTMLHCYQWSCHLPQPTSQRDGESEIDKPKHSSPREKTSGVATNVHSTKMLEKPKRGLQILKIRVWKLFTHGEGVDKGVALAPMYPQVR

SEQ ID NO: 130418 - protein, 155 aa, Glycine max
  Coding DNA Sequence Number=SeqID_38733
MIRGDTLRLSAPLCHPEAAGPMIRGNTLRLPAPLCHPEAAGPMICGDTLRLSAPLCHPEAAGPMIRGDTLRLSAPFCHPEAAGPMTSRDKIWSFCTLVSSRGGGPDDTRRYLTVIRTLVSSRGGGPDDTRKYPSGYPYKHSFAICKTERLIACRG

SEQ ID NO: 130419 - protein, 144 aa, Glycine max
  Coding DNA Sequence Number=SeqID_38734
MEWRRKRERRRHFNEKMSLEEAHHHMRPWIRDWRKKEMNDGRGKDMKSEFLSGFLVEPIIRLIKVILVASTRTYLPSPEVASIPTYLPSPEVASNLTYLPSPEVVSILTYLPSLEVASSKTSVACIKRSAPTQVRIIWYQSFGS

SEQ ID NO: 130420 - protein, 36 aa, Glycine max
  Coding DNA Sequence Number=SeqID_38735
MTRSTKCKKNFGLPRLNKILQKVLRKKAKSFKNLGI

SEQ ID NO: 130421 - protein, 744 aa, Glycine max
  Coding DNA Sequence Number=SeqID_38736
  Gene Ontology: Mol. function=homoserine dehydrogenase activity; Cellular component=chloroplast; Biological process=aspartate family amino acid biosynthetic process
  Homolog annotation: Hit_ID=A7MNG6; Match level="QueryCoverage=100%, HitCoverage=95%, E-value=0.0, Identity=79%"; Hit description =Putative uncharacterized protein
  Pfam annotation: Domain name=AA_kinase; Domain location=1-246; Score =47.3; E_value=5.3e-11; Accession=PF00696.19; Description=Amino acid kinase family
  Pfam annotation: Domain name=Homoserine_dh; Domain location=542-738; Score=340.4; E_value=3.1e-99; Accession=PF00742.10; Description =Homoserine dehydrogenase
  Pfam annotation: Domain name=NAD_binding_3; Domain location=399-534; Score=138.9; E_value=1.4e-38; Accession=PF03447.7; Description =Homoserine dehydrogenase, NAD binding domain
  Pfam module annotation: Pfam domain module=AA_kinase::Homoserine _dh::NAD_binding_3; Domain location=1-246::542-738::399-534
MADYSQPGDLMVVSAAGSTTNQLISWLKLSQSDRLSAHQVQQALRRFHSELIAALLPAEYAETLTAAFIRDLERLAALLDGAITDAVYAEVVGHGEIWSARLMAAVLSQRDIEAAWLDARDFLRAERAAQPQVDEGKSWPLLQALLAQHPHKRLVVTGFISRSEAGETVLLGRNGSDYSATQIGALAGVNRVTIWSDVAGVYSADPRKPVSNSDIDLQLRCSYQPEQGSTRIERVLASGTGARIVTSHDDVCLVEIQIPDSHDFATQQKEIDLLLKRAQLRPLAMGIHPDRRLLQLCYTSEVVNSAFNLLQDAALPGHLQLRDGLALVALVGAGVTRNPLHSHRFWQQIKDQPVEFVWQSEDHISLVAVLRVGPTQHLIQGLHQSLFRAEKRIGLILFGKGNIGSRWLELFAREQETLSARTGFEFVLAGVADSSRSLLSYDGLDASRALAFFDDEAEARDEESLFLWMRAHPFDDLVVLDVTASDSLAQQYHDFASHGFHVISANKVAGAASGQSWRQVRDAFAKTGRHWLYNATVGAGLPVNHTVRDLRESGDSILAISGIFSGTLSWLFLQFDGTVPFSELVDQAWQQGLTEPDPRVDLSGQDVMRKLVILAREAGYDIEPDQVRVESLVPSQCEGESIDHFFENADELNEQMLQRFEAAQEMGLVLRYVARFDANGKARVGVEAVRPEHPLAALLPCDNVFAIESRWYRDNPLVIRGPGAGRDVTAGALQSDINRLAQLL

SEQ ID NO: 130422 - protein, 105 aa, Glycine max
  Coding DNA Sequence Number=SeqID_38737
  Gene Ontology: Mol. function=transcription repressor activity; Cellular component=cytoplasm; Biological process=negative regulation of transcription, DNA-dependent
  Homolog annotation: Hit_ID=Q57HB6; Match level="QueryCoverage=100%, HitCoverage=100%, E-value=4e-52, Identity=93%"; Hit description=Met repressor
  Pfam annotation: Domain name=MetJ; Domain location=2-105; Score =294.4; E_value=2.2e-85; Accession=PF01340.11; Description=Met Apo -repressor, MetJ
MAEWNGEYISPYAEHGKKSEQVKKITVSIPLKVLKILTDERTRRQVNNLRHATNSELLCEAFLHAFTGQPLPNDVDLRKERSDEIPEEAKQIMREMGIDPDSWEY

SEQ ID NO: 130423 - protein, 227 aa, Glycine max
  Coding DNA Sequence Number=SeqID_38738
  Gene Ontology: Mol. function=ATP-dependent helicase activity; Cellular component=alpha DNA polymerase:primase complex; Biological process=DNA replication
  Homolog annotation: Hit_ID=A4TS80; Match level="QueryCoverage=78%, HitCoverage=24%, E-value=4e-47, Identity=55%"; Hit description =Replication restart DNA helicase PriA
  Subcellular localization annotation: CTP_CleavageSite=28; ConfidenceScore=5.14e-01
MPVVQVALPVPLPRLFDYLLPADAPQPVAGARVSVPFGNRKMTGIVVSTRATSDLPLAQLKQIDALLDDRSLFSPALWRILNWAAGYYHSPLGEVLSHALPVLLRQGKPAQEAPLWQWVVNEAGREVALESLKRAPKQQQALAALRQRPLYRHQIGEQDFTDAALQALRAKGLCDLREHAPQQHDWRASFAVKGLSQRAGECAGARQTGAGAGAGNWPDAANHRPFP

SEQ ID NO: 130424 - protein, 120 aa, Glycine max
  Coding DNA Sequence Number=SeqID_38739
  Homolog annotation: Hit_ID=Q6DB12; Match level="QueryCoverage=100%, HitCoverage=100%, E-value=2e-38, Identity=70%"; Hit description =Putative uncharacterized protein
MKEQEKAEIKRLSDQLDALNRKEPQLLEAGDAEKLGALLKEKETLVQEIERLRNVREEKLSKEAQQLKKLPFSREITKKEQANMGALKKSVRGLVVVHPMTALGREMGLKVMTGYAKQPF

SEQ ID NO: 130425 - protein, 114 aa, Glycine max
  Coding DNA Sequence Number=SeqID_38740
  Gene Ontology: Mol. function=transcription factor activity; Cellular component=intracellular; Biological process=regulation of transcription, DNA-dependent
  Homolog annotation: Hit_ID=A6T9A8; Match level="QueryCoverage=95%, HitCoverage=30%, E-value=9e-27, Identity=52%"; Hit description =Putative periplasmic binding protein/LacI transcriptional regulator
MPTFAAGHSLLAEIRLTWPELDVLICTSDEVACGAIMACHAAGVSVPSQLAIASIGGGPLAAVCSPPLTSIVLPYEDMGRMAGKRLLAALNGDEPPAINELPVQLKLRASTHKV

SEQ ID NO: 130426 - protein, 55 aa, Glycine max
  Coding DNA Sequence Number=SeqID_38741
MASSSSANELAQLHSTPEKDDDKNLKIAAYPSSIPFKSNFQQKNGRGKEGDLGNI

SEQ ID NO: 130427 - protein, 58 aa, Glycine max
  Coding DNA Sequence Number=SeqID_38742
MGTPYGTHSPRCNTGPKQAIGPIDRGPDGDPQQAPSTTISDKSLSLFSHANRGMPHLR

SEQ ID NO: 130428 - protein, 224 aa, Glycine max
  Coding DNA Sequence Number=SeqID_38743
  Homolog annotation: Hit_ID=A1G068; Match level="QueryCoverage=77%, HitCoverage=67%, E-value=2e-78, Identity=83%"; Hit description =Putative uncharacterized protein precursor
MAPKPVSGAIFLHRRDSTEPCTCRGPYVHGWWTGLSGTVVFILMNHCKDSSMRPVPTLLALSLLAAGASFATAAHAAEGDDRFALRLGAMNIDSDNTLRGKTNVAGQDIGFSEDFKLGGKEWEPRIDGMFRISNRQRLLFNYFKYDKDRRETLGQDISFGDGELKYQVASLVYDYSVVDTDTFDLGLQLGAEYAKVSTKAYADLGTVYEGQFLNEKTDGVAPVV

SEQ ID NO: 130429 - protein, 44 aa, Glycine max
  Coding DNA Sequence Number=SeqID_38744
MQSEGLALPPEPEVGPSTARVNTKESCVDPSRNDPYMSDLEKCG

SEQ ID NO: 130430 - protein, 199 aa, Glycine max
  Coding DNA Sequence Number=SeqID_38745
MNPLANHGGGAVNAVESGRLEVGDEGSEEQHTRMQSADERSFGRPKPLVVYFTRDSAPQTPQHPSIFKPVPFPYRNSHAVPWRYAPPSERKEEATNISLLSAKVTNITGLSGVTRSNHVFAPPDLPTQPANVKGKAKMVEEQNDKTTLTLNEDIPVKGLLEKRDGCGKKDVSLEEAGEFLRIIQQCEFKVIEQLNKPWP

SEQ ID NO: 130431 - protein, 203 aa, Glycine max
  Coding DNA Sequence Number=SeqID_38746
MTGDRSQPCTIIMKKEELLILKGTQFGKDYSFEDYQWELEWQPCYQNEAEGLFNLDDLLMQFKGTVDSMQQAFKRAETQIGKLVDEMIEVMVRREEEYAEIETHKESILQVNTIHHQLITKEEKDEVSIILEYSLMKHPDMSDAYFEEEVEQEIALSASTMVLQFPLEKELDHVTECLACDEELDDPKDNSVGHVVFEELEKK

SEQ ID NO: 130432 - protein, 41 aa, Glycine max
  Coding DNA Sequence Number=SeqID_38747
TKAGTGPPLEVDGIDKLDEEHIVAVGTTSNNRFSKRKALDE

SEQ ID NO: 130433 - protein, 177 aa, Glycine max
  Coding DNA Sequence Number=SeqID_38748
  Homolog annotation: Hit_ID=Q2HW90; Match level="QueryCoverage=42%, HitCoverage=14%, E-value=2e-08, Identity=44%"; Hit description =Putative uncharacterized protein
MGTNQNGKRFYQVKVKGLDVTSLKELGRLMGPLQRQAFRKVYGKILDLTVAEQDCSCDWGFSKRVGSHEANSEWNSGPATEILGRQGKGYGEPREVGPFADILALLIFGVVLFPNVDGLIDLVAIDAFLAYHHSKESPVVAILENLFDTFDRRCEKNSARIVCCLPALCVWLISHLF

SEQ ID NO: 130434 - protein, 129 aa, Glycine max
  Coding DNA Sequence Number=SeqID_38749
MKILKELRKEKHASYSSHNSCKSLSEELRDYYEGRHRAHPRPHSHWREKERMPQEANINLLYFHGKDNVEANLDWEIRVEQQLKRNSTSKSYGSHYYLKKDEGQGILGVTPSKPKDDKGKTIENQPLKA

SEQ ID NO: 130435 - protein, 167 aa, Glycine max
  Coding DNA Sequence Number=SeqID_38750
  Homolog annotation: Hit_ID=Q2HW90; Match level="QueryCoverage=92%, HitCoverage=28%, E-value=1e-17, Identity=37%"; Hit description =Putative uncharacterized protein
MAGQEEWAPFADILALLIFGVVLFPNVDGLVDLGAIDAFLAYHHSKESPVVAILADLFDTFDRRCEKNNTRIVCCLPALCVWLVSHLFQLDIRHPCPLQSYRSCIEKRRVDWDQYLAGIGGSTINWFPRWKEGKEGVLFSCGDYPNVSLIGMRGCINNNPALAIRQL

SEQ ID NO: 130436 - protein, 35 aa, Glycine max
  Coding DNA Sequence Number=SeqID_38751
VLRKKIPEFQEPRDLRSNPFQGGGNDTILSRKGIG

SEQ ID NO: 130437 - protein, 157 aa, Glycine max
  Coding DNA Sequence Number=SeqID_38752
LALSLEPEVGPSTTRVNTKGSCVDPSAIDPDTGDSEKYGLYIEENLPRLEVKDADALIPIPTDEVILVGQTLNTFLAWLTHLVKRLSEQVMWDASLFKLFNSDFPLYIKHKDLSEIAHGGQCLSIFVIQLWILYMIETSMRLGNSDVYGFLEPQSIQ

SEQ ID NO: 130438 - protein, 213 aa, Glycine max
  Coding DNA Sequence Number=SeqID_38753
ASEPVDMQRLTSSFAPLSSRDDESDDMWGYLMVIHTFCHPETASPMTCGEASEPIDTQRLTSSSAPLSSKDGVPYGYPHLLSSRDSESDDMWGYLRASEPVDMQRLTSSSAPLSSRDGESDDMRVYLMVLLSSSRDIQVRRRARFFSARQGRSSLIACGNVMAHLGLPEGSKRRRCLLVEATQLAWASWAATTSLFSPINKGRRAEQIGSALL

SEQ ID NO: 130439 - protein, 263 aa, Glycine max
  Coding DNA Sequence Number=SeqID_38754
  Subcellular localization annotation: CTP_CleavageSite=19; ConfidenceScore=5.15e-01
MRTALPQLKFTPNSGSRVTGMGASPPNLLKSHPSGTSLADILIGRFHGSIHLRPVGRGIVMLDFKLLAHFPHHLVIQVGSVIRDNLPWQTISADDLFLNEPDHHTPRDIGVGGRLDPLGKIIYRYEDEAMTIRGLGLNGPDDIYPPHGERPRGGHDIQRMRWSIDIVCERLTFVAFPYMDTTITFHGKPECHVVVSLIQYASAHEEAGRQPSQCPLIIVGNLWRVFFAYDISLDVEIPRLTVPFLFYLATMRGFATTPKFNVW

SEQ ID NO: 130440 - protein, 60 aa, Glycine max
  Coding DNA Sequence Number=SeqID_38755
  Subcellular localization annotation: CTP_CleavageSite=52; ConfidenceScore=5.10e-01
MLCPGTPLWYAHLAPGHTTWGRVAGGPSRLASGAVLLTGRGAAGAVRWVGALSAAGGPFT

SEQ ID NO: 130441 - protein, 107 aa, Glycine max
  Coding DNA Sequence Number=SeqID_38756
METERPFFDVLKLGQSSSTQTIMAQESAIVQEQVVVQEEQPLNPTQEPLRRSTRMHHAPDKLNLMVQDDMSNEVYHNDDDPKGYEEPMRSSYCNKWQKAMESEIESM

SEQ ID NO: 130442 - protein, 243 aa, Glycine max
  Coding DNA Sequence Number=SeqID_38757
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130443 - protein, 150 aa, Glycine max
  Coding DNA Sequence Number=SeqID_38758
  Homolog annotation: Hit_ID=A5B939; Match level="QueryCoverage=23%, HitCoverage=22%, E-value=8e-07, Identity=74%"; Hit description =Putative uncharacterized protein
CPPGNGSAGGRVQRLEEHAPSGRWNNVGKGSRQNGSVTSGKGLALRAGHGGPSPEPVGCRWTARAASAARAGRRVPVGGRIGNGPFGASSPGVEQSTQNCETTAKGTGLAESAGKEDPVELDSSPTFGALPLFVDPRSASAGRSGRKTLS

SEQ ID NO: 130444 - protein, 155 aa, Glycine max
  Coding DNA Sequence Number=SeqID_38759
MGDQEETQEQMKVDMSALKEQMASMMEAMLGMRQLMEKNVVTAAAVSSAAEADPTLLATTHHPPPNAVGRERSTLGHNSNPHLGYNRAAYPYGLLPNYTPPVMQDDAGHISSPILEGEPPRQPDEVHEDHQEYAQRDVEFYPPILVEGSAPNTLP

SEQ ID NO: 130445 - protein, 48 aa, Glycine max
  Coding DNA Sequence Number=SeqID_38760
MVTRRRLEPQNMLTKTPELRGTCHIRGERSEMSDNYHDEAGPSLILVD

SEQ ID NO: 130446 - protein, 172 aa, Glycine max
  Coding DNA Sequence Number=SeqID_38761
  Homolog annotation: Hit_ID=Q6WAY6; Match level="QueryCoverage=90%, HitCoverage=24%, E-value=8e-16, Identity=36%"; Hit description =Putative uncharacterized protein
MDRLVDLAAIDSFLAYHDHKESLVVAMLADLYDTFDRRCEKSSTRIVCCTPALYVWLVSHLFRQEVRHACPLESHRSCIEKGGANWDQLLANKEGASVNWFPRWKEETIEVLISCGGFPNVPLMGTRGCISYNLVLVIRQLGYPMRGAPLEEELAPVISRGFNKTNMETLQK

SEQ ID NO: 130447 - protein, 196 aa, Glycine max
  Coding DNA Sequence Number=SeqID_38762
  Homolog annotation: Hit_ID=UPI00016621D1; Match level="QueryCoverage =94%, HitCoverage=41%, E-value=4e-14, Identity=34%"; Hit description =UPI00016621D1 related cluster
YPGLQSTTLLANRGLHALTLRGLCVLTFRGLHVLTFRGLHALAIRGLRVLTFRGLHALAIRGLHVLTFRGLHALAIRGLHVLTFVGLHALTFRGLHVLTNRGLHALTLRGLHVLANVGLHALTFRGLHVLANRGLHALTFRGLHILAFRGLHVLTLRGLHVLALRGLHVLTIRGLHVLTSRGLHVLALRGLPALAL

SEQ ID NO: 130448 - protein, 294 aa, Glycine max
  Coding DNA Sequence Number=SeqID_38763
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMEKKVQWSLHQDIWMGINMLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130449 - protein, 75 aa, Glycine max
  Coding DNA Sequence Number=SeqID_38764
MSHAVKDNRGKWAPNYEGPFVVKRAFSGGALGQDHLELPSGVGTKHEQQKPTKILRNGCNWGWGHDRLIAAPSLR

SEQ ID NO: 130450 - protein, 66 aa, Glycine max
  Coding DNA Sequence Number=SeqID_38765
MTVSYKDWHEMLPFALHGYRTSGQDHLELPSGVGTKHGQQKPIKVLRNGCKWGWGHDRLIVALSLR

SEQ ID NO: 130451 - protein, 132 aa, Glycine max
  Coding DNA Sequence Number=SeqID_38766
DGESDDMRRYLMVIRSFCQLEASEPVDTQRLTSSSAPLSSRDGEQASPLRRKRLPSSSAPLSSRDDESDDMRRYLMVIRKFCQLEASEPIDTQRLTCHLQPLSSRDSESDDMRRYLMVICTFCQLEASEPVD

SEQ ID NO: 130452 - protein, 91 aa, Glycine max
  Coding DNA Sequence Number=SeqID_38767
MDRASSIHICYPNTSTSRPIYPRLTEHRVHALKSISRADIDIVELAGWGSTKTHYDSGAVYGEGSLARSPTFSYEGRWRLFKFGKCIGSCK

SEQ ID NO: 130453 - protein, 49 aa, Glycine max
  Coding DNA Sequence Number=SeqID_38768
MQEQIVGLGSSSSMDSFASWKMNGTIMEKEEREEMPLQGEDESRRSSPP

SEQ ID NO: 130454 - protein, 96 aa, Glycine max
  Coding DNA Sequence Number=SeqID_38769
MLQCEGFSSKLRYDFEIPNGENVGNWVANMILKFYDDPTVNGFEIVVFLRQLVGLGSSSSMDSFASWKMSGSGMEKEEREETPLQGEDESRKSSSP

SEQ ID NO: 130455 - protein, 138 aa, Glycine max
  Coding DNA Sequence Number=SeqID_38770
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-24, Identity=64%"; Hit description=LacZ protein
  Subcellular localization annotation: CTP_CleavageSite=32; ConfidenceScore=5.02e-01
MTMITPSSKLTLTKGNKSCPGDPLVLERPPPRWSSNSPYSESYYNSLAVVLQRRDWENPGVTQLNRLAAHPPFASWRNIEQARTDRPSQQLRSLNGEWDAPCSGALSAAGVVVTRSVTATLASADVRRCFCRYAPPRQ

SEQ ID NO: 130456 - protein, 66 aa, Glycine max
  Coding DNA Sequence Number=SeqID_38771
MVKARQKGVWKANEIKIKARETKEKREVVAAQLAQASWVASTRRHRLLLEHPRRCKWAWLLFAHPF

SEQ ID NO: 130457 - protein, 284 aa, Glycine max
  Coding DNA Sequence Number=SeqID_38772
  Gene Ontology: Mol. function=signal transducer activity; Cellular component=membrane; Biological process=signal transduction
  Homolog annotation: Hit_ID=A1FZU7; Match level="QueryCoverage=92%, HitCoverage=37%, E-value=1e-139, Identity=98%"; Hit description =Methyl-accepting chemotaxis sensory transducer precursor
MIGRSLTGPLARAVNLAERLSKGQLDQEFRLGGRDELTQLGEAMASVRQSVQAAIGAQLQMAEQHEAGAIRYRMDASAFPGDFGRMVQATNSLVESHVQVELLMAEVMQRYAIGDLSRDLPDYPGEKGTLTRTLAAVKQSLMAINAQIDELARAARAGDFSMRGDATAFQFQFKAMVEHLNGMMASSQSSIADVSDVLRAISHGDLTARMDGEYDGVFARMRDDANTTTAQLTGIVRGIQVAADSINNAAQELAAGNNDLSRRTEQQAANLEEAAASMEELTST

SEQ ID NO: 130458 - protein, 214 aa, Glycine max
  Coding DNA Sequence Number=SeqID_38773
  Subcellular localization annotation: CTP_CleavageSite=73; ConfidenceScore=5.10e-01
MCPPPPPTNENSQNPPQYIMYPPPPHMWYMHPSSNVEPPTSGSSQNPQIYSQPSTPTNLNTCYRPSLSNIVLPSNEIESLVGVDGIQLDEGDENSGGKKVVPHSRSRKMIHPLVQKFNGCYKQADKHRRSGSSEKDVLADAHMIYSQDTETPIEVEEYDTPSPMSRPIGQKATKRKSKGKECRNTLDLSGIESVMKDKNMNTSKLIQLKEAQEK

SEQ ID NO: 130459 - protein, 246 aa, Glycine max
  Coding DNA Sequence Number=SeqID_38774
MERGGQLYRSVRRRLRTARRLGAEGRDDLGMGLGVGAADQIDAVGNGREDARRQHRAVIGLQAFEGFADRLGLARQVDDQGGVRWPFADDGDLPRQDRRGHEAQADLAHLFAEARHFLGADRQRGLGRDIAPRRAGAAGGQDQVAAAGVDQFDQGVGNAPRLVGNQPLHGLPRRSQRRAQPFAQRRQPLVLVGAGRGAVGNRHQADDQFVGVAAGDAGRGGHGQMSVKWADSGQPPSRRTGNAVNP

SEQ ID NO: 130460 - protein, 71 aa, Glycine max
  Coding DNA Sequence Number=SeqID_38775
MAEINQGKTMTGHDWPRIFVSYLQVHRDGSSGARVTTDRSLPLPSAKQAENVAARQPNILCGCSFFYYCLF

SEQ ID NO: 130461 - protein, 17 aa, Glycine max
  Coding DNA Sequence Number=SeqID_38776
MADQWVTKSKAKGSKIP

SEQ ID NO: 130462 - protein, 106 aa, Glycine max
  Coding DNA Sequence Number=SeqID_38777
MTEGAEDNTLSLTDSERVFIRITTWVTIAEGGVVDKSEAFAPTLYQETLTSPERVQMTTLASACQSNLGSPNDEVRITGRCFCLLPDSWVMIAKGGVVDKSDAFAP

SEQ ID NO: 130463 - protein, 53 aa, Glycine max
  Coding DNA Sequence Number=SeqID_38778
MSGGENRERHEEERRGGNGGGPRPNRIEGVKLNIPPFKGKSDPEAYLEWELKI

SEQ ID NO: 130464 - protein, 97 aa, Glycine max
  Coding DNA Sequence Number=SeqID_38779
THLLLEVASPLSLPFSIPLPFIFQEAKKSIDEEDPRPTSSNGACISFYRLTWTVQKHKINTSLYCLLRELRRSDFLFDGGYVGAKAPAFVDLVRWLE

SEQ ID NO: 130465 - protein, 279 aa, Glycine max
  Coding DNA Sequence Number=SeqID_38780
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMFRASSSMCLTDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130466 - protein, 43 aa, Glycine max
  Coding DNA Sequence Number=SeqID_38781
MCFVLCFLKMNGSGMEKEDDWRRHFKEMSQEEAHHHRKPWIRA

SEQ ID NO: 130467 - protein, 79 aa, Glycine max
  Coding DNA Sequence Number=SeqID_38782
MTEGCGEGFCLANLPGDAFSLWGNFFEAKKQMMADAKFAGLLGFVGDLEGRDESKRQGLNLSGSWQQGHSATYNTPSRI

SEQ ID NO: 130468 - protein, 137 aa, Glycine max
  Coding DNA Sequence Number=SeqID_38783
  Homolog annotation: Hit_ID=Q2HW90; Match level="QueryCoverage=58%, HitCoverage=16%, E-value=5e-12, Identity=48%"; Hit description =Putative uncharacterized protein
MARIAKVVKILAQELDRVKQNRNGVVKIPRKHLEEKAKALADQGEWVLFIDVLALLVFGVILFPNVDRLVDLAAIDAFLAYHHSKESPVVAVLADAYDTFDLRCEKSGARIVCCTPALYVWLVSHLFHHESRPVCPL

SEQ ID NO: 130469 - protein, 201 aa, Glycine max
  Coding DNA Sequence Number=SeqID_38784
  Homolog annotation: Hit_ID=Q6WAY6; Match level="QueryCoverage=74%, HitCoverage=26%, E-value=3e-15, Identity=35%"; Hit description =Putative uncharacterized protein
MVGFAPFLLRGKACLPARKSPFMHREKRCKLGPTLSKTEGVSINWFPRWKEGKVGVLISCGGFPNVPLTGTRGCISYNLVLAIRQLGYPMRGAPLEEELAPVISRGFNKTNMETLQKVRKAWEVVREKDKELRGGNNGPIGGYRKWLRAHVQGLDWLPSLRNAKREEVEAPEEDEEVQALRTKLEQAQSVKERFKSTALKI

SEQ ID NO: 130470 - protein, 148 aa, Glycine max
  Coding DNA Sequence Number=SeqID_38785
LCQSFGVPVAPSKVIRPPITRAFIKKYCTQRQAQGDAPQAADVPPPHQAGRAGSFDTEQYLRHLVRQQAANHRAHVQTHDCLYQLSLSLQSQGFTSFPCPTPDQFMAEVAWPRDWLEAPAEAPDEADEAREDEEMTDLLDFLGGSGAT

SEQ ID NO: 130471 - protein, 54 aa, Glycine max
  Coding DNA Sequence Number=SeqID_38786
MVRLPNGHTVMNDKCFIQDMNQQKIGTIEMVEELYRLKMIPIKSKYKSDFAEYL

SEQ ID NO: 130472 - protein, 15 aa, Glycine max
  Coding DNA Sequence Number=SeqID_38787
LTRPVKFRNVAEIEK

SEQ ID NO: 130473 - protein, 154 aa, Glycine max
  Coding DNA Sequence Number=SeqID_38788
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=2e-23, Identity=96%"; Hit description=LacZ protein
  Subcellular localization annotation: CTP_CleavageSite=41; ConfidenceScore=5.30e-01
MSMSTPRSKLTLSKGNKSWYRAPPRGRRPGDPLVLERPPPRWSSNSPYSESYYNSVAVVLQRRDWENPGVTQLNRLAAHPPFASWRNSEEARTDRPSQQLRTLNGEWDAPCSGALSAAGVVVTRSVTATLASADVRRCFCRYAPPRLYLNRRDS

SEQ ID NO: 130474 - protein, 216 aa, Glycine max
  Coding DNA Sequence Number=SeqID_38789
  Homolog annotation: Hit_ID=A5C169; Match level="QueryCoverage=69%, HitCoverage=13%, E-value=1e-07, Identity=28%"; Hit description =Putative uncharacterized protein
MVIDQSLFYDLTQLSSEGVPFEGTLNDDWKFDFSVHDARQLVCINQADMNGRLLASSLAFESRILHYLIVRILLPRSSNLAQVSEEDLIVMWAFHTGRQIDWAHLVRYHMHKALQLNAPLPYPHLVTLFLQHFNIPLDLEPYVPIKRSFLIGAAVIASFGYRKEHDGSRVKKGAPPINEEGNIPLGGDSSLLQRFWTGSMVFKPLLAKGLMLWSYK

SEQ ID NO: 130475 - protein, 376 aa, Glycine max
  Coding DNA Sequence Number=SeqID_38790
  Gene Ontology: Mol. function=tryptophan synthase activity; Cellular component=chloroplast; Biological process=aromatic amino acid family biosynthetic process
  Homolog annotation: Hit_ID=A7ZL79; Match level="QueryCoverage=100%, HitCoverage=94%, E-value=0.0, Identity=89%"; Hit description =Tryptophan synthase beta chain
  Pfam annotation: Domain name=PALP; Domain location=29-357; Score =415.2; E_value=9.7e-122; Accession=PF00291.16; Description=Pyridoxal- phosphate dependent enzyme
MPALRQLEEAFVSAQKDPAFQAEFTDLLKNYAGRPTALTKCRNLTEGTKTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYETAHYMLGTAAGPHPFPTIVREFQRMIGEETKAQILEKEGRLPDAVIACVGGGSNAIGMFADFIDETNVGLIGVEPAGHGIETGEHGAPLKHGRVGIYFGMKAPMMQTDEGQIEESYSISAGLDFPSVGPQHAFLNSTGRADYVSITDDEALEAFKTLCRSEGIIPALESSHALAHALKMMKENPEKEQLLVVNLSGRGDKDIFTVHDILKARGEI

SEQ ID NO: 130476 - protein, 211 aa, Glycine max
  Coding DNA Sequence Number=SeqID_38791
  Gene Ontology: Mol. function=nucleic acid binding; Biological process= transposition, DNA-mediated
  Homolog annotation: Hit_ID=Q2LFC1; Match level="QueryCoverage=28%, HitCoverage=6%, E-value=2e-11, Identity=56%"; Hit description=AGO4-2
ASRYQQGHQDLCILRSDLPSQWLLFLSAVPPVQLLTGWCVTAKAPPDISAGKCSGRVPFAIQAAQLLGRAIGAGLFAITPAGERGMCCKAIKLGNARVFPEFDPIARRGLASKGTKLQLLTNHYRVNVANTDGHFYQYSVALFYIKLIDTVDLEGGPVGKPVVPAALMNRPTRGERRFAYWALAECILAYYVGTDEGVSEVLHVAGEKRLH

SEQ ID NO: 130477 - protein, 408 aa, Glycine max
  Coding DNA Sequence Number=SeqID_38792
  Gene Ontology: Mol. function=transporter activity; Cellular component= integral to membrane; Biological process=transport
  Homolog annotation: Hit_ID=A1FSE3; Match level="QueryCoverage=95%, HitCoverage=36%, E-value=0.0, Identity=89%"; Hit description =Transporter, hydrophobe/amphiphile efflux-1 (HAE1) family
  Pfam annotation: Domain name=ACR_tran; Domain location=1-408; Score= -263.9; E_value=0.085; Accession=PF00873.10; Description=AcrBAcrDAcrF family
  Pfam annotation: Domain name=FtsX; Domain location=209-373; Score= -37.3; E_value=0.074; Accession=PF02687.12; Description=Predicted permease
  Pfam module annotation: Pfam domain module=ACR_tran::FtsX; Domain location=1-408::209-373
  Subcellular localization annotation: CTP_CleavageSite=43; ConfidenceScore=5.08e-01
MQGYGLSASQVLAAVRAQNVQFAAGALGSDPSPEGQHFTATVSAEGRFSSPQEFENIILRANADGSRVLLKDIARVAFGANNYGFDTQYNGKPTGAFAIQLLPGANALNVADAVRAKMDELQPSFPAGVTWFSPYDSTTFVKISIQEVVKTLFEAVFLVFLVMLIFLQNFRATLIPTLVIPVALLGTFLGMWMIGFTINQLTLFAMVLAIGIVVDDAIVVIENVERIMTEEGLAPKPATQKAMTQITGAVVAITVVLAAVFIPSALQGGAAGEIYKQFALTIAISMAFSAFLALGFTPALCATFLKPTHNDNPNIIYRTFNKYYDKISHTYVGHIASAVRHAPRWMILFVVLTALCGFLFTRMPGSFLPEEDQGYALAIVQLPPGSTKGPDQRSVRADAWHPGKAGWL

SEQ ID NO: 130478 - protein, 104 aa, Glycine max
  Coding DNA Sequence Number=SeqID_38793
MGEAEEVQEKMKADMEAMKEQMATMMEAVFYEHEEDNGSQCGYSCRYCAVAKAKNWEVRTTPCVKFKRAPSIIWLAPNYTPPNNVAYTLNENSITPTPILIENQ

SEQ ID NO: 130479 - protein, 129 aa, Glycine max
  Coding DNA Sequence Number=SeqID_38794
EFKIPETGPGHLESEPPPHLSDGKTGKSERATASPDKESERSAASLFGDLGGAAASLDGESKMIIKGGDGGTTSSSGEEDGFTTGDYGSTGAGSTRAELWTSGPMVADRGAGVDDEGMSSALALFLDAI

SEQ ID NO: 130480 - protein, 70 aa, Glycine max
  Coding DNA Sequence Number=SeqID_38795
MDSGRFQVSIPGDSCPSKTFLGEMYQQFLIFCVCPPSSDNTSLDGSWGQVVPLYLSKSNTLNLGMTTFGY

SEQ ID NO: 130481 - protein, 70 aa, Glycine max
  Coding DNA Sequence Number=SeqID_38796
MEACLWGFYGGWIFELQWGPLMVIFHHGDAAEDKGKELGEDASMEEKKEGEKEGGGSTKLKEEKGREVEL

SEQ ID NO: 130482 - protein, 73 aa, Glycine max
  Coding DNA Sequence Number=SeqID_38797
MASDQEIQMMERVMVGRNDRAIADALPALAQAIGNPNRGEAIGAIEYQGGTASNETILLLSMEDTTLMVLKIG

SEQ ID NO: 130483 - protein, 99 aa, Glycine max
  Coding DNA Sequence Number=SeqID_38798
MGIAPTKTPSGPEEVQQGPGVSSSGIVPAKHSMDPEKSNRGLGVASSKYGSLSVLGSACRPQQGHQAPLPTELSSRSTAPPGRRRAKHHISIGMAGSGQ

SEQ ID NO: 130484 - protein, 744 aa, Glycine max
  Coding DNA Sequence Number=SeqID_38799
  Gene Ontology: Mol. function=glucuronate isomerase activity; Cellular component=intracellular; Biological process=glucuronate catabolic process
  Homolog annotation: Hit_ID=Q57JX8; Match level="QueryCoverage=59%, HitCoverage=93%, E-value=0.0, Identity=77%"; Hit description=Uronate isomerase
  Pfam annotation: Domain name=FCD; Domain location=562-691; Score =127.3; E_value=4.3e-35; Accession=PF07729.3; Description=FCD domain
  Pfam annotation: Domain name=GntR; Domain location=477-540; Score =92.0; E_value=1.8e-24; Accession=PF00392.12; Description=Bacterial regulatory proteins, gntR fam
  Pfam annotation: Domain name=UxaC; Domain location=14-499; Score =871.0; E_value=5.9e-259; Accession=PF02614.5; Description =Glucuronate isomerase
  Pfam module annotation: Pfam domain module=FCD::GntR::UxaC; Domain location=562-691::477-540::14-499
CQSRGCIPQSGGQMKRFMDDDFLLHSEVARRLYHDVAAQMPIYDYHCHLNPQEIAEDRQFANLGQIWLEGDHYKWRALRAAGVEESLITGNTTSDYDKYLAWAQTVPKTLGNPLYHWTHLELRRPFGITDTLFGPETAPRIWHECAEKLATPEFSARGIMRQMNVRMVGTTDDPIDSLQYHRQIAEDSSFDIEVAPSWRPDRVFKIELEGFTDYLTRLEAAADVSIDSFDALRVALLRRLDHFSAHGCRAADHGIETLRYAAVPADSVLDGILARRRSNAALSELEIAQFSTAVLVWLGAEYARRGWAMQLHIGAIRNNRTRMFRQLGPDSGFDSIGDHPVAWPLARLLDAMDTYDQLPKTILYCLNPRDNEVLATMAGNFQGAGMAGKMQFGSGWWFNDQRDGMLRQLEQLAQMGLLSQFVGMLTDSRSFLSYTRHEYFRRILCNLFGEWGRKFGGLMSEPAEKSVMKPQASAQRPYQEVGEMLRNMITQKQYAIGERLPPERELAMLLNVTRTLVREALIMLELEGLIEVRRGAGIYVINDTPAPRAAAQTACNAAGPFEMLQARQLLESNIAEFAALQATREDIIKMRQALALEESELASGAVNDSENGDRNFHLAIAEATHNSMLVELFKQSWQWREDNVMWSQLHRHLINTNYRKKWLDDHKKILAALIKKDARAAKQAMWQHLENVKQLLLEFSDVDDIDFDGYLFESWPLQDARRPQIVTVSDSLPDGLNGLATARG

SEQ ID NO: 130485 - protein, 324 aa, Glycine max
  Coding DNA Sequence Number=SeqID_38800
  Gene Ontology: Mol. function=sugar:hydrogen symporter activity; Cellular component=periplasmic space; Biological process=transport
  Homolog annotation: Hit_ID=A9CEV8; Match level="QueryCoverage=53%, HitCoverage=54%, E-value=2e-91, Identity=97%"; Hit description=ABC transporter, substrate binding protein
DVGSKDCKVVECQGTTGSSPAINRKKGFEQAIASHANIKIVRSQTGDFTRTKGKEVMESFIKAEGGGKDICAVYAHNDDMAVGAIQAIKEAGLKPGTDIKVVSIDAVPDIFKAMAAGEANATVELTPDMAGPAFDALEAYLKDKKAPPKWIQTESKLYTASDDPMKVYEAKKGLAKPLRSSLQNGLVWSERMPLVSSPRPGRSPRQWDEGASLEMSEELAPSSDPSAHLLPGGEKKYAAPLWRIRQTIPFRPWIRRIEHVLVYSGDPAAAGYFRHYGRSVADCCGSEDTAREGRADQRHRRQRFPFLHFAACMQHGHTGRKRRA

SEQ ID NO: 130486 - protein, 197 aa, Glycine max
  Coding DNA Sequence Number=SeqID_38801
  Subcellular localization annotation: CTP_CleavageSite=41; ConfidenceScore=5.09e-01
MAESSKKRKGSSSTTAAVGHRHHRPSEAPIAPIHPSLSSPRSSTLFSSDDQRLWYNSQFSSRIILDPKYLDTNFFNDETFDCYQVFQNSGLADFMSLKLPYYPELVKVFYSNFKIQDGIISSEVHGISMIIDQSLFFSLTKLPSQGAPFEGTIVDDWKFNYSSHDACRMVCNDKAEMIGRLLAGSLTFDCRIMRYIN

SEQ ID NO: 130487 - protein, 49 aa, Glycine max
  Coding DNA Sequence Number=SeqID_38802
MTKLGLCLSSALDDKRVRITVRVRITVRYLRVSWVQNDQTWSLLVICSG

SEQ ID NO: 130488 - protein, 209 aa, Glycine max
  Coding DNA Sequence Number=SeqID_38803
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=77%, HitCoverage=23%, E-value=5e-87, Identity=98%"; Hit description=DNA -directed RNA polymerase subunit beta'
  Pfam annotation: Domain name=RNA_pol_Rpb1_2; Domain location=52-178; Score=102.2; E_value=1.6e-27; Accession=PF00623.11; Description=RNA polymerase Rpb1, domain 2
MCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRLGIQAFQPILVEGRAICLHPLKLKQSSFTYVFSYEPPVSGYWGSYFRTNSRYAYWTLHINERESSRYLFK

SEQ ID NO: 130489 - protein, 120 aa, Glycine max
  Coding DNA Sequence Number=SeqID_38804
  Homolog annotation: Hit_ID=Q2HW90; Match level="QueryCoverage=66%, HitCoverage=16%, E-value=3e-08, Identity=40%"; Hit description =Putative uncharacterized protein
KHLEEKAKALADEGEWASFIDVSALLVFGVVLFPNVDGLVDLATIDAFLAYHHSKESPVVPVLANAYDTFDRRCEKSGARIVCYTPALYVWLVLHLFHHESRPICPLQGHRICTEKGKAN

SEQ ID NO: 130490 - protein, 166 aa, Glycine max
  Coding DNA Sequence Number=SeqID_38805
MSRSLAFSLQRVDPWVLVPIAFRGLHILAFRGLHVLTLRGLQRPRLERTTCPHHQRAARPHLQRTTRPRLERTTCPHHQRAARPHLQRTTRPRLERATRPRLGGLHALAIRGLHVLTFVGLHALTFRGLHVLANRGLHALTLRGLHALTSRGLYILALRGLHRPHL

SEQ ID NO: 130491 - protein, 259 aa, Glycine max
  Coding DNA Sequence Number=SeqID_38806
SEYQGSVWRKGQRPWKIKANGLSFIDILALLIFGVVLFPNMEGLVDLAVIDAFLAFHHGKESPVVAILAMYDTFDRGCEKSDARIFCCALALYVWLVSYPFLQEGRKNQDSIFMRRMSKCSLDGTRGCINYNPVLTIRQLGYPMRGVPSDESITPFIARGFSDHNVRDRELRGSSNGIIGGYHKWLRVRTQGLDWLPNLNTVRDDEVKASEESDEVQALKAELERARVVEEKFKSIAIKGSNSELKLRRGERNHHGSKA

SEQ ID NO: 130492 - protein, 28 aa, Glycine max
  Coding DNA Sequence Number=SeqID_38807
MRKLIKVKWWLDRNIEMEITEATGLQMR

SEQ ID NO: 130493 - protein, 178 aa, Glycine max
  Coding DNA Sequence Number=SeqID_38808
  Gene Ontology: Mol. function=RNA-directed DNA polymerase activity; Biological process=RNA-dependent DNA replication
  Homolog annotation: Hit_ID=A5BH93; Match level="QueryCoverage=69%, HitCoverage=9%, E-value=4e-14, Identity=34%"; Hit description =Putative uncharacterized protein
MVEAVDGGGEYHQLDGSQHLLLDVVTTQMQHLLNRNNEDLYRRIKGLEHQMNPNVGRPYGGNRRANDGPNRMEGQNKIEGVKLNVPPFKGRSDPDAYIDWEMKIQHVFSCNGYIEEHKLQQNHATETPEAIPGKFDCGGVHKEMEMVLVRANIEEEIEDTMAHCLSVLNPDIRDVVEL

SEQ ID NO: 130494 - protein, 48 aa, Glycine max
  Coding DNA Sequence Number=SeqID_38809
MLMHNPPTWALQKIPPEGGCFWRKQPCSPGRAELAWASWAATTSPILL

SEQ ID NO: 130495 - protein, 135 aa, Glycine max
  Coding DNA Sequence Number=SeqID_38810
MQACARAPIWIHPNPIIKNPIATKIKPKPYLKAADGLYLDSQILDTEEASAMIKNELRIENQETLISDASLLNSLYNIQITAPQINPKQINNTIFEMAILFQVTFANLIRTQEIIESGTIVNKPFTTLKVVNAAP

SEQ ID NO: 130496 - protein, 140 aa, Glycine max
  Coding DNA Sequence Number=SeqID_38811
GLAVPPEPLVGPGPSGPRVSTKGSYVDPSGNDPETGDSDRCGLYIEAYPVRLVAMGRVYEGSTLVHNTHLLPGQVKVSVDEVKDSHAPVPVPTDEVVVSPPKPPPKLDPEVDDPLYLMTLTIPELFLRPYQVRWDATVFG

SEQ ID NO: 130497 - protein, 180 aa, Glycine max
  Coding DNA Sequence Number=SeqID_38812
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPCKNHEVDRGAKFQPTACQDLATGQNRPPGTWKNLSNG

SEQ ID NO: 130498 - protein, 66 aa, Glycine max
  Coding DNA Sequence Number=SeqID_38813
MSESPKNQTWDEILGKFNIPEASNAKKKLEKNLMEEKRKKIQEETILVGDSAMLVDPSSPIERHVK

SEQ ID NO: 130499 - protein, 81 aa, Glycine max
  Coding DNA Sequence Number=SeqID_38814
MCTYAIFGSQNALSMHEMAPRKLSSKRSRKDKAAEGTSSAPEYDSHRFRSAEHQQRFEAIRGWSFLWERRVQLRDDEYADF

SEQ ID NO: 130500 - protein, 343 aa, Glycine max
  Coding DNA Sequence Number=SeqID_38815
  Homolog annotation: Hit_ID=A5AKA6; Match level="QueryCoverage=54%, HitCoverage=20%, E-value=4e-08, Identity=24%"; Hit description =Putative uncharacterized protein
MAKSSKRKHGECSQAALNRIDMWFINEDKKIDFKMIYAGFNFPNLLEAQGLSTFVKMKGTFYPELVKVFYTCAHADMEGNLYSTINGVDMIIDATVWKAVAGLDMGGVCKFKEYVDGYNKMKTYEGMLLDPARNLTNRLGFGGLTTEDWMLVYLITYILTPRSSNHAQVTDDELQIVYGLKLGIQLNWVLLIEDIMLKSHSLVDYEFPYVVLASRFIDHFNINVSNEIIDFTKASNEITKRHLKKLGMRYVDHEWIMAGEPPLAANMDQMEEEEEEEKAQQEPAHQWNRFESLMIQKMDAILHLHQEHQAKVDSFLENITTRLENIETRLSLSNLLNSDEDET

SEQ ID NO: 130501 - protein, 174 aa, Glycine max
  Coding DNA Sequence Number=SeqID_38816
VDSRGSPAILTRMSVHVAQLIVDVIYLFAGMPPTRHPLDPDKSNRALGFPALITGLYQSFAVLVTPSKLIRPSITRSFIEKYYTPRQAQGDAPQGAGAPPPPPQAGAAGSLGMKRYLQHLVRQQQFAAEVAWSGDWPDAQAGEEPAGSPSRIEEPRMDEDMTDLFDFLGGSGAT

SEQ ID NO: 130502 - protein, 72 aa, Glycine max
  Coding DNA Sequence Number=SeqID_38817
MSDSSAYYIETVKIEHECSPQIQTTDMTKSKGKDPLYGLGGPMTRARARKAKEVLQQVLSILFEYKPKFQGE

SEQ ID NO: 130503 - protein, 256 aa, Glycine max
  Coding DNA Sequence Number=SeqID_38818
MAPEKLSAKRFRRDTAAEGSNATPEFDSHRFWSAEHQRRFEAIKGWSFHRERRVQLREDEYTDFQEEIARRHWTSLVTPMAKFDPEWIPFDADALSQFLGDTLMLEEGQECEFSQRRNRADGFDEEAIAQLLCTLGQDFARAAAGMQIMCTSMTTLTQTWMTLLLSNVLPSDHNSDLPLPKCMPPTRHPLDPDKSNRALGFPALIMGLCQSFGVPVTRSKVIRPPITRAFIEKYCTPRQAQGDAPQAADVASLNND

SEQ ID NO: 130504 - protein, 153 aa, Glycine max
  Coding DNA Sequence Number=SeqID_38819
  Homolog annotation: Hit_ID=A5ATL8; Match level="QueryCoverage=57%, HitCoverage=68%, E-value=1e-17, Identity=60%"; Hit description =Putative uncharacterized protein
RRQIPGLNPGQAVETTKLEYETKARGANGIRYPSSPSRKRWILGAVRIDPCNAVANALSIPPGEYRRTLPGLDMPRILLKERGAFGNADTGGAWAVVSSCRKTAGDKPEEGEDDVKSSCPLCPGRHTCYNGRDKGSRSREGELTPKTRPQFGL

SEQ ID NO: 130505 - protein, 105 aa, Glycine max
  Coding DNA Sequence Number=SeqID_38820
MLQPYEISIGLKEHSNPVTPKAYTPKSPSGPLPPDSEFSNVRKKEKGLKPSFCTASCDAHFSLHRHCFANPNGGGVRNWIGNNISNFHDNPTVNETGIVILPRQL

SEQ ID NO: 130506 - protein, 40 aa, Glycine max
  Coding DNA Sequence Number=SeqID_38821
LSSLVMDVWGANTFPVRKNNSRTIRKLKHTREPRVALPPK

SEQ ID NO: 130507 - protein, 96 aa, Glycine max
  Coding DNA Sequence Number=SeqID_38822
  Subcellular localization annotation: CTP_CleavageSite=44; ConfidenceScore=5.78e-01
TINSLASVSASGPSSFSTWAFILLHSGALSFSTWVFVLLHMGLVASTQTYLPSPEVASTLTYLPSLEVASSKTSVACIKRSAPTQVHIIWYQSFGS

SEQ ID NO: 130508 - protein, 414 aa, Glycine max
  Coding DNA Sequence Number=SeqID_38823
  Homolog annotation: Hit_ID=UPI00005F72F7; Match level="QueryCoverage =99%, HitCoverage=71%, E-value=7e-47, Identity=31%"; Hit description =COG5295: Autotransporter adhesin
VLEVAVQPRNGKNVTGTVVTLATDAENSDGNNTSGGGEGGIIIDPTGLPSVSNLKFSGSLVSGTALTASYDFDAGVGVPGDKSQFAWGEKGTTAALVSQGSTVSGSGVVPSRQLVASDVGKILELSLLARNSADVTGNTETLTTADKDNGINGNDSGTIIDAALAPVVENLSLSGTLAAGSALKGTYTFNPNNGDRRDNSVYLWGIKGQTASAVSSSGSTVSTSGVIPDEIIGPQHVGKILEVSVLPKNGLDVKGTVVSMATDVSGGNNFNGGNNGQIVDPAGAPALSNLVLSGKLITGSKLQASYTFDPQTGDPSDKSEYLWGEKGQTAGNVAGQGLTVSVPGTVGEIILDNSYIGKIIEVSVLAKNGLGVTGNTETIASDAQAPANSTTDGGTDGKIVDALAAPSVTNLAIQ

SEQ ID NO: 130509 - protein, 222 aa, Glycine max
  Coding DNA Sequence Number=SeqID_38824
  Homolog annotation: Hit_ID=A5B5G7; Match level="QueryCoverage=99%, HitCoverage=15%, E-value=8e-11, Identity=25%"; Hit description =Putative uncharacterized protein
MASRKRKAPSTPTQARFDRSRFSSQEAWERYTDIVVPRKLLLERNVVVYYTEFDEFKQELERRHWDEELIDFLDDNIDVAIVNEFYANLYDPEDKSPKQVRVKGHLIKFDEDTLNTYLKTPVVVEEGETLSAYSRFALLRSDPQELAAKHCIPGRRFELNADGQPLKILRKSMTMLAQTWSVHSFSNLIPTSHTSDVTLDKAELIYSIIMKMDMNVGYLISH

SEQ ID NO: 130510 - protein, 90 aa, Glycine max
  Coding DNA Sequence Number=SeqID_38825
  Subcellular localization annotation: CTP_CleavageSite=39; ConfidenceScore=5.43e-01
SPVACGDTLRLSTPRHSETPSPIDMQRPMLSSAPFPEMSASSAKASLLSTAPPFVTVTQESDDMWRYPSGGDTQVVIRINTLSLSVKLRV

SEQ ID NO: 130511 - protein, 103 aa, Glycine max
  Coding DNA Sequence Number=SeqID_38826
MKAQVEKDEGPEAEALSRPLMLLKAQTNLKAQTYQGNPCGVYPDLSSLTGSGVYPDLSSFTGSGVYPDLSSFTGSGVIQTFVACIKRSAPTQVHIIWYQSFGS

SEQ ID NO: 130512 - protein, 202 aa, Glycine max
  Coding DNA Sequence Number=SeqID_38827
  Gene Ontology: Mol. function=sequence-specific DNA binding; Biological process=regulation of transcription, DNA-dependent
  Homolog annotation: Hit_ID=UPI00005F9B06; Match level="QueryCoverage =97%, HitCoverage=85%, E-value=4e-36, Identity=44%"; Hit description =COG1974: SOS-response transcriptional repressors (RecA-mediated autopeptidases)
  Pfam annotation: Domain name=HTH_3; Domain location=10-64; Score =39.4; E_value=1.3e-08; Accession=PF01381.13; Description=Helix-turn -helix
  Pfam annotation: Domain name=Peptidase_S24; Domain location=127-202; Score=60.4; E_value=6.1e-15; Accession=PF00717.14; Description =Peptidase family S24
  Pfam annotation: Domain name=Phage_CI_repr; Domain location=8-71; Score=17.2; E_value=0.0027; Accession=PF07022.4; Description =Bacteriophage CI repressor helix-turn-h
  Pfam module annotation: Pfam domain module=HTH_3::Peptidase _S24::Phage_CI_repr; Domain location=10-64::127-202::8-71
MKNEFMSDRINQRMQALGLRSTHLMDATGASKGTVSQWVNGGTAPSAKFISKLAEVLGVSERWLTQGGLIEESKGNAYPGPDLRRRVPLLSSVQAGSWKEIVEGNLQDVNEWIETTAKVSPYSFSLRVSGDSMDGPPGQGVSIPNGSIVIVDPEVEALNGRIVVARVNGSNEATVKKLAIDGPNIYLMPLNPNFKPIRGSSR

SEQ ID NO: 130513 - protein, 174 aa, Glycine max
  Coding DNA Sequence Number=SeqID_38828
MVEASGNRLPACVIDYTEEWVTGIDYQACIVMAAQLIRDRVKMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 130514 - protein, 85 aa, Glycine max
  Coding DNA Sequence Number=SeqID_38829
  Subcellular localization annotation: CTP_CleavageSite=35; ConfidenceScore=5.14e-01
MGRTCSPLKARMCSLLKARTCSPLMVRTCSLLKVRACSPLKARTCSPLKIDCPFEIGDNSCNLVLSFANLSGNSLGVYVLFVLAT

SEQ ID NO: 130515 - protein, 201 aa, Glycine max
  Coding DNA Sequence Number=SeqID_38830
  Homolog annotation: Hit_ID=Q08J38; Match level="QueryCoverage=52%, HitCoverage=39%, E-value=2e-14, Identity=30%"; Hit description =Replication protein O
DYTENTSEITTEKKPVRQLAPPADPQADSLKIDYKAILEAFHSTLPELPVVLKITDDRRKKLRKLWADYELNLEKWGAYLRFISKKCRWMLEDRADTNTGKTWRKKDFDYLITEKCYLKVKEERANDLPKVQKLDSAAREDAYTRLVSQRRKPQNEVEALAKEMAGSLGRMTDYDARRAWTGIWAQAVTKASENDLARLAS

SEQ ID NO: 130516 - protein, 324 aa, Glycine max
  Coding DNA Sequence Number=SeqID_38831
  Gene Ontology: Mol. function=beta-lactamase activity; Cellular component=integral to membrane; Biological process=beta-lactam antibiotic catabolic process
  Homolog annotation: Hit_ID=Q1QEC3; Match level="QueryCoverage=73%, HitCoverage=60%, E-value=7e-54, Identity=44%"; Hit description=Beta -lactamase precursor
  Pfam annotation: Domain name=HGTP_anticodon; Domain location=2-81; Score=1.1; E_value=0.033; Accession=PF03129.11; Description =Anticodon binding domain
MKKDGLAEYAENIFNDLKYDFNLFYEEKDAIGKRYRRQDAIGTPYCITIDHDSLTDHTTDLKQMLKYIIGGAAAGVAFAYLFGYDYLFSGIAKTYLKGKSSANIDDGKLFPSNIISTESPKLWEEDPAYNKSTLPKTIVENLIQSNTASFLVIKNGKLLHEQYWNGYNQLSKTNSFSMAKAVTVMLLGKALEEGKIKSIDEKFSNFFEDFKNKELGNQLTLKNLAQMESGLDWDEDYKNPFRPNAKAYYGRSLLKATFSKRFKAEPGTRFEYQSGSTQLLGFAIKKSINQTLASYLSEKFWTPLGMEQNAEWSVDNSRMEKTYC

SEQ ID NO: 130517 - protein, 131 aa, Glycine max
  Coding DNA Sequence Number=SeqID_38832
  Homolog annotation: Hit_ID=A0ST23; Match level="QueryCoverage=34%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGLYDTVFDVDHDKDRAQAQGLEPGTELEFVIMVIAVSFGKPVVPAALMNRPTRGERRFAYWALFRFLAH

SEQ ID NO: 130518 - protein, 109 aa, Glycine max
  Coding DNA Sequence Number=SeqID_38833
MANTFIDCNKVGRSKYQATWKIKHEKDMEAMSSKIQRTNRQRILCPNTLEGTSFVRGYISCGSVQVKGTSTWLFKENKEGYIPCGSLACTGFYKVERNLKNCWLLGDWM

SEQ ID NO: 130519 - protein, 165 aa, Glycine max
  Coding DNA Sequence Number=SeqID_38834
IPEVHGIPMVIDQSLFFSLTHLPSQGAPFEGTIVDDWKFDYSSHDTRRMALQANAPLPYPQLITLFLRHFQIPLDDEPFVQVKRSFAIGAGAVTSFGYRKDRNGQWLKKDALPPQDERTPSPPPQRDDSALMNEVLTELRGLCSYVGERFDSLDTRFAGMDIRLT

SEQ ID NO: 130520 - protein, 71 aa, Glycine max
  Coding DNA Sequence Number=SeqID_38835
MLPFDSQHVAELHGLPNDGCQVPRSGQAKVASHQIDGPWTKLSLILIKLHPQIPLVGLNSSRTALRQTYNN

SEQ ID NO: 130521 - protein, 188 aa, Glycine max
  Coding DNA Sequence Number=SeqID_38836
MTKESKDLASMSMEVLSGKLLAYEQDLIQQSHEDYKESSDDDEDGENFGLMVKKFGNFPKMYKDRKFSKSSKKIDNNNNTFICFECGKQDNVSTSSDSSSEEEVANVCLMENSMDDSSTIEESEVNFESEEVLEAFNEMQEEAQRLAVLNKKLKNDLKLHITKLTSTQSELDELRKENERLVSSFIAT

SEQ ID NO: 130522 - protein, 115 aa, Glycine max
  Coding DNA Sequence Number=SeqID_38837
MSCLAIITPISLCLSASWCMPPTRHPLDPDESNRALGFPVLITGLFQSFGKYYTPRQAQGDAHQAADAPPPPHQADPAGSLGMECYLQHLVCQQAANHRGQVQIHECLYQFSLSQ

SEQ ID NO: 130523 - protein, 89 aa, Glycine max
  Coding DNA Sequence Number=SeqID_38838
MVRGGDGPQQRWWRMIPFSSSMILPFEEVLVNFNWWNQKRSENEEDWALRDRRTRCNRLQGMVIDYRSSKPSGNRLQDVVIDYRLLVLV

SEQ ID NO: 130524 - protein, 222 aa, Glycine max
  Coding DNA Sequence Number=SeqID_38839
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=76%, E-value=5e-33, Identity=65%"; Hit description=LacZ protein
  Subcellular localization annotation: CTP_CleavageSite=50; ConfidenceScore=5.06e-01
LSGFATSDLSVDFCDARQGGGAYGKTPATRPFYADTARRSRTTERSESVSEEAEERPIRKPPLPAPDNNFTQETAMTMITNSSSVPLVKAVPNEDSQKGMSKRVTSATMDNTVAAVDPLGELVKNLFGDPLESTCRHASLALAVVLQRRDWENPGVTQLNRLAAHPPFASWRNSEEARTDRPSQQLRSLNGEWRLMRPDTRQHPLTRPDGLVCSRHPLTDKL

SEQ ID NO: 130525 - protein, 130 aa, Glycine max
  Coding DNA Sequence Number=SeqID_38840
MEDSEDFLHGIFEEDSEDFTLIKVFLLVWGSNGKQRWLTAATGGLGCGPSGCSVHFLSVGNGLSATLGHSAQFLLVGITLSALFSLSGRSKVIFFQDPNSQNVETYLRDIQTKVEDDPTVNESGIAISLN

SEQ ID NO: 130526 - protein, 79 aa, Glycine max
  Coding DNA Sequence Number=SeqID_38841
  Pfam annotation: Domain name=zf-CCHC; Domain location=7-24; Score =14.0; E_value=0.012; Accession=PF00098.14; Description=Zinc knuckle
EDSSSVPNFYECNQPGHLRVDCPSFKRRMEKSDRKTFKDKKAKKTYITWEDNDMDSSRDSKNEVVNLSLMAKNYESEEE

SEQ ID NO: 130527 - protein, 222 aa, Glycine max
  Coding DNA Sequence Number=SeqID_38842
  Homolog annotation: Hit_ID=A5B5G7; Match level="QueryCoverage=92%, HitCoverage=14%, E-value=4e-09, Identity=25%"; Hit description =Putative uncharacterized protein
MASKKMKFTASRPREPYDTTRVISEGIWERYAQNVHSQNILMERNIILYVTEYDEFRRELDRRSWHKALTMQLDGHIDVALVKEFYANIYDPEDKSPRQVRVRGKLIKFDAESLNSFLETPVILEPGEHYTTYSRFCHSCPNPQEFAARLCILGCGFVLNTEGAPWKLLRKDLTTLAKTWTVLSYSNLAPTSHTSDLNMDRARLVYGLVMKMDMDLGSLISG

SEQ ID NO: 130528 - protein, 318 aa, Glycine max
  Coding DNA Sequence Number=SeqID_38843
  Gene Ontology: Mol. function=tetracycline:hydrogen antiporter activity; Cellular component=integral to membrane; Biological process=response to antibiotic
  Homolog annotation: Hit_ID=A0UA75; Match level="QueryCoverage=94%, HitCoverage=55%, E-value=2e-53, Identity=38%"; Hit description=Major facilitator superfamily MFS_1
  Pfam annotation: Domain name=MFS_1; Domain location=19-308; Score =92.6; E_value=1.3e-24; Accession=PF07690.7; Description=Major Facilitator Superfamily
  Pfam annotation: Domain name=Sugar_tr; Domain location=14-296; Score=- 165.2; E_value=0.016; Accession=PF00083.15; Description=Sugar (and other) transporter
  Pfam module annotation: Pfam domain module=MFS_1::Sugar_tr; Domain location=19-308::14-296
MTFKHQEKETLNIFAVLAVSLSTVIAMLDSTIANVALPVIAKDFGVSESASIMIINAYQFAVVASLMPFAALGRAVGNKKIFMAGVVLFAFSSLGCALSTTLEMLTAFRVIQGFGAAAVLSVNAALIKEIYPERLLGRGLGINVMVVSVSAAAGPSIASAILSQTSWNWLFTINVPIACLSLLLSVIFLGSRERRSVGFDSGGALLVFVLFIAFSLSTMSMTTHHLPAAALSFAVFAGLAGLLYINQKRKADAALIPIAMLHNPTLSLSLLMSMLSYSTQLLAYVSLPFYFHNVLQRNVVEIGLLLTAWRAGHHGRLR

SEQ ID NO: 130529 - protein, 85 aa, Glycine max
  Coding DNA Sequence Number=SeqID_38844
MAPKKLLSKRARKDAAGEGSSVAPQADIEFDGHRFRSGLRIGRSSASSLTDSLRSVVRLRRAVSAHSKAVIRLSTESGDNAGKNM

SEQ ID NO: 130530 - protein, 35 aa, Glycine max
  Coding DNA Sequence Number=SeqID_38845
MTVKRRKLEGAKVVVSLSLDRALSKTQPLSETSAA

SEQ ID NO: 130531 - protein, 371 aa, Glycine max
  Coding DNA Sequence Number=SeqID_38846
LKKSWDAHWEEGSHICSMGSIPPRQELPRPWEIKANGLSFIDILALLIFGVVLFPNMEGLVDLAVIDAFLAFQHGKESPVVAILAMYDTFDRGCEKSGARIVCCALALYVWLVSHPFLQEGRPVYPLQGHRSCVEKGKANWDQLLASMEGRLVCINYNPVLAIRQLGYPMRGVPSDESITPFIARGFGDHNARVLQGVRKAWDAAVRTQGWDWLPNLKTVRDDEVKASEESDEVQALKAELERARVVEEKFKAAIVSSSSKEVKGIITGQRHDLEGRAKGNMWAIIDKCKEKLNLAATHEQRLEDEYAKISAEREARERVIDSLHQEATMWTDRFALTLNRSQELPPFLAKAKAVADTYSAPEEIHGLLSY

SEQ ID NO: 130532 - protein, 114 aa, Glycine max
  Coding DNA Sequence Number=SeqID_38847
MGEAEEVQEKMKANMEAMKEKMATMMEAMMSMKKIMEAKCETHEIPHHNLADFEPWLGYTTEGQAVGGIPLQNPLEGPQYHPQLHLLHSTAVKNPHDYGRNGKVGSSRGKAQGH

SEQ ID NO: 130533 - protein, 85 aa, Glycine max
  Coding DNA Sequence Number=SeqID_38848
MVLEDKSKACQRSKRSLTKQCSHSGILLVCVDAKSTGKCTRLSSSSTKHRCHIGKEFTSITQQESPTEDLASHSKEALFTMKKRN

SEQ ID NO: 130534 - protein, 109 aa, Glycine max
  Coding DNA Sequence Number=SeqID_38849
MNLIIVTKRKEHALRRPYQTRTRVRVMGEVEEVQEQMKADLEAMKEQMATMVEAMMSMKKIMEANAVTVAATSTVAKVNLMPPSDLNQMNHPTSDMVGKDLGSMDGPMI

SEQ ID NO: 130535 - protein, 185 aa, Glycine max
  Coding DNA Sequence Number=SeqID_38850
  Homolog annotation: Hit_ID=Q6L477; Match level="QueryCoverage=57%, HitCoverage=17%, E-value=2e-09, Identity=29%"; Hit description =Putative uncharacterized protein OSJNBa0009L15.8
  Subcellular localization annotation: CTP_CleavageSite=41; ConfidenceScore=5.82e-01
IIGSPPASTPPPLPHSPPSPPPPPPTSDASASPFAVKRTRKASHLRSLSTRPPGVERPVVHVDPATGKADGPHMKKSRTYLGIVACDKVDITYENWKEVPTAQKDLIWEDIHAEFDISEASDSRTKRKLLQTMGERWRQFKSDLTRKWALAVDQDGVEDIVYEKYNISKEKWAQFCQTHRDPSWE

SEQ ID NO: 130536 - protein, 28 aa, Glycine max
  Coding DNA Sequence Number=SeqID_38851
MDYPTQGKICYSMDEQGDAPRQHNNKQG

SEQ ID NO: 130537 - protein, 216 aa, Glycine max
  Coding DNA Sequence Number=SeqID_38852
NTETFSSLTSYPELRRSEFIIGGYVGARASLLSTTPPFVAITQEPLCPMARRDQVWSFCTHDIAEIPYGYLHPYARQTQLCPMARRDQVWSFCTHDTRRYLTVICTPLLGRHSCVRWHAETKFGHSAPMIRGDTLRLSAPLCYADTVVSDGTQRPSLGLTQSSAPFVPPGTTKSFTCGNFMVTRDSRQPRGAKLVSYTDFRGPLLDDMRPFFGPCE

SEQ ID NO: 130538 - protein, 57 aa, Glycine max
  Coding DNA Sequence Number=SeqID_38853
MKESFLHSNYPMIINDPRCRIQCPDILLENTGVAVQCKIKVKCRSEAAGSTMSDTMS

SEQ ID NO: 130539 - protein, 139 aa, Glycine max
  Coding DNA Sequence Number=SeqID_38854
MKADMEAMKEQMAIMMEAMMSIKEIMEVNAVAIATTSTIAEVDLTLPYGLNQINLPTSDMVGLEGKELGGTGGPHLVRKTSIPSHHMACLPTIHHPLWHTLPTHEIPHHNLADFEPCLGYATEGQAVGGIPLQNTLEGP

SEQ ID NO: 130540 - protein, 193 aa, Glycine max
  Coding DNA Sequence Number=SeqID_38855
TGGTTRPVKDRSASPAEGTSRPVHTGGGPIDPTQAGITAAAGTRLALQWILVKGFRLYSFQLPDSMSPAPSPESNPNSPSPVTTMAEPVLTFYLINASLPEVGVCCTIALNKASARAKRHPRQPIFKEQCGGTRPPTFTACTASERTITTRVPQEAVMMTTNVVHVWDFEILQPPQQRGLDGMGLTSHTNTVW

SEQ ID NO: 130541 - protein, 227 aa, Glycine max
  Coding DNA Sequence Number=SeqID_38856
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P12862; Match level="QueryCoverage=98%, HitCoverage=61%, E-value=7e-72, Identity=97%"; Hit description=ATP synthase subunit alpha, mitochondrial
  Pfam annotation: Domain name=ATP-synt_ab; Domain location=43-215; Score=40.2; E_value=8.5e-11; Accession=PF00006.16; Description=ATP synthase alphabeta family, nucleotide-binding domain
ACGDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVAQLVQILSEANALEYSILVAATASDPAPLQFLAPYSGPWHIDKCHYCYADHQAVRLSQAIPAINVGLSVSRVGSAAQLKAMKQVCGSLKLELAQYREVAAFAQFGSDLDAATQALLNR

SEQ ID NO: 130542 - protein, 100 aa, Glycine max
  Coding DNA Sequence Number=SeqID_38857
  Gene Ontology: Mol. function=aspartic-type endopeptidase activity; Biological process=DNA integration
  Homolog annotation: Hit_ID=A5AMK2; Match level="QueryCoverage=75%, HitCoverage=10%, E-value=2e-16, Identity=56%"; Hit description =Putative uncharacterized protein
MIMKTDGEITSEFEISEEEELEEEAMQGDMLIVRRLLGSQMQPLDNTQRENIFHTRCIINDEEVKVTQQVEVCLTIGRYNDRVLCDVVPMEATHILLGRP

SEQ ID NO: 130543 - protein, 155 aa, Glycine max
  Coding DNA Sequence Number=SeqID_38858
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARARLSGASSKGGIRVESPPMFICGKRQKNRRKPVMKNIPDSGVVFTFEEGISTSHIDKSGTLAPTYPTSKRK

SEQ ID NO: 130544 - protein, 47 aa, Glycine max
  Coding DNA Sequence Number=SeqID_38859
IALSNHYAWLQTLEGGGHMNENAIHGAPKRLRMENYTKQSLHVSLTR

SEQ ID NO: 130545 - protein, 149 aa, Glycine max
  Coding DNA Sequence Number=SeqID_38860
MAVTGGQWWWRRSLRVLGEGLGEEKEEEDGYFMLLNVFVACNTHPGEFGSLGRADPQLKFSASFNRPSKPRTCFSVRGSGISRMAFTLSGSTSIPFWLMIKSSNFSDLTSKMHFARFNLNRYLRSLLNNFHKLTRCSSLVFDLAIISSM

SEQ ID NO: 130546 - protein, 139 aa, Glycine max
  Coding DNA Sequence Number=SeqID_38861
MVKGSTKINLHSTLFKSLLVLCPGDNLVVWFCSLRKKPDAAIKGAVNSAMKSVSKTVEGKPPQHGPQWIEAKSHVQTGNYECGYYVMHWIWCIISAGLKDEWIHWFSDRSAVTKDTMTTLRHKWVAYFLQMKKCELRKI

SEQ ID NO: 130547 - protein, 208 aa, Glycine max
  Coding DNA Sequence Number=SeqID_38862
MAEAEDIRHPCLPPESPSLGKEGVLFLMWGLPKHPVDREQGGCINYNPRPCYKKLGVPHEGSTDGRKPLSFPCERFRYAKFQRLYKESIRRGKARLDWLSKLKIINEENFEAPEEDEEVRALKTELGKARLAKEKFKLVTTDVRKECAKLREENAATARALEQETKRARKEEHGRDKFRGALWGSNSELKLRSEERDQSRAHSTVLKE

SEQ ID NO: 130548 - protein, 145 aa, Glycine max
  Coding DNA Sequence Number=SeqID_38863
MWGIPFILEPNQTPTSKRKRKEIPNQRVGESKKRERKFPIKEWEKAKRKERKFPIKEWEKAKRKERKFPIKEWEKAKRKERKFPIKEWEKAKRKERKFPIKEWEKEKKKGEKKERKLLIKDRKQKNCAERSLDRTISEQNRIVTK

SEQ ID NO: 130549 - protein, 75 aa, Glycine max
  Coding DNA Sequence Number=SeqID_38864
MEAMKEKITTMMEAMMSMRKMMEVNTATVVAASTATEVDLTHLSGLNQVNHPISDMVGQRGKALGSTGAPHFVQV

SEQ ID NO: 130550 - protein, 113 aa, Glycine max
  Coding DNA Sequence Number=SeqID_38865
MASMMDAMLGMRQLMEKNAATAAAISSAAKANPTLPAIAHHPIPDVVMSLPPSLKGNLLDSRTRSTRIVGSMPKETSIPTPRSLLRGRHPMHYLSPTSWENLETPQHSQYSFP

SEQ ID NO: 130551 - protein, 150 aa, Glycine max
  Coding DNA Sequence Number=SeqID_38866
  Homolog annotation: Hit_ID=Q2HW90; Match level="QueryCoverage=53%, HitCoverage=16%, E-value=9e-11, Identity=43%"; Hit description =Putative uncharacterized protein
MARVAKVVKISTQELDRVKQNRNGVVGIPKKHLEEKAKALADQGEWTSFIYVLALLVFGVILFPNVDGLVDLAAIDAFLAYHHNKESPTVAILADAYDTFDQRCKKSSTRIICCTPALYVWLVSYIFHYESRPVCPLQSHSLYAEKGKAN

SEQ ID NO: 130552 - protein, 184 aa, Glycine max
  Coding DNA Sequence Number=SeqID_38867
MGEVEEVQEQMKAAMEAMKEQMATMMEAMMSMKKIMEVNTAAVATVCVVSRVDLTPRSGQNLINRPTSDTGGPHFVQALNKHVFPPYGLPPNYTPPNENVNNFTPILIESQQPQTDHAHVSQPMGETHEISHRNLADFEPRLGYATEGQAVGDIPLQNTLEGPQYHPQPHPLHSTASKNPPPMA

SEQ ID NO: 130553 - protein, 89 aa, Glycine max
  Coding DNA Sequence Number=SeqID_38868
MVGYAPSSFADLVITRERIEAGLKRGKFDHPAWMNEKIGANKVDEKEGETHAVTAIPIRPSFPPTQQCHYSANNNLLLTHHLVIHKGHP

SEQ ID NO: 130554 - protein, 146 aa, Glycine max
  Coding DNA Sequence Number=SeqID_38869
  Homolog annotation: Hit_ID=Q6UUU1; Match level="QueryCoverage=41%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKDMQKHHWQQH

SEQ ID NO: 130555 - protein, 106 aa, Glycine max
  Coding DNA Sequence Number=SeqID_38870
MEDYLELLRQLEPMSKEESDNSFKDKSYLVLYFYGIRAAHPIKIGGIMVGRPHNTTAQLLARMTQVLETLEQDCDAKLVEYRGFSSFTKHNPPKFEVNFDSKGAQH

SEQ ID NO: 130556 - protein, 332 aa, Glycine max
  Coding DNA Sequence Number=SeqID_38871
QYRLQLDDNNAMSGGRRCGEQRASPHRRGLTAGDNEQHGLYDDDAGPGGAVDVEADQGAKHAGEHRHYRRHHQHAFEAAAQHKGDDARGDQHGDHQDHPHGLQRGDDGHRQQAQQPVVQQLDRQANHPRMMRIEAVQHEVFALEQHHRQGDAGDQQCLLQLAVGNAQHVAEQNVAQAEGEHAGKDDAHHRVFFHPAVLFQVTGGYRTEDAGKEGADRQRNADHERHHDAGQHRVRDGVAHQRPAFEHQVAGEHGAHYAGDDGGDDRPLHERAVFRREEERRQEHQRLQGDDHPPGGAVEEEAQVGADAAGQCADDDGDDHQPAEAIGQQGIL

SEQ ID NO: 130557 - protein, 151 aa, Glycine max
  Coding DNA Sequence Number=SeqID_38872
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=56%"; Hit description =Putative uncharacterized protein
  Subcellular localization annotation: CTP_CleavageSite=45; ConfidenceScore=5.25e-01
MTMITPSSKLTLTKGNKSWYRAPPRERSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130558 - protein, 80 aa, Glycine max
  Coding DNA Sequence Number=SeqID_38873
MQIATRPTWAFQEVLQKASPSGGSNLARLSELGGKLLPHFLINRGRREEQKGLTLLVSENHLKLVKKIVSVKKIQAEELP

SEQ ID NO: 130559 - protein, 112 aa, Glycine max
  Coding DNA Sequence Number=SeqID_38874
MEETPNISQTSRSHRPADGNRLTTGDIRVTSSAQVAHLDSIAESGLQKPSNGIADTYLYLFLSAGVLPADTLIREMELGICFETSSLRATNCHYSEAYGDPVPRKALFPGQD

SEQ ID NO: 130560 - protein, 164 aa, Glycine max
  Coding DNA Sequence Number=SeqID_38875
MSNLNLDEDDDDDDDDYLVSNSYVEESLDEDDSVDGISDTDSEVSDMIPPVRVVHPAEGVQGIQNPFWNNALHYNNINWSHPDEEDICGLEMPSSFNVGQKLYVGMEFDSKDAVKNAVKQYVMKVHQSFKVVESKWDKYVVCCVNLYADCPCPFYMREIRSKKI

SEQ ID NO: 130561 - protein, 109 aa, Glycine max
  Coding DNA Sequence Number=SeqID_38876
MGAKHLTRTKQRSHVIKQRSPDEIREMAPRKLVTKRSRKDKAAEGTSSTPEYDSHRFRCVEHQQHFEAIKGWSFLWERRVQLRDDEYTDFQEEIGRRAVGITGYPHGQV

SEQ ID NO: 130562 - protein, 235 aa, Glycine max
  Coding DNA Sequence Number=SeqID_38877
  Homolog annotation: Hit_ID=A4DID9; Match level="QueryCoverage=26%, HitCoverage=88%, E-value=2e-18, Identity=53%"; Hit description =Putative uncharacterized protein
  Subcellular localization annotation: CTP_CleavageSite=4; ConfidenceScore=5.40e-01
GRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVTKNTGLRKVVRPCMGADACPVPEEPSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVNAG

SEQ ID NO: 130563 - protein, 93 aa, Glycine max
  Coding DNA Sequence Number=SeqID_38878
SQYLLYAFLLTFLSGEVDRTIDVRPRPSQYHVHHPDRTEAIVITSPKTTIDWQDTAREQKESGGEAYASMPTAPTLYYWWLIGPFAYPVFWLA

SEQ ID NO: 130564 - protein, 153 aa, Glycine max
  Coding DNA Sequence Number=SeqID_38879
MATMMKAMMSMKKIMEANAVIVAAISAVAKVNPMLPSGLKQMNHPTSNMVGKDLGKTHEIPHHNLADFEPWLGYTTEGQAVGGMGKLDHLEERLRAIEGGEDYAFANLEELFLIPKHGHSQVQGAGLWQVQGDYSLQEPSKDVLSEDGGIRKR

SEQ ID NO: 130565 - protein, 42 aa, Glycine max
  Coding DNA Sequence Number=SeqID_38880
MSFRGPRKARDVSFHAPELTQGAVHYHAEPSELGLAIHHEHG

SEQ ID NO: 130566 - protein, 193 aa, Glycine max
  Coding DNA Sequence Number=SeqID_38881
  Gene Ontology: Mol. function=chlorophyll binding; Cellular component =integral to membrane; Biological process=photosynthetic electron transport
  Homolog annotation: Hit_ID=Q2MI75; Match level="QueryCoverage=68%, HitCoverage=32%, E-value=1e-47, Identity=63%"; Hit description =Photosystem II P680 chlorophyll A apoprotein
  Pfam annotation: Domain name=PSII; Domain location=1-190; Score= -85.6; E_value=9.9e-08; Accession=PF00421.10; Description=Photosystem II protein
MGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVDGDGIVRADVPFRRAESKYSVEQMVFFVAVRGVVYFWTCFFALLFFFGTLAWGLELIQRWFCWNRPDLDAQVEFEAIPRPWRSNY

SEQ ID NO: 130567 - protein, 141 aa, Glycine max
  Coding DNA Sequence Number=SeqID_38882
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MEGGHFSCLDVKEPKKNSPVPRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130568 - protein, 135 aa, Glycine max
  Coding DNA Sequence Number=SeqID_38883
LNPVHHHVAFFGVITAAGNHDGVPAFARIEFSQFEVGEQIEAGLAVDHLDVGDTRRLEQHAAVRDNNQKGSDNDYDNEQLSKSDLKPSILFNLQKSQTTLPVQRDAARHGIITGGFNNRADERDLTVGGKGGVAG

SEQ ID NO: 130569 - protein, 38 aa, Glycine max
  Coding DNA Sequence Number=SeqID_38884
MWTTTGEMVAAQLARASSARPGEPGCFLQKQQPSGGTF

SEQ ID NO: 130570 - protein, 98 aa, Glycine max
  Coding DNA Sequence Number=SeqID_38885
PTWEDSQEGSDYTGSGVVSDSLTFECLSPVINLAYIRTNCWNPEDLIVSIRGARRARAWPAELPSISAAPTPASTSAVIPAQTNSQCFEAMLQSIHPG

SEQ ID NO: 130571 - protein, 136 aa, Glycine max
  Coding DNA Sequence Number=SeqID_38886
MEKNEETTMEEKLACGASMEAGSLSFNEVLQMVIFHHGDAAEGKGEEERGGPHPLGNKPRKKELHHPRIALDKKLEDDALMEEKKERRGEHEIEGIKEGEKWNFEVCLTRLSFIKVTTSVTHASIYRLGSFLEKLS

SEQ ID NO: 130572 - protein, 103 aa, Glycine max
  Coding DNA Sequence Number=SeqID_38887
MPKNQKNIDAQSHPGPLGPSKIFLQKAVASGGSNLARLGELGGNHLPYFAINRGGSEEEKGSAPLALLSLSNLLGKIVSVKKIQAEALPKCFCNVSVRNFAKV

SEQ ID NO: 130573 - protein, 96 aa, Glycine max
  Coding DNA Sequence Number=SeqID_38888
  Homolog annotation: Hit_ID=A7QGZ7; Match level="QueryCoverage=76%, HitCoverage=51%, E-value=2e-23, Identity=73%"; Hit description =Chromosome chr3 scaffold_95, whole genome shotgun sequence
MDLEMENRLAAMLMREVAELRWQSEREGVMAYLRKPNVRTRPNSCFLAATIRGVQQANRVVEVNEMWRLRQKEDIGRQVLTYGERPVSVDNTNDVR

SEQ ID NO: 130574 - protein, 125 aa, Glycine max
  Coding DNA Sequence Number=SeqID_38889
  Subcellular localization annotation: CTP_CleavageSite=20; ConfidenceScore=5.19e-01
MTFQWFRKHFPEEPFFRNVSRRTTSSGIVYSGSTFPNRCSGNFPEDQYFRKTFQWFRNNYSSGNLPEDLFPEVPEEPLTVHNKTKAKKNATYLECKWVQGLPEKLAEKKLVGEERREEAFAEETQ

SEQ ID NO: 130575 - protein, 126 aa, Glycine max
  Coding DNA Sequence Number=SeqID_38890
MKTLSKTKYLEELKNINREERKSQEASTKTKRIQETGNHSDGAPKKRLSTLGGSTNSSPTTCQGYYPEPQIISFDIGQPLLPTSGLSGGLMYYPGSTNYTWHPTWHSKTCVNPSRQSRNRSKTLNP

SEQ ID NO: 130576 - protein, 446 aa, Glycine max
  Coding DNA Sequence Number=SeqID_38891
MKHDLVNVEVLSPIWWDFLLLCGAFSPDVRSIFDLPLVKGLANQSGGRLLDLRSFSSDGYKEANLAYLEFLWRWNLVTEMAHQDICGAALVNKDLGHHEVCNNDGDNHKMAFSGLTRLSSIGKSTRNGVDYTFDLLNRLSANLSGCRARSMECNANSGLRFKIWTAVRPNLCMNFLKDSLFACPRLAKAVEVNVTPLRDIGKTRHRITSSLGMLASIMRLMKGCQRVLYPTGRGELVILGTFDTSLQVFVSVIAASGRFEPSKGVSCLRPDRVLTMDEQERDDERPWTWPKWALGLRTSALRVAFIKRKRGGPAKQRTLMLSKCTGMFASVLVCVACVEDSMELGIYWRGVELWVLAKGHFGAVAACPGELKLSAEAISSPRRVGFFTMKLFGGPGELEASQGYTSTYFFNLEPYKVSLDIFIVKKSYTIIIYMIVALEASRKQPL

SEQ ID NO: 130577 - protein, 55 aa, Glycine max
  Coding DNA Sequence Number=SeqID_38892
  Homolog annotation: Hit_ID=A5B7H7; Match level="QueryCoverage=72%, HitCoverage=18%, E-value=5e-09, Identity=62%"; Hit description =Putative uncharacterized protein
MEAYMKDESMWIIDSGATLHVTARKEFFTSYTPSDFGVLKMGNDDLFPPSDITLL

SEQ ID NO: 130578 - protein, 109 aa, Glycine max
  Coding DNA Sequence Number=SeqID_38893
GVTDAIGTAAHAWLKERGPCQGWTGWACIRDKNYKGNSYVASLALPWGFYRVVRNGESVYSKNLTSISAHKTPTCITQKHNFKSRALVTHPVVTLITRSTISVVKSLSH

SEQ ID NO: 130579 - protein, 59 aa, Glycine max
  Coding DNA Sequence Number=SeqID_38894
MECSQFCITKLTSLFRVSKGLEEQNCLSGSCVCRFAFDLQWLEMKMCEDGLVLNPCPAA

SEQ ID NO: 130580 - protein, 108 aa, Glycine max
  Coding DNA Sequence Number=SeqID_38895
MPLEPGGWAAVCTPQGLRLVHPWAGHLPGKDEQQATEWLLPSRSLPLSIRSHNIPTEPNVNVRFYPNFKGHRILEWKTCNKVWRSKIDIRTQVLDPKMQKLELEAQSN

SEQ ID NO: 130581 - protein, 121 aa, Glycine max
  Coding DNA Sequence Number=SeqID_38896
MYPPLFSLNLVDIPSTRTDPQEMYPLLFSVNNPSRCTLYWEKGDTKEFRRLVLRSFGKGRRETQKEFRRLVLGEFFLAKGEEMKRMNSTSFQGLENQKTLESFLAQRRRRSSKRFKACKGL

SEQ ID NO: 130582 - protein, 236 aa, Glycine max
  Coding DNA Sequence Number=SeqID_38897
  Pfam annotation: Domain name=Retrotrans_gag; Domain location=1-69; Score=-0.7; E_value=0.062; Accession=PF03732.8; Description =Retrotransposon gag protein
AKRWLHSFKGNSLKTWDEVVEKFLKKYFPESKTADGKDAILSFHQFPDKSLKAKIKLKTSEEAMELIEDMAASGHAILRDRAHIPTKRSLLELSSQDALLAQNKLLSKQLEALTKTLTWPAIQFTTGTMEESPWKPLQQRPGCPSNRPPQQGPSLYDQTMKLEETCSVHANRSSSSFGANIEKNPKEECKVVMTRSRLVAMKEGENGIGAEKQQLVSGPTLDPMVESLSESDEELE

SEQ ID NO: 130583 - protein, 477 aa, Glycine max
  Coding DNA Sequence Number=SeqID_38898
MSSIFGSALGVGGSNFGCSIQQPMVEWEVVLIGDYSLEESPHEASDSESSFFKRLMKPSHVSEEELSATTTRSNGGEVRIFPQNRRRCGSEAPSSPPFVVGFKWVKDDVLRTSFYSCVMVQAVDPSSKSTATCLRAFEVLCPFFNIRSNVPMFLYFFEMKLTGKIGWVLLSSVSKKMFEFKSNVFHIFKDCFFKPSAREGGQTKARVNPPRAFEADEEEVFKAIPSTMLATSTPLVVPVSAPLSSIMMPLLNVGVTTIDALVNLHPPSSALLPSAPTILPSAIPSSSSPPSVSLDHVYTCRDTKSLWSMVYKPKQRNPTNFESGYLGGEWKRHKEVLNKIISLETKVTKWRAITRTESYDFVSKVERFTKEKEELNAIVSESAKEIAKLKEFELKVAKEKEENKELEEELIMFKKEVVEQHEKGFLKTVKQVDFFTEGLDLCLFDPFKDVKDDQLLDKEEIVVGEEDDDGEDNEANV

SEQ ID NO: 130584 - protein, 403 aa, Glycine max
  Coding DNA Sequence Number=SeqID_38899
MCPKYFTCGIVAKEHFKNLRKNWLARRTSKVVCRCSRWMERCITRKALQGTRSGRDASKMLSTSDEKGARARANYACLEHGGDLCLDFLLLTIWVPIGLDVDWGGCGSEVNAMIGWSRRGYGRADADMKEFTSTVGLNQTTKLHGRDSFKVSGSVTAELDNLPMMNEFHGEGVIISQDWPKGFQPVHIEDHVYATYRQDMEVCGECMALLHEVVRAPAVDQDHDGLVRNTAQHAIWVRAKYIRVWGFLKTLIICDEDEEPGGVRHFKGTNGGLGGVGNKGRVREEGEGREKIEGLGGGSGGGGPVLGAGRPRGLAEDDKGEWVELRLQYGRDSTCRDQQWKAEMKAPKLLRAKVKFPAFETQCAMVVMVGGGTEEEEVLMAREEGEAIGREIQRMKYDVALLG

SEQ ID NO: 130585 - protein, 125 aa, Glycine max
  Coding DNA Sequence Number=SeqID_38900
MDDNHCPTPSRLFKGKGAERGVEEIVALELEAKGLETQAIKVEDSSKLSDEEACDDVFEVHASSFNHHLHQVLFHCDVPDESIFNMDKDVYNGQLIPIDDIPEDGASIAELSTTPPVATHMTNGV

SEQ ID NO: 130586 - protein, 120 aa, Glycine max
  Coding DNA Sequence Number=SeqID_38901
MADQESGHQDTTPVLGYTLSPSPSPCYTLSPFAGHVPSATPNESILPHEAEEIADNLEGTTQTGTSRLKRSTRQTFLVPKVIHGKQELGTKTYDADNARTKLANAIIMHGYLLSIMDHWF

SEQ ID NO: 130587 - protein, 114 aa, Glycine max
  Coding DNA Sequence Number=SeqID_38902
MARRIGGEEAVEKRKMVGRERERRRRWVRTEVARRGRKEVRMERSAGRSFTGRPKKPWKTLWVMEARANKEKNTTKRRKKSRGNENGNGSSGGGVSVRVRVRGWGWVWRRRMWM

SEQ ID NO: 130588 - protein, 623 aa, Glycine max
  Coding DNA Sequence Number=SeqID_38903
  Gene Ontology: Mol. function=metal ion binding; Cellular component =integral to membrane; Biological process=protein palmitoylation
  Homolog annotation: Hit_ID=A7QSP4; Match level="QueryCoverage=97%, HitCoverage=96%, E-value=0.0, Identity=56%"; Hit description =Chromosome undetermined scaffold_161, whole genome shotgun sequence
  Pfam annotation: Domain name=zf-DHHC; Domain location=169-233; Score =84.9; E_value=2.6e-22; Accession=PF01529.11; Description=DHHC zinc finger domain
MRKHGWQLPYHPLQVVAVAVFLALGFAFYVFFAPFVGKKMYQYIVTGLYSQLIISVFGLYIWCAAADPADPGVFKSKKYLKIPDSKKLAELKNSKLGEESTSSMHEANASMVGSNSVDKEALGKIRTSKDASNSVEKSTSSSCSSCILLVSSPCAYICSCSSPTEKSSDKQTSEDGMFYCSLCEVEVFKYSKHCRVCNKCVDHFDHHCRWLNNCIGKKNYRQFFTLMVAAMLLFILQWLTGILVLICCFVKRKEFSVDISSKLGTSFSLVPFVLVVSICTILAMIATLPVVQLFFFHILLINPGLSTYDYIIAMREQEQEQLGNGGQQSPQMSTVSSFTGLSSASSFTTLHRGAWCTPPRLLLQDQFDVVPPETASVSSVGKKTMREDPLKKKNPGTVKISPWTLARLNAEEISKAAAEARTKSKVLQPVTRHGEAIRLEPESSFSSSGRRMVPRIESNKKGASKRIHHPANLSMESLTKVSASNTDKGLSGMSRLAPLPFEAHNTFQTSQPMSSSAGIVPSSPESSLDSPDIHPFRVSSSGAEKARQLAVAGASGAGAATLKEISLSGSTSDGYEASGGEDSDRVVPFRIVQRSTNWTNLFRADQDERAFKKPQSSTIVGHR

SEQ ID NO: 130589 - protein, 89 aa, Glycine max
  Coding DNA Sequence Number=SeqID_38904
  Homolog annotation: Hit_ID=A5BEV8; Match level="QueryCoverage=82%, HitCoverage=9%, E-value=6e-13, Identity=47%"; Hit description =Putative uncharacterized protein
MSLHVDGLITVTMDNWMDITNMGYVIASRYNVILVSLSHQQSTTFFPLRFQPPGDPSVHRIICIGHVYDNHFVQIYLKDHCPLPPIEYK

SEQ ID NO: 130590 - protein, 133 aa, Glycine max
  Coding DNA Sequence Number=SeqID_38905
MAQCCHLRILSFRCVSGAQCFPRFVRFGEGKGGGSGDVWCCSGRRRWHMRYAVLDAFWCTAFHADQMDEDQWMYERIMPEEVDMDDENEEECGVNEPHVDCSDAFNTSQVFDSQEYVLRWARSVALMKMDLWR

SEQ ID NO: 130591 - protein, 97 aa, Glycine max
  Coding DNA Sequence Number=SeqID_38906
MVGVKGFVISDSKCERSIEQIAREGKLPDTEMDKEVKGGLVMMWKGSIKGEVMSLAKNFINLKVMDEVTRGWILIGFYGIPDCDKMREFVGVTEEFG

SEQ ID NO: 130592 - protein, 214 aa, Glycine max
  Coding DNA Sequence Number=SeqID_38907
  Subcellular localization annotation: CTP_CleavageSite=69; ConfidenceScore=5.40e-01
GGFKQLKSLLGLAIYPSQANRQFDWRFPSPLRAATAHFSNSDKLSSASGEMPFHMKSPAVLAVCPDTCRVAAKSLLAMAQTAIANSDLAATRHVSGQTASTAGDFTWKGISPLALESLSLLLKLQTEQLQRAEDQGIASQTSELLGMEKKKEALVGVCVPETIHAGKKKEAIGVFVDELANASGEMPFHVKSPAVLAVCPDTCCVAAKSLLAMA

SEQ ID NO: 130593 - protein, 522 aa, Glycine max
  Coding DNA Sequence Number=SeqID_38908
  Gene Ontology: Mol. function=nucleic acid binding; Cellular component= intracellular; Biological process=regulation of transcription
  Homolog annotation: Hit_ID=A7PDG3; Match level="QueryCoverage=99%, HitCoverage=93%, E-value=3e-27, Identity=34%"; Hit description =Chromosome chr17 scaffold_12, whole genome shotgun sequence
  Pfam annotation: Domain name=zf-C2H2; Domain location=113-135; Score =7.1; E_value=1.9; Accession=PF00096.17; Description=Zinc finger, C2H2 type
  Pfam annotation: Domain name=zf-C2H2; Domain location=471-493; Score =20.6; E_value=0.0059; Accession=PF00096.17; Description=Zinc finger, C2H2 type
  Pfam annotation: Domain name=zf-C2H2; Domain location=7-29; Score =17.2; E_value=0.062; Accession=PF00096.17; Description=Zinc finger, C2H2 type
  Pfam module annotation: Pfam domain module=zf-C2H2::zf-C2H2::zf-C2H2; Domain location=113-135::471-493::7-29
MEERKKYVCKYCSKRFPCGKSLGGHIRTHIMTEERSNDVVVVDGDDNNDNMFIKLDGTVMRNNKKRDLLWCEDNNNPIYGLRENPKKTVRFVHSGGGANANNNEQQQNKEDKRFCKECGKGFPSLKALCGHMACHSEKEKRTTTTTIKFEEEKLVMDSRSDTETCAPTTHPRRSKRMRVKKTINLSNHNPFFSFSSSSSSGVVPLANGSSPVSEVEQEEQEEVARCLMLLSRDSSFNFKGGRFASVTESSDNNSVILEAKLSSPDTRIGVSNGNNNNNFVSNNHAYDLVAKKLLKVKDIKFKSAEFGASDNYSGSRFFRYGPKTKMVDSDFSNDEFRWSKVEGKSSKYTASVVKKLGVEDLDYDTTHGTTRKFDSIKRNNYDLVGVSSKKIASGFGNEVYKNGTRGWKYECFEVERDNDSYDSIDDESNENSSETESFPAPRSHHKSKALNGKKCTKPKKKLKPSKKSKDHECPICYKIFKSGQALGGHKRSHFIGGSEENTMVIKQVPYFIDLNLPAPVDE

SEQ ID NO: 130594 - protein, 28 aa, Glycine max
  Coding DNA Sequence Number=SeqID_38909
MWPQDSQHQRQPTRIKSHINNRTVLSFL

SEQ ID NO: 130595 - protein, 653 aa, Glycine max
  Coding DNA Sequence Number=SeqID_38910
  Gene Ontology: Mol. function=extracellular-glutamate-gated ion channel activity; Cellular component=integral to membrane; Biological process=ion transport
  Homolog annotation: Hit_ID=A5BU55; Match level="QueryCoverage=88%, HitCoverage=73%, E-value=1e-103, Identity=37%"; Hit description =Putative uncharacterized protein
  Pfam annotation: Domain name=ANF_receptor; Domain location=23-329; Score=157.6; E_value=3.3e-44; Accession=PF01094.19; Description =Receptor family ligand binding region
  Pfam annotation: Domain name=Lig_chan; Domain location=383-612; Score= -82.7; E_value=1.8e-05; Accession=PF00060.17; Description=Ligand -gated ion channel
  Pfam annotation: Domain name=SBP_bac_3; Domain location=363-598; Score=-62.3; E_value=0.00074; Accession=PF00497.11; Description =Bacterial extracellular solute-binding proteins, family 3
  Pfam module annotation: Pfam domain module=ANF_receptor::Lig _chan::SBP_bac_3; Domain location=23-329::383-612::363-598
MAKEAIPIPIGIVLDLNSSIGSMSNSCIWMAYQDFYERHPHYKTRLALQTRDSRDNVVTAASVAQELLNEKVHAIIGPQTSEQAWFVIELGSKAQVPVISFSATSPSLSSTQKPYFIRAARDDSSQVEAIAAIVQGNGWREIIPIYEDTEYGNGLNPYLNDAFVKIGTRVPYRSVISPGSGGAEISNELKKLNTDLGCKVFLAAKKEGMMTIGYAWIVTEGLSAEVDPMVLKCIGTMQGVLGVRPSPKHTKRLDNFKERYGNTVTIFGLWAYDSVWALAKAVEKVWGENVTATLHNTILATKFHGLSGNFHLVKGQLEPSILEVFNVVEQTERSIGNWMPERGLSKLEQPKWPGNTTEPPAKLRIGIPPTNSVNEFKKFLNFSFDVFFEVLKKYDAVVGDVTIVAKRSEYVDFTMPFSESGVAMLLSSSQASSFGFSNTAQTRSSGALQRTKSAWLSGREQMVTICADYMVLCGTHHNAKLHCKFSFNSHGLLIEKLGFNESKLKGYHGPKAYQQALSLGSNNGGVAAVFDEIVFINLFLMKYGCKKYQIVGPTYKTDGFAFAFPRNSPLVPYFSRSILNVTENKTTFDGIKKKYFSRDVISEDPIMVHLFKFMHSKWTARDFQRSLSEMMTELAKHFNKEECSLHPPPIMEE

SEQ ID NO: 130596 - protein, 398 aa, Glycine max
  Coding DNA Sequence Number=SeqID_38911
  Homolog annotation: Hit_ID=A7P2J4; Match level="QueryCoverage=45%, HitCoverage=32%, E-value=8e-85, Identity=83%"; Hit description =Chromosome chr1 scaffold_5, whole genome shotgun sequence
MISAYFIVSLLNAASILKYDFCFKLAIVYKCLKGGTVRRFLEKQKNNIIAVVFCTVSTTDTEIYKRLLPLYFPRDKHEEQVALSKLPADVGDENGETISDERKIRIKPLPKRIVSRPPEFPADHPVSDVGLVSRNSSHLDSFLDPAFMSMIKDPDQRRMEQWEKTAEAQRGWNCAKLIGYGDLGGPSLSAAEEYSLHSRYLSKANSLNLSEIAEMKIVINTALVRDYSAFVIFSQCNIQISFLFSILSTWYLELSDPFSWLPQILMQLWLTPATLVRSDSSKQHRCDSVSSEQLRNKISFSLFGFSQRSRARCLLVFLDRRTRIKCGTRPKFSDFLSYIKELIDALASVGDAATYREHMDAILEGLPRNFDSTIALIESRLPHITIEEAEGYILVQEL

SEQ ID NO: 130597 - protein, 82 aa, Glycine max
  Coding DNA Sequence Number=SeqID_38912
MAKNERKVKRMEVESWLCRAGGGGDRGEAVVRCCKSMADDLFLYIRAMDPPLVGSSTARERLDGIGKSTRQPTNPVTEKGKR

SEQ ID NO: 130598 - protein, 357 aa, Glycine max
  Coding DNA Sequence Number=SeqID_38913
  Gene Ontology: Mol. function=molecular_function; Cellular component =endoplasmic reticulum; Biological process=biological_process
  Homolog annotation: Hit_ID=Q9ZQ87; Match level="QueryCoverage=92%, HitCoverage=84%, E-value=1e-138, Identity=75%"; Hit description =Expressed protein
  Pfam annotation: Domain name=Band_7; Domain location=21-230; Score =49.2; E_value=1.4e-11; Accession=PF01145.16; Description=SPFH domain Band 7 family
MNRVLLPSASPSFQNSLSILHQVPEGHVGVYWRGGALLKTITEPGAKYSFDFFNVYKQKRLLHVLRINFPGFHLKMPFITQYEPVQVTLQTDMVIDIPCGTKGGVMISFGKIEVVNQLHKEFVFETLLNYGVHYDKTWIYDKIHHEINQFCSSHSLQQVYIDVFDQIDEKMKDALQVDCTRYAPGIEILSVRVTKPTIPESIRRNFEQMEEERTKVLIAIEKQKVSEKEAETMKKMAISEAEKNANVSKILMEQKLLEKDSARRQEEIENAMYLAREKSLADADFYRVIKEAEANRLKLTPEFLQLKFIQAIANNTKIFFGDKLGLQVPNMILDQRLLGNLLHDVSRGRTTTAKADI

SEQ ID NO: 130599 - protein, 699 aa, Glycine max
  Coding DNA Sequence Number=SeqID_38914
  Gene Ontology: Mol. function=binding; Cellular component=nucleus; Biological process=metabolic process
  Homolog annotation: Hit_ID=A5AY98; Match level="QueryCoverage=94%, HitCoverage=93%, E-value=0.0, Identity=59%"; Hit description =Putative uncharacterized protein
  Pfam annotation: Domain name=PPR; Domain location=200-234; Score =26.2; E_value=0.00012; Accession=PF01535.11; Description=PPR repeat
  Pfam annotation: Domain name=PPR; Domain location=235-269; Score=8.0; E_value=0.87; Accession=PF01535.11; Description=PPR repeat
  Pfam annotation: Domain name=PPR; Domain location=270-304; Score =15.0; E_value=0.13; Accession=PF01535.11; Description=PPR repeat
  Pfam annotation: Domain name=PPR; Domain location=305-339; Score =34.6; E_value=3.6e-07; Accession=PF01535.11; Description=PPR repeat
  Pfam annotation: Domain name=PPR; Domain location=405-439; Score =34.5; E_value=3.9e-07; Accession=PF01535.11; Description=PPR repeat
  Pfam annotation: Domain name=PPR; Domain location=440-474; Score=4.5; E_value=2.3; Accession=PF01535.11; Description=PPR repeat
  Pfam annotation: Domain name=PPR; Domain location=507-541; Score =34.7; E_value=3.3e-07; Accession=PF01535.11; Description=PPR repeat
  Pfam annotation: Domain name=PPR; Domain location=542-576; Score =14.2; E_value=0.16; Accession=PF01535.11; Description=PPR repeat
  Pfam annotation: Domain name=PPR; Domain location=578-611; Score =13.3; E_value=0.2; Accession=PF01535.11; Description=PPR repeat
  Pfam annotation: Domain name=PPR; Domain location=97-130; Score=5.3; E_value=1.8; Accession=PF01535.11; Description=PPR repeat
  Pfam module annotation: Pfam domain module=PPR::PPR::PPR::PPR::PPR::PP R::PPR::PPR::PPR::PPR; Domain location=200-234::235-269::270-304::305- 339::405-439::440-474::507-541::542-576::578-611::97-130
MFPISRVLRVTTKPRLHWNSLYHHHGQKQQPPSPPTFYLSRLCTNLPSLKTLHASFLIHGLTNDLLLSTKLLSLYASFGQLRHARKIFNHLPTRDLYCFKVMIRAYFLNDTPSGVVSLYRLMRLSLHPTPHDYVLFSIVFKSCAESRDFQTLTITHCHFVKSLPSDSFVLTCLVDAYAKFARVDEATRAFDEIHENDDVVSWTSMIVAYVQNDCAREGLTLFNRMREAFVDGNEFTVGSLVSACTKLNWLHQGKWVHGFVIKNGICVNSYLTTSLLNMYVKCGNIQDACKVFDESSSSSYDRDLVSWTAMIVGYSQRGYPHLALELFKDKKWSGILPNSVTVSSLLSSCAQLGNSVMGKLLHGLAVKCGLDDHPVRNALVDMYAKCGVVSDARCVFEAMLEKDVVSWNSIISGFVQSGEAYEALNLFRRMGLELFSPDAVTVVGILSACASLGMLHLGCSVHGLALKDGLVVSSIYVGTALLNFYAKCGDARAARMVFDSMGEKNAVTWGAMIGGYGMQGDGNGSLTLFRDMLEELVEPNEVVFTTILAACSHSGMVGEGSRLFNLMCGELNFVPSMKHYACMVDMLARAGNLEEALDFIERMPVQPSVSVFGAFLHGCGLHSRFELGGAAIKKMLELHPDEACYYVLVSNLYASDGRWGMVKQVREMIKQRGLNKVPGCSSVEMDLQNDSYAKVAVVS

SEQ ID NO: 130600 - protein, 106 aa, Glycine max
  Coding DNA Sequence Number=SeqID_38915
MAGAGDNGGVYHQLDGSQRLLLEAMTTQIQRLLNRNNEELYRRIEGLEHQMNPNAGRPYGGNNGTSTRLFKENNGGYIPYGSLLVKGFLQSWKRNLKDRRSLEDWM

SEQ ID NO: 130601 - protein, 269 aa, Glycine max
  Coding DNA Sequence Number=SeqID_38916
  Homolog annotation: Hit_ID=A7P0D2; Match level="QueryCoverage=67%, HitCoverage=90%, E-value=2e-89, Identity=92%"; Hit description =Chromosome chr6 scaffold_3, whole genome shotgun sequence
  Pfam annotation: Domain name=PurA; Domain location=77-249; Score= -90.4; E_value=0.0023; Accession=PF04845.4; Description=PurA ssDNA and RNA-binding protein
  Subcellular localization annotation: CTP_CleavageSite=31; ConfidenceScore=5.07e-01
MARFSTHPSSQLPFIWSSLSFVFLMAPENCKAPSYSDAAESFFRIFPLSIPNLPPKSNLKSSSNHWKCLQREFDGRKGVKDQINLYWKFWDVSEASVSRNRSTIIVPAGSSRDEGWAAFRNVLAEINEASRLFILPNQQNSESSERLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMTVANVRTVDPPQR

SEQ ID NO: 130602 - protein, 281 aa, Glycine max
  Coding DNA Sequence Number=SeqID_38917
MEEAQIWGKGKLPAFVGEDPICWIATAENSEVQEIPSFHKLQYAFMSMEGAAMHWFYIWSQKNPDSDWESFSTALKDSEITMRTNILELKHMLHKLLNEEADPQSTEQEKNSMEGSGSECSEAKASWTRKKSLLDPNSIMKVVGTSMALKSWNFNLLGDPLALNFVASMADSLDTELRHKECTESWFTDEDMTKSKDKDPLGGPMTRTRARKVKEAFQQVLSILFDYKSKFQGEKFKWSFDSFGKAPTDLTHESVSHHKGRTLLQLKKRCAASSSEWRRTK

SEQ ID NO: 130603 - protein, 487 aa, Glycine max
  Coding DNA Sequence Number=SeqID_38918
  Gene Ontology: Mol. function=calmodulin binding; Cellular component =alpha-glucosidase II complex; Biological process=protein kinase cascade
  Homolog annotation: Hit_ID=Q9FM96; Match level="QueryCoverage=66%, HitCoverage=51%, E-value=5e-68, Identity=42%"; Hit description =Genomic DNA, chromosome 5, P1 clone: MCD7
MMTYNNNNNNNNNNNNQFIVEGASLTRPPGFIGEDYPYCINYEGTKDVQLRKPATLTHQYESFSMKEGEYADDMFGRVQVLLNGLKALGHTFTKGQINLKIQDSFPKNMKLLIALLLVLCAPFSSSSKPKDPFLGISPEDDKYYKASDVIRCKDGSGKFTKAQLNDDFCDCADGTDEPGTSACPGGKFYCRNAGHSPVYLFSSRVNDGICDCCDGTDEYDGQVKCPNTCWEAGKVARDRLEKKIATYQEGVKLRKLEMEQAKVAMEKDEAELSKLKKEESILKGIVKQLKDHKEQIEKAEEKERLQKEKEEKQKKESEEKANEAKDKADEDTGHRNEAEKHSDVEDNSVENNHDKIENLEGSPADQDEAGDKLEDVLDNDDEASDSPGSEGSLHNKVEENAKEAEEEPIVKSETDIKVGNKESSAEIINKHLKNVNKEAATLIDAKEVAGTKLSLIAPRFRAAIVPRQLPGSSLTSQQHNSGHRSIR

SEQ ID NO: 130604 - protein, 422 aa, Glycine max
  Coding DNA Sequence Number=SeqID_38919
  Gene Ontology: Mol. function=nucleic acid binding; Cellular component= intracellular; Biological process=response to DNA damage stimulus
  Homolog annotation: Hit_ID=A7Q1D9; Match level="QueryCoverage=100%, HitCoverage=100%, E-value=3e-89, Identity=48%"; Hit description =Chromosome chr10 scaffold_43, whole genome shotgun sequence
  Pfam annotation: Domain name=G-patch; Domain location=213-257; Score =74.3; E_value=4.1e-19; Accession=PF01585.14; Description=G-patch domain
  Subcellular localization annotation: CTP_CleavageSite=52; ConfidenceScore=5.10e-01
MLGGLYGDLPPPSSAEEDNKPTPNVWSSSTKMAPATLRKPASLFAPPQTLLRAHPKPKPTAKPVLSSTTPALPPEDSPLQPALVGVQSTVLEEYDPARPNDYEEYRRDLKRKAREAEMLRELERRRQEEEEEEKEREKEREKERERDYNNNNDSSSSRLNVSGEEAWRRRAAMSGAAAGAPPRSPSPPLPGNSDGFSIGKSETGGLGVGAGGQMTAAQRMMAKMGWKEGQGLGKQEQGITTPLMAKKTDRRAGVIVNASDNNSSSKKVKSVNFNGVPTRVLLLRNMLPIDLEVAALDELIHIKCPTFVYLTMSLRVDMQLPHLKVGPGEVDDELEDEVGSECAKYGIVTRVLIFEITEPNFPVHEAVRIFVQFERSEETTKALVDLDGRYFGGRVVRATFYDEEKFSKNELAPMPGEIPGFT

SEQ ID NO: 130605 - protein, 544 aa, Glycine max
  Coding DNA Sequence Number=SeqID_38920
  Gene Ontology: Mol. function=RNA-directed DNA polymerase activity; Biological process=RNA-dependent DNA replication
  Homolog annotation: Hit_ID=A2Q4L4; Match level="QueryCoverage=46%, HitCoverage=32%, E-value=6e-15, Identity=28%"; Hit description=RNA -directed DNA polymerase
MMSGGTSERSHGLAKEKHSEEREIQGKGKRVDTEEKKEYKNLLRWKMKTLSIFKTIQKWDEDLGLANRNKEFLESRLCLNYGVHFVPSDDIFIVKGVVIDLTKIVFQVKEDCGSRRQIEKHNGAFNGVQALVDIHEETKNFSRVDCAQILDTIVVHFMDFDLEEDRNKEGLWKQEADRKARQGVQSEKKHFYSHWKSSSQVKGGGRYEQQGKQLGVTGIGNAKEKDGQGMKLEAKKEGSVKDNGTRDNFKNLKEDLVTVEDTSLVDGRSGPKAQYQKKKVDFKKAYCSLSWEFLLYMLKSPTQEFKCSKGLTQGVPLVPFLFLGVAEGLSGLMKEVKVKDLYMATRCGSWDGYLNLSNCKTLELPFIYLGLPIGGNPRRLLKEVWRKLVGMERRFLWGGNDENKKIVLVNWKEGLMRDGELSRDPLWWRDLKKVCGGWCSKKWFKERTKWKIGVGGHMVLGFKMEKGVFESENRLFQDFNNVLQAIQVIKHVADSWFWRPISSSDHTTNSTYVLSVQAIGEDNNNDLISQTWSIIIPNNVTFLI

SEQ ID NO: 130606 - protein, 92 aa, Glycine max
  Coding DNA Sequence Number=SeqID_38921
  Gene Ontology: Mol. function=helicase activity; Biological process =viral genome replication
  Homolog annotation: Hit_ID=A2Q378; Match level="QueryCoverage=93%, HitCoverage=5%, E-value=3e-12, Identity=43%"; Hit description =Putative uncharacterized protein
MSQYVVIQPEIVSTLSQMLDEHNIHAKSFRMARDRLADSQLDSVKLRLIAGHEKDGHTYNLPDVSEVATLIVGDFDADSRRDILVETQNGEL

SEQ ID NO: 130607 - protein, 179 aa, Glycine max
  Coding DNA Sequence Number=SeqID_38922
  Subcellular localization annotation: CTP_CleavageSite=45; ConfidenceScore=5.37e-01
MDYGRLGPSDLGGSSRLNSLRSSGRKKIVLLSLFAVLIIVASTVTAVVVRSHTKNTRADGTSLEKFTKAISSEIDRFLALSLSRGIWKRRVCRINTHLSLLSLSLSGKNKAEEATQNRTTEPTQNHKCFEVASRKTAPQPALLHHDSGRSSRDPKPRRYTRVRRGWVSLRRYSGRYSCY

SEQ ID NO: 130608 - protein, 169 aa, Glycine max
  Coding DNA Sequence Number=SeqID_38923
  Gene Ontology: Mol. function=histone-lysine N-methyltransferase activity; Cellular component=nucleus; Biological process =multicellular organismal development
  Homolog annotation: Hit_ID=A7QCS5; Match level="QueryCoverage=89%, HitCoverage=93%, E-value=6e-60, Identity=73%"; Hit description =Chromosome undetermined scaffold_79, whole genome shotgun sequence
  Pfam annotation: Domain name=DUF260; Domain location=23-123; Score =245.5; E_value=1.2e-70; Accession=PF03195.5; Description=Protein of unknown function DUF260
PINPPPPSATILGRVLLDGAPSPCAACKLLRRRCAQDCVFAPYFPADEPQKFANVHKVFGASNVNKMLQDLAEHQRGDAVSSMVYEANARVRDPVYGCVGAISSLQQQIDVLQTQLAVAQAEAVHLRVRQTASLYSPTSPTNSGSPSQAKPIFDMDMVVDQNSYGDSMW

SEQ ID NO: 130609 - protein, 168 aa, Glycine max
  Coding DNA Sequence Number=SeqID_38924
  Subcellular localization annotation: CTP_CleavageSite=17; ConfidenceScore=5.13e-01
MVESSKKRKGSSSTSIAAGQRRHDTSGDQPAPPPPSFSSPRSLTLFSLDDQHQSQGVPFDGTLVDDWKYAYSSYDARKMVYNDHADMTDKLLAGSFTFECHIMHYILCRVLLPRSSNFAQASEEDLILLWALQTGRQIDWAHLVRHRMHKALRANAPLPYPHLVTLFL

SEQ ID NO: 130610 - protein, 173 aa, Glycine max
  Coding DNA Sequence Number=SeqID_38925
MVCNDNANMTGRLLVGSFTFECRIMHYVLCRILLPRSTNLTQASKEDLILLWALQTGCQIDCAHLVRYRMHKALRVNALLPYPHLVTLFLQHFNIPSEDEPFVKVKRSFAIGVGTVTSFGYQKDMDGQWVFLTELRDLRAFVGDRFDTMDSRITHLEDNMSFIRRCFDPPADS

SEQ ID NO: 130611 - protein, 111 aa, Glycine max
  Coding DNA Sequence Number=SeqID_38926
MTTEHRVRKELLDAGELLGNPKVAVSRATLAQVRDINDDSIEICYLRGVLQVIWPVKLHDAAFPVRLFANDLVDLVIEIAEAVLVETSVLDLSYFSVDLSHDCRPPRGCKT

SEQ ID NO: 130612 - protein, 99 aa, Glycine max
  Coding DNA Sequence Number=SeqID_38927
GRRHAWSSLVFDGFGCARLKTSLLPRKVHFFRACHLPLESAEETIFRPTSNGTQTRAEEMNLPRKKARLQPRATKTIKNQTRPSMSSTLWPSKAIKGEK

SEQ ID NO: 130613 - protein, 201 aa, Glycine max
  Coding DNA Sequence Number=SeqID_38928
  Gene Ontology: Mol. function=nucleotide binding; Cellular component =intrinsic to membrane; Biological process=defense response
  Homolog annotation: Hit_ID=Q2YE88; Match level="QueryCoverage=76%, HitCoverage=12%, E-value=1e-74, Identity=87%"; Hit description=NBS -LRR type disease resistance protein Rps1-k-1
MPRGMSKLNHLQHLDFFVVGKHQENGIKELGGLSNLRGQLELRNMENVSQSDEALEARMMDKKHINSLLLEWSGCNNNSTNFQLEIDVLCKLQPHFNIESLQIKGYKGTKFPDWMGNSSYCNMTRLTLSDCDNCSMLPSLEQLPSLKFLVFTRMKIVVLGGPFPPLNLCSFMTCLVGSCGVPLIQKLFLCLKVLEYLAAPN

SEQ ID NO: 130614 - protein, 177 aa, Glycine max
  Coding DNA Sequence Number=SeqID_38929
MSKSCGFGMTGPLDESISCFLIRLDPWVLDLSPLRGLRVLAIRGLHVLNFRGLHALAIRGLHVLALRGLHALTLEDYASSPPEGCTPSPPEDYNVLALRGLHALTLGTSYPSTSEDYTSSPSKGMCLHLCRATALTFRGLHVLTFRGLHPRHQRTTCSPFSKGGMPSPSEDCTSLPS

SEQ ID NO: 130615 - protein, 105 aa, Glycine max
  Coding DNA Sequence Number=SeqID_38930
  Homolog annotation: Hit_ID=A0PAV3; Match level="QueryCoverage=26%, HitCoverage=14%, E-value=6e-07, Identity=89%"; Hit description =Restriction endonuclease
  Pfam annotation: Domain name=Ins_element1; Domain location=39-98; Score=-14.0; E_value=0.0028; Accession=PF03811.4; Description =Insertion element protein
WNSYVPINVSFSPKVGPGLPGINRDTRIYLFCEVIFRHSCPSCSATDGVVRNGKSTAGHQRWQAAQLLGRAIGAGLFAITPAGERGMCCKAIKLGNARVFPVTTL

SEQ ID NO: 130616 - protein, 255 aa, Glycine max
  Coding DNA Sequence Number=SeqID_38931
  Gene Ontology: Mol. function=motor activity; Cellular component=cell projection
  Homolog annotation: Hit_ID=UPI00016621D1; Match level="QueryCoverage =96%, HitCoverage=40%, E-value=1e-22, Identity=36%"; Hit description =UPI00016621D1 related cluster
DGPWGTSTHTIRGLHVLTFRGLHALTFGGLHILAFVGLHALTFTGLRVLAFRGLHTFAFRGLYVLTFRGLHVLTFRGLHVLTYRGLHALAFSGLYVLTFRGLHALTFIGLHALAFRGLCVLTFRGLHVLAFRGLNAIAFRGLHVHTIKGLHVLTIRGLHDLTFKGLDVLAIRGLHVLTFRGLHVLAIRGLHALTFKGLHVLAFRGLHVLAFRGLHVLAFRGLHVLAFKGLHVLTFRGLHALAFRGLHTLTFRGIL

SEQ ID NO: 130617 - protein, 249 aa, Glycine max
  Coding DNA Sequence Number=SeqID_38932
VVLFPNIDSLVDLAAIDAFLAYHHSKESPVVAILADLFDTFDRSAINWFPRWKEGKEGVLFSCGDYPNVLLIGTRGAQSLKAIQRVHKAWRSPLRKGKELRGIRNGIIGVIDEEDCEASEEDEEVRALKLDLGKARLAKEKFKSAATHIRKECTELQEENVATAKALEQETKRARKEEYGREKFRGALWGSNNELKLRREERDRSRVHGMILKEELVACARSERSVAQHLEATEQSILAIIRQYKEELN

SEQ ID NO: 130618 - protein, 78 aa, Glycine max
  Coding DNA Sequence Number=SeqID_38933
MMAHHKVLSCLSREWQPKVTAITESRDLSNMALENDKKKKGIALKAPSSIQEESDKEIDLDEDDDLSLFVKRFNKFLK

SEQ ID NO: 130619 - protein, 35 aa, Glycine max
  Coding DNA Sequence Number=SeqID_38934
MAVGSTAMGALVAPMAAGAAASSAAAPQQAREYQP

SEQ ID NO: 130620 - protein, 144 aa, Glycine max
  Coding DNA Sequence Number=SeqID_38935
  Homolog annotation: Hit_ID=UPI00006A2D9E; Match level="QueryCoverage =90%, HitCoverage=65%, E-value=6e-13, Identity=17%"; Hit description =UPI00006A2D9E related cluster
LHVLAFKGQHVLAFAFVGLHTLTFRGLHVLAFRGLHVLTFRGLHVLTFRGLHALTFRGLHALTFRGLHVLAFRGLHVLTYRGLHILAFRGLHVLAFRVFHALAFKGRHILNFRGLHALAFRGLRVLTFNGLHIHILREFKVLCP

SEQ ID NO: 130621 - protein, 119 aa, Glycine max
  Coding DNA Sequence Number=SeqID_38936
  Subcellular localization annotation: CTP_CleavageSite=36; ConfidenceScore=5.18e-01
MPSSTKKRPRSFMIIKKDFMVGQKVLLYNSRLGLMSVEIKSNTTNKSFKVNKHRLKPFLTNPSLVDIVVEETSLEDERLASLNETEWAKIQRRVVSMIRLVLAPEIKHNMLKEKTPKAL

SEQ ID NO: 130622 - protein, 227 aa, Glycine max
  Coding DNA Sequence Number=SeqID_38937
YQGSVWRKGQRPWQIKANGLSFSDILALLIFGVVLFPNMEGLVDLAVIDAFLAFHHGKESPVVAILTMYDTFDRGCEKSSRELFVVHWLSMCGWFHTFFLQEGRPVYPLQGHRSCIEKGKANWDQLLANMEGRLLIGSLARRKEESGFYLHAKDDRELRGSSNGIIGGYHKWLRVRTQGLDWLPNLKTVRDNEVKASEESDQVQALKAKLERARVVKEKFKSIAIKV

SEQ ID NO: 130623 - protein, 92 aa, Glycine max
  Coding DNA Sequence Number=SeqID_38938
  Subcellular localization annotation: CTP_CleavageSite=23; ConfidenceScore=5.11e-01
MGDRCRTGCHDITLQNMQFKCVRMNRLNKYNRFICPVFSGRMSGHRVRHRGSCSFTSALDFYLALYSNSSILGQDVRTLYPTSWILQLHFCT

SEQ ID NO: 130624 - protein, 36 aa, Glycine max
  Coding DNA Sequence Number=SeqID_38939
FDLVKNPTIGHLLIQLSSNFSLVSVLEAIAVPGVQS

SEQ ID NO: 130625 - protein, 83 aa, Glycine max
  Coding DNA Sequence Number=SeqID_38940
MGMKVVTETTDRQKKDRLSRCLLPKERIGLSAAQNQPNLFMVTSPYPTLFVLLHVPYGIQIQSSLLPMIEVKIRNVCFPYSNK

SEQ ID NO: 130626 - protein, 78 aa, Glycine max
  Coding DNA Sequence Number=SeqID_38941
MAGRGKDQNRDVLDRITAVLETLVQERDVEPAEYRGLMAFRKNHPLKFSGDYDPEGARLWLAKTEKIFEATGCLEEHK

SEQ ID NO: 130627 - protein, 55 aa, Glycine max
  Coding DNA Sequence Number=SeqID_38942
  Homolog annotation: Hit_ID=A7PG34; Match level="QueryCoverage=87%, HitCoverage=8%, E-value=2e-12, Identity=70%"; Hit description =Chromosome chr6 scaffold_15, whole genome shotgun sequence
  Pfam annotation: Domain name=WD40; Domain location=1-37; Score=20.3; E_value=0.0074; Accession=PF00400.23; Description=WD domain, G-beta repeat
MKFLISLVPHSAAVYSLAFEFPWLVSASSDGKLALIDVRKLLKISKRALGKRVSK

SEQ ID NO: 130628 - protein, 70 aa, Glycine max
  Coding DNA Sequence Number=SeqID_38943
MALKKLSAKRSRRDTAAEGTSAAPEFDSHRFKSAEHQQRFEAIKGWSFDKERRVQIRDDEYIDFQEEIAR

SEQ ID NO: 130629 - protein, 103 aa, Glycine max
  Coding DNA Sequence Number=SeqID_38944
MKHSSKLESGGHMNENAIPGVPKKQGEWRIALRAIVKHSSKLESGGHMNENAIHGAPKKGREWRIALKAIMKHNSKLESGGHMNENAIHGAPKKVGEWRIALR

SEQ ID NO: 130630 - protein, 80 aa, Glycine max
  Coding DNA Sequence Number=SeqID_38945
MSQPTLRREGDARLTGASSMGGKCAKSPPTFIREKRQKNRKRCGLRTLSVKGLGVVFTHGEGCFPRSYVFLNCDKEIRPT

SEQ ID NO: 130631 - protein, 57 aa, Glycine max
  Coding DNA Sequence Number=SeqID_38946
MARKGSSWQSVVVEEEVGGVVMQSYPPRALDRRLQEDWARDAREGPKVLMRLMGSIT

SEQ ID NO: 130632 - protein, 64 aa, Glycine max
  Coding DNA Sequence Number=SeqID_38947
KVVASRGSNLARLGELVGKLLPYFAINRGRSEGRRGSAFLALLILSKLLRKIISVKKIQAESST

SEQ ID NO: 130633 - protein, 200 aa, Glycine max
  Coding DNA Sequence Number=SeqID_38948
  Homolog annotation: Hit_ID=A1Z0H8; Match level="QueryCoverage=34%, HitCoverage=15%, E-value=6e-07, Identity=41%"; Hit description=D-myo- inositol 3-phosphate synthase
MSDDSHNNVPKLVGHVERCNIGVGEDPLGELMKILFMDDYGTSRGNGLVYGFLEPQCIHNAKDRRQQCQHYIETWVKESQRQLYLGAYLNHSMKTITSTFKCMSDQAAPWWIEPKSHVQTGGYECGYYVMHWMWFIVTASLKDEWNRASMLSKIGSAGDSVCLDNLLDHFGISWSTKDKIQQPNYFESFMQASAIRVGSF

SEQ ID NO: 130634 - protein, 166 aa, Glycine max
  Coding DNA Sequence Number=SeqID_38949
MATISPNDHFIAAATFTVDVKVRFNVKIYLIYYGLLIYLNVRKYGSNDFQDYFNDAKESRVKHVPKNQESKSFQNQVSKNQDSRIIKFQDSIKFQESRSRFKNQEKTLSRKVLKKFFKTLSSTRIFHKIFYQRVLLSGNRLPEGSNRLPAASIVFKTDLQSCNRLP

SEQ ID NO: 130635 - protein, 222 aa, Glycine max
  Coding DNA Sequence Number=SeqID_38950
  Gene Ontology: Mol. function=transporter activity; Cellular component= integral to membrane; Biological process=lipid transport
  Homolog annotation: Hit_ID=Q9F0Y5; Match level="QueryCoverage=100%, HitCoverage=50%, E-value=1e-117, Identity=90%"; Hit description =Outer membrane protein FadL
  Pfam annotation: Domain name=Toluene_X; Domain location=1-222; Score =107.4; E_value=4.2e-29; Accession=PF03349.7; Description=Outer membrane protein transport protein (OMPP1FadLTodX)
GDEWGFGWNAGILYELDKNNRYGFTYRSEVKIDFDGDYKSSLPSAYNQILGNFGLPLGTNGSTTGGSLSLHLPEMWELSGYNRVAPQWAIHYSLTYTSWSQFQELKATNSKGDTLFYKDESFRDAYRIALGTTYYMDDNWTFRTGIAFDDSPVPADKRSISIPDQDRFWLSAGATYAFNKDASIDAGISYMHGQKVSFKEGPYEFSSEGKAWLYGMNFNYAF

SEQ ID NO: 130636 - protein, 97 aa, Glycine max
  Coding DNA Sequence Number=SeqID_38951
MKNLHPSGRHLSVEIIAEKPLNFVHSTLKRFSKPIGLHPWHDDKALAVRVSRLHVITPSVEDSVTSRYLVCVEFQQDIRHVTLLAWEKCCIGHWDAP

SEQ ID NO: 130637 - protein, 228 aa, Glycine max
  Coding DNA Sequence Number=SeqID_38952
GLHALTFRGLHVLTFRGLHVLTFKGLHAFAFVGLEVLKFRGLHVLAIRGLHVLTFTGLYALAFRGLHTLAFIPGPPPDPRGGLTMQVQPEEEAIVQLLCILGQDFTRAAAKRRVRIMRTNMTTITQIWMTLLLSNILPNDRNADLPLRKYQDRAHKTPSGSGEVQQGPGVSSFGYGPLSVLQGARSPQQGIAPARNPVDPEKSNRALGFPALIMSLCQFYGVPVTPNK

SEQ ID NO: 130638 - protein, 68 aa, Glycine max
  Coding DNA Sequence Number=SeqID_38953
MYEIENDEGHYCLGSSSSMDSFASWKKNASGMEKEEREEIPLQGEDESRRSSPPYEAMDKSLEEKGDE

SEQ ID NO: 130639 - protein, 140 aa, Glycine max
  Coding DNA Sequence Number=SeqID_38954
MPGIATQTMSLAERSFRKGMREIERRNWHKEFTNFSEGSINVAIVKEFYANLYDPKDKSPKQVRVRGHVIKFDADALNTFLKTPVVIEEGESLPAYSRFANLRPAPQELAACLCLPGKGFELNADDLPLKIMRKNLTTLA

SEQ ID NO: 130640 - protein, 108 aa, Glycine max
  Coding DNA Sequence Number=SeqID_38955
MAPKKLSAKRSRRDAEAEGTSATPEFDSHHFRSAEHQQRFEAIKGGSFHRERRVQLRHDEYINFQKEIARPHWTSLVTPMAKFDPDIVLEFYANAWPTEEGVRDMRSW

SEQ ID NO: 130641 - protein, 104 aa, Glycine max
  Coding DNA Sequence Number=SeqID_38956
  Pfam annotation: Domain name=zf-CCHC; Domain location=48-65; Score =18.9; E_value=0.0021; Accession=PF00098.14; Description=Zinc knuckle
MEDSIDLDDDEELSLFVKRFNKFLRMRETQRRQNFKPKRRIEESSQTRRCYECNQLEHLRVDCSMFKKRMEKFENKNIGEKKAKKAYITWDDNDLESSDDSKKE

SEQ ID NO: 130642 - protein, 126 aa, Glycine max
  Coding DNA Sequence Number=SeqID_38957
STLEDPTSIAANKLFDTRRFTSSSAQTISVILTLESHDMRRYPSGYPFKTISVILTLESRDMRRYPSGGGPDDMRLSARSMSDKRAGTNSAPFIIQKQRVKWNNKLGGKRAETNFAPFIIQEQQVG

SEQ ID NO: 130643 - protein, 88 aa, Glycine max
  Coding DNA Sequence Number=SeqID_38958
MSLHSSSSANGEGSTPKDPLYTILDELRSLKLWKEKQERKEKEGAIVHILNITPKEEKQDRRPQKVNISLPYFHGTDTVEAYLDCEMK

SEQ ID NO: 130644 - protein, 65 aa, Glycine max
  Coding DNA Sequence Number=SeqID_38959
MLVATPRVFLSWDTHPRVTSRPLVEGVKPIPKIQESRFKNIQESRFKNNQDQDSRIKKRFNQDKY

SEQ ID NO: 130645 - protein, 103 aa, Glycine max
  Coding DNA Sequence Number=SeqID_38960
MLNIQNLIYGYGRFHQQTLLPRGENTETFSSLTSYPELRRSEFLIGGYVGARASLLSTIPPFVAMTQELVARGDTLRLSASFCHPEAVVSDGTQRPSLVILHT

SEQ ID NO: 130646 - protein, 61 aa, Glycine max
  Coding DNA Sequence Number=SeqID_38961
LYAFLDFRFIIIKKGEIVEASFMMMNQAILMMPKAQVIDSRLQDQALRIQSKIQEKKSRSN

SEQ ID NO: 130647 - protein, 88 aa, Glycine max
  Coding DNA Sequence Number=SeqID_38962
  Subcellular localization annotation: CTP_CleavageSite=46; ConfidenceScore=5.03e-01
MGLKSALRLMRTLGPSLASLPNLLGVFYPMPLRGRIASRHDHGFLCGALRGNVTSPKTFEAFNVAIPFLGTSVRGVFLYGLTLVFLGF

SEQ ID NO: 130648 - protein, 37 aa, Glycine max
  Coding DNA Sequence Number=SeqID_38963
VLKDGCKERLGSRPVGRHPLPSPGQTESAAAKQPSIL

SEQ ID NO: 130649 - protein, 100 aa, Glycine max
  Coding DNA Sequence Number=SeqID_38964
MTRGNPSDLQPFDPEIDRTFHRLVRHSVHPGHSVHCEHSEHSIEGDSEYSDFEQSTTNFYTENMAQPPPRERTLREMATPDFTSLLHVYHGNNVGHPLYP

SEQ ID NO: 130650 - protein, 196 aa, Glycine max
  Coding DNA Sequence Number=SeqID_38965
  Gene Ontology: Mol. function=motor activity; Cellular component=cell projection
  Homolog annotation: Hit_ID=UPI00016621D1; Match level="QueryCoverage =95%, HitCoverage=40%, E-value=1e-16, Identity=36%"; Hit description =UPI00016621D1 related cluster
MTDPLDESISYFLIRVNTWVLVPITFRGLHAFTFRGLHVLAIRGLHTLTFRGLHVLTFRGLHALAFVGLRALTFRGLHVLTFRGQHVLALTFRGLHVLTFRRLHVLAFKGQHVLALAFVGLHALTFRGLHVLTFRGLHVLAFRGQHILAFAFVGLHALTFRGLHVLAFRGLHVLTFSGLHALAFRGLHVLHFRGLH

SEQ ID NO: 130651 - protein, 62 aa, Glycine max
  Coding DNA Sequence Number=SeqID_38966
MGMTFSARFHINMNVKAKCKSLIGQKMLGSMSWMPGEVWLIVLPNNSSMNALRSLKSLVYLG

SEQ ID NO: 130652 - protein, 325 aa, Glycine max
  Coding DNA Sequence Number=SeqID_38967
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=99%, HitCoverage=52%, E-value=2e-28, Identity=29%"; Hit description=CTV.20
MALKICQDDKIQRQLAKEQAQTKRDLGSFCEKFGLLACPKQKKKQNSRKEIHENKPVHKKRFPRRRFSHKSSTKTSEEETETETSSSTLFDENLNKVQQDDQPSSTDDERQINTLTREQDLLFEAINSIPDPQEKKVFMEKLKKNLKTKPRQKDFITNNKFDVSNIFKRLENTSAKPTTIQDLQTEINNLKIEVKELRQQQEIHQIILSQLDESSDSESREKDVENETENPEDEMFMGLINKIKIQKFYIKIKIIINDFILDTMALFDTGADSNCILKGLIFTKFFEKTSEKLSTASGSKLKINYKLSNAIIENQGLRINTNFLL

SEQ ID NO: 130653 - protein, 99 aa, Glycine max
  Coding DNA Sequence Number=SeqID_38968
MVPNAWLTKKRCFFGNLKFIITFAMHSLSMLNSFISVKCCQIIGAIEIAIPWVMGLNQAHAFMKKVHEVKLKYGSNHLAKIGAKDGSGYIIAPSTAKHI

SEQ ID NO: 130654 - protein, 179 aa, Glycine max
  Coding DNA Sequence Number=SeqID_38969
  Homolog annotation: Hit_ID=A1IW39; Match level="QueryCoverage=38%, HitCoverage=98%, E-value=2e-17, Identity=69%"; Hit description =Putative uncharacterized protein ophh-69
MNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGVAVTRPGRLFTKNTGLRKVVRPCMGADACPVPEGEPTTEAPVNGGRNYNGPKVAKFLV

SEQ ID NO: 130655 - protein, 68 aa, Glycine max
  Coding DNA Sequence Number=SeqID_38970
MICPLRCHEKMHDAIKEQAKVSLLCVGFIPESQLKSKISHSLIHMGFIGLVAWSGKTNMLWLEGGSKG

SEQ ID NO: 130656 - protein, 229 aa, Glycine max
  Coding DNA Sequence Number=SeqID_38971
  Homolog annotation: Hit_ID=UPI00006A2D9E; Match level="QueryCoverage =75%, HitCoverage=86%, E-value=3e-08, Identity=15%"; Hit description =UPI00006A2D9E related cluster
GLHVLAFRGLHVLTIRGLHALTSRGLHILALRGLLALALGLHALTFRGLHVLAFRGLHVLTIRGLHALTSRGLHVLALRGLHVLTIRGLHALTSRGLHVLALRGLLALALGLHALTFKGPHVLTFRGLHALAIRGLHVLTFVGLHALTFRGLHVLANRGLHAFTFRGLHVLANRGLHALTLRGLHALTSRGLYILALRGLHALTFRGLRVLIFSVLHIRTLREFKVLYP

SEQ ID NO: 130657 - protein, 87 aa, Glycine max
  Coding DNA Sequence Number=SeqID_38972
MVKKGRGGSCLHPKLSPLIQKTKAHGIPWFSSLRSPFLRVFDSILHYYSSPTGSGLRHNLYSEKIGHATLPPFPCYSCLNVRPPSAR

SEQ ID NO: 130658 - protein, 102 aa, Glycine max
  Coding DNA Sequence Number=SeqID_38973
  Homolog annotation: Hit_ID=A2Q517; Match level="QueryCoverage=64%, HitCoverage=20%, E-value=1e-07, Identity=33%"; Hit description =Putative uncharacterized protein
MDWWLKDKGFQQLVQRQWGNYHPPGWGGYVRNHKIKLLKQCIKQWSLTNGEANARKVIMIKKELNALENGLKMQLSFISKTDFWRNVLTGQHWMVFSSPLWI

SEQ ID NO: 130659 - protein, 144 aa, Glycine max
  Coding DNA Sequence Number=SeqID_38974
MLGFTRDSPQISASPPQLDFAPYASRSYSAQWNVPGLLHDKHTLRSSRILGEMEVDETWLGLWLPLSYQVDMGASQHRTPEFWVNSAGFFAAKFISWLVFGMTFVDDWVVGNEKLHPIRSHYTDTAKRRQPLGPSKNGLGKVPS

SEQ ID NO: 130660 - protein, 220 aa, Glycine max
  Coding DNA Sequence Number=SeqID_38975
  Homolog annotation: Hit_ID=Q2HW90; Match level="QueryCoverage=67%, HitCoverage=27%, E-value=8e-17, Identity=36%"; Hit description =Putative uncharacterized protein
MDILTLLIFGVVLFPNVEGLVDQATIDAFHAFYDRKESPIVAILADLYDTFGRRCEKNSARIVCCTPALYVWLVSHLFRQEVRHICLLEGHHSCTKKKEANWDKLLASKEGVSVNWFPRWKEGRTGILISCGEFPNVPLMGTSGCINYNPVCHTLISSGDHLLGGMQPLLDHFESKGSVNAQSVKFRNIPEAKEGTVAGVQIAIRPTWAFQDVPTEGGAF

SEQ ID NO: 130661 - protein, 87 aa, Glycine max
  Coding DNA Sequence Number=SeqID_38976
  Subcellular localization annotation: CTP_CleavageSite=40; ConfidenceScore=5.22e-01
MFFSVKNTIFALSSSPNATQTLTPPFPPPTTIGGRHEPLLLAAKPPHQEEHFNWSRILLKDSVEKIPPILHFKASLRYCNRVFLHFL

SEQ ID NO: 130662 - protein, 56 aa, Glycine max
  Coding DNA Sequence Number=SeqID_38977
MLYGPTGSLTEHLSEYLPIGWFLGCNMTFDEVSMEWKLQLQELEEIRLEAYENSKI

SEQ ID NO: 130663 - protein, 76 aa, Glycine max
  Coding DNA Sequence Number=SeqID_38978
MAKFDPKVVLEFYANAWPIEEGVRDMRSWVRGRPAVRVQPEEEQGRQVRRGGHCPAVMHTRPGFRPDRCREAGADC

SEQ ID NO: 130664 - protein, 184 aa, Glycine max
  Coding DNA Sequence Number=SeqID_38979
  Homolog annotation: Hit_ID=Q6WAY6; Match level="QueryCoverage=54%, HitCoverage=18%, E-value=2e-11, Identity=37%"; Hit description =Putative uncharacterized protein
AIDAFLAYHHSKDSPVVAILVDLFDTFDRRCEKNNALIDQYLAGIGGSTINWFPRWKEGKEGVLFSCGDYPNVPLIGIRGCINYNPALAIRQLGYPMRGAPTEESLSPFLVRDFGVQSLKVVQRVHKAWKSPLRKEKEVRGIRNGIIGGYHEWLRVHTRGLDWLSKLKVINEENFEAQEEDEEV

SEQ ID NO: 130665 - protein, 70 aa, Glycine max
  Coding DNA Sequence Number=SeqID_38980
PSLVDLWPNLLGVFYPMPLRGRFASGTSWRCSDTGSKGEQRGLGEDHIREYIAKASRKKELLPSVNQEAL

SEQ ID NO: 130666 - protein, 143 aa, Glycine max
  Coding DNA Sequence Number=SeqID_38981
MHRSPTGTLVPLDLEIEATLRRNRAERRKKLLQDRIVASILEEETHFSNSSSPDSPSSRESTNQLSETATMADEHDQRTTLEDYSSSSDYLMKIPMHTWQHLLRFTTLLRYPVYQMYQERPRGGSTHSKVTVLKPGKKLWKSS

SEQ ID NO: 130667 - protein, 141 aa, Glycine max
  Coding DNA Sequence Number=SeqID_38982
  Homolog annotation: Hit_ID=A5BTR2; Match level="QueryCoverage=100%, HitCoverage=11%, E-value=6e-24, Identity=38%"; Hit description =Putative uncharacterized protein
  Pfam annotation: Domain name=zf-CCHC; Domain location=87-104; Score =10.9; E_value=0.034; Accession=PF00098.14; Description=Zinc knuckle
MKFSSLRLTNVKGVHEYIIHIRDISAQLKKLEVDMFESFLEEERLVMEMGESALLTTACGKNKAAKSQANQKGNGKIPPQADIKKVTKYFFCKKKGHMKKNCPRFQKWLEKKDKSISWGMQNLRKPVGSEQSILSGNKLGS

SEQ ID NO: 130668 - protein, 81 aa, Glycine max
  Coding DNA Sequence Number=SeqID_38983
MVIDQSLFYELTQLSSDGVPFEGALDDDWKFDFSMHDARRLVCTNQANMTGRLLAGSLALESRILHYLIVRILLPRSSNLA

SEQ ID NO: 130669 - protein, 317 aa, Glycine max
  Coding DNA Sequence Number=SeqID_38984
KVELYHTELDDFKAELERCNFHKCLTLLANGSIDLALVKECYANLYNSEDCPPKQSRVKGHLVKIDANSLNTFLETPVVLVEGETLPAYSRYCRLPTYFREIEASLCIPGRGFILNSEGQLGKILKKNLTTLAQVWSVLSYSNMAPISHTSDLTVDRARLIFGLVSHLDMNIGALISDQMTSTAQSNTSRLGFPALITVLCRARWVVSDSITFKCLSPIINLVYIRKNCWNPEDLAVSIRGARRARARPAELPSTSAAPTPASTSATPSVPAQTNSQHFEAMLQSIHQGQIIFVGPCGLNNLKRDKLRMQKKQQQSI

SEQ ID NO: 130670 - protein, 550 aa, Glycine max
  Coding DNA Sequence Number=SeqID_38985
  Gene Ontology: Mol. function=oxidoreductase activity; Cellular component=cytoplasm; Biological process=aromatic compound metabolic process
  Homolog annotation: Hit_ID=A7FE85; Match level="QueryCoverage=46%, HitCoverage=98%, E-value=1e-112, Identity=75%"; Hit description =Extradiol ring-cleavage dioxygenase family protein
  Pfam annotation: Domain name=LigB; Domain location=5-259; Score =298.1; E_value=1.7e-86; Accession=PF02900.9; Description=Catalytic LigB subunit of aromatic ring-opening dioxygenase
MTRMPALFLGHGSPMNVLEDNRYTRVWQQLGETLPRPRAILAISAHWYTRGTAVTAMSNPRTIHDFGGFPQALFDVRYPAPGSPALAQRVIDLLAPVAVQADQQWGFDHGSWGVLAKMYPQADIPLIQLSIDGTQPAAWHFALGRKLAALRDEGVMLVASGNVVHNLRMIRWQGAESAYPWAESFNQFVRDNLDYEGEAVQHPLVNYQQHEGAQLANPTPEHYLPLLYILGARAEGEAVSIPVEGMEMGSISMLSVQILGDQRTIFAQTDTGRLIVNQPAANQRVAVAKFRQRPELLDDHALFAIGAVGARDFLTVFHDSDIGTFAGKQRFHHIFFHLRRAGIIGKPGGQQPAHAGIGQLGREHLAQHEFPRIELEQVADHLIVLIGKLTFFAQPDLINVEKFTRQTGFSGAILQILYRGAILFRIATAGKVQPVKTVLLVQRGEARNQLLLQAVELIAALRQVAGVELILQPDPLEKRRFVQRGWRIGVVLQQLDLACAIPRQIEAGGRFQLFNLRQSKLVISVFAPVGFAIHGVKLKAVLGRLFSPVR

SEQ ID NO: 130671 - protein, 77 aa, Glycine max
  Coding DNA Sequence Number=SeqID_38986
MMTTKDDDKSDEQKAQVNQRTSQENQEQVKSSRRKPTKKNQDSRFKISRIKIKIQESRIKTQDLKNQDQDSRLKIQE

SEQ ID NO: 130672 - protein, 110 aa, Glycine max
  Coding DNA Sequence Number=SeqID_38987
MAGIFFLLKQQNNSENYERPRIFFINGLLCFLEDEWQRNGERKRERRRHFKEKMSLEEAHHHRRPWIRAWRKKEMNEGRGREEHEILCSKRALKSEVNIQMIKVEKNAHT

SEQ ID NO: 130673 - protein, 144 aa, Glycine max
  Coding DNA Sequence Number=SeqID_38988
MGLKQVPRGFMGQKQRSQALKGRKGRVKGGKYDIRGQVEGLSKYREKLNLAASHEQRLEDEHAKVLAPHMERKARERVIELLHREAMKWMDRFTLTLNGSQELPRLLARAKSMANVYSAPEEVHGLFDYCHHMIELMSHKIRNH

SEQ ID NO: 130674 - protein, 52 aa, Glycine max
  Coding DNA Sequence Number=SeqID_38989
MAEQAKQAFDVQDPCDERWQMAKPPNSPPPPPPTGAPSQSPSTLKQTRKPHD

SEQ ID NO: 130675 - protein, 119 aa, Glycine max
  Coding DNA Sequence Number=SeqID_38990
  Subcellular localization annotation: CTP_CleavageSite=48; ConfidenceScore=5.15e-01
MLRKLTDCATTLPFDFRHVTEFHGLRNNASFRFLACLGTSRIVQQRVPSTSKQSIKGCMPSNNSPQTKLGYDKADTVIAQEDVASPEPFPQAEPSPFPSPKPKLSAPTPVPNQSTSQDP

SEQ ID NO: 130676 - protein, 64 aa, Glycine max
  Coding DNA Sequence Number=SeqID_38991
MGNARFLEEVEFGKEENIKNVVFEEEPGIYSDQVLIPLTVQDTAPVIDDNVQTIDIVPEQDNNQ

SEQ ID NO: 130677 - protein, 141 aa, Glycine max
  Coding DNA Sequence Number=SeqID_38992
MGEVEEVQEQIKANMKAMKEKMATMMEAMMSMRKIMEANTVTVAATSAVAKVNSMPPSGLKQMNHPTSDMVGKDLGSTDDPMMCKYKTSMPSHHMACLPTIRHPMWHTLPMRMSITPLLYPLRAKNPELSCTCLLNRGGDT

SEQ ID NO: 130678 - protein, 94 aa, Glycine max
  Coding DNA Sequence Number=SeqID_38993
MFAGMKILMTNTSTPYHKGGMMNASGHVYAMHDKCVYLRTQDLGRPSLLTHNALGIMVHLQTLPWCPMHATKKVMQTFQLLMTKMMKTNARHEQ

SEQ ID NO: 130679 - protein, 178 aa, Glycine max
  Coding DNA Sequence Number=SeqID_38994
  Homolog annotation: Hit_ID=A5B939; Match level="QueryCoverage=24%, HitCoverage=28%, E-value=2e-10, Identity=70%"; Hit description =Putative uncharacterized protein
TGEARLIALCARTPKGNRPAHPGNGSAGGRVQRLEEHRTSRASGRWNNVGKGSRQNGSVTSGKGLALRAGHGGPSPEPVGCRWTARASAARAGRRVPVGGRIGNGPFGASSPGVEQSTQNCALNVKVKKIQPKRGETTAKGTGLAESAGKEDPVCGALPLFLDPRSASAGRSGRKTLS

SEQ ID NO: 130680 - protein, 15 aa, Glycine max
  Coding DNA Sequence Number=SeqID_38995
PLVSQEEMGNMLNII

SEQ ID NO: 130681 - protein, 151 aa, Glycine max
  Coding DNA Sequence Number=SeqID_38996
MTSRDQVWSFCTLVSSRGGGPDDTRRYLTVIRTLLSSRGGGPDDKQRPSLAAGPMTSRDQIWSFCTLVSSRGGGPDDTRKYPSGYPYKYSFAICKTERLIACDTRKYLTVIRTLVSSRGGGPDDTRKYPSGYPYKYSFAICKTERLIACRG

SEQ ID NO: 130682 - protein, 69 aa, Glycine max
  Coding DNA Sequence Number=SeqID_38997
MGRREAHHGYIDEIEKFGLGQNRGGSCHSYVPRQLCSPRGRAYVVAFFKGESSHFFTWKEESWKARRSG

SEQ ID NO: 130683 - protein, 158 aa, Glycine max
  Coding DNA Sequence Number=SeqID_38998
  Homolog annotation: Hit_ID=UPI00016621D1; Match level="QueryCoverage =83%, HitCoverage=37%, E-value=8e-08, Identity=33%"; Hit description =UPI00016621D1 related cluster
MTGPLDESISCFLIRVDPWVLVPIAFRGLHVLDFAGLHVLALRGLHVLALRGLHVLAFRGLHVLALRGMRVLALRGGLHVLALRGVHVLAFRGLHVLTFRGFHVLAFRGLHILAFRGLHVLTFRRLHTLIVRGLHALAFRGVYVLAFRGFHVLAFRGL

SEQ ID NO: 130684 - protein, 197 aa, Glycine max
  Coding DNA Sequence Number=SeqID_38999
MSVHVAQVIADAIYLFAGMPPTRHPLDPDKSNRALGFPGLITGLCQSFGVPVTPSKVIRPPITRAFIEKYCTPRQAQGDAHQAADALPPPHQTDPVGSLGMERYLQHLVRQQAANHWGQVQIHECLYRFSLSQQGQGFAPFACPTPKQFGAEVAWPGDWPEAQAGEEPAGSPGEAEEARMDEEMTDLLGFLGGSGAT

SEQ ID NO: 130685 - protein, 223 aa, Glycine max
  Coding DNA Sequence Number=SeqID_39000
  Gene Ontology: Mol. function=aspartic-type endopeptidase activity; Biological process=proteolysis
  Homolog annotation: Hit_ID=A5BDA4; Match level="QueryCoverage=89%, HitCoverage=31%, E-value=2e-37, Identity=37%"; Hit description =Putative uncharacterized protein
MVTISTSNLINVINEDIDQNSKNATEIGSVSEKNINPINSKHRKKPSKLYYQRPTVPNLLLEERSENNFKSFSANNIYEWNIDAQMEYNIMNTLQHMTMVATAYQTSHECSEETIIDILVVGFSGQLKVKTDLNGKVITNDEDKEIPNAVNTLIFTIAQHFIGDPSLWKDRSAKLLSNLKCRTLADFRWYRDTFLTRIYTRDTLGEPHTCVHNHCMFSSLGDQ

SEQ ID NO: 130686 - protein, 209 aa, Glycine max
  Coding DNA Sequence Number=SeqID_39001
STLEDPTGFAVQALGRLVGQEYAAVAPRHVADAVAGQAVVVLNDGGVLQADAAAQVPVAREPSGGRQLDAARALLAGQQHEGRIDRVGGATVVEFQLVQRQRGAQLPVEPIALDAHFVLARVFGVDVVGVAARVRRDADQAAAHGREGLAVRGVEGMVAQRRPHHPGARAHATAVAAGREVEHAIGRIDAEAVHAQAQQHLPGVVQLDL

SEQ ID NO: 130687 - protein, 49 aa, Glycine max
  Coding DNA Sequence Number=SeqID_39002
MGAKYLEVVKRGSHPNNGWSPDKIRERCPCSYVSSSAMRNSDLHSSLKA

SEQ ID NO: 130688 - protein, 78 aa, Glycine max
  Coding DNA Sequence Number=SeqID_39003
MSGFTRNSPQISASPHQLDLAPYASGSCNAQWNAPGLLHDKHTLRSSRILRKMEVEEHWLGLWLPLNYCSGYGIKFSI

SEQ ID NO: 130689 - protein, 119 aa, Glycine max
  Coding DNA Sequence Number=SeqID_39004
DGLSLCGLDFVMDFTKIVEISSGLLEYWTEARVVAEPPIPLKIIEATRSNMEWILPTPTPYRLVEPVQVIEVSSSEEDPEEDPEELPPEPVVDALDLSKDDEDPLLDVDFPEDIMSASE

SEQ ID NO: 130690 - protein, 69 aa, Glycine max
  Coding DNA Sequence Number=SeqID_39005
MSNLSMRVYFYGTLCNARSDDYKCPRDRRSNTWDPTIDLSKKNQDRRKGYEHLVNPEVVERPLRQVWGL

SEQ ID NO: 130691 - protein, 138 aa, Glycine max
  Coding DNA Sequence Number=SeqID_39006
  Homolog annotation: Hit_ID=A5BZR5; Match level="QueryCoverage=50%, HitCoverage=43%, E-value=1e-08, Identity=36%"; Hit description =Putative uncharacterized protein
MATGNTTIEKPRDQWSEEEKRLVQYNLKVKNIITFALGINEYFRVSNCKHAKDIWDTLQVIHEGATDEHEMELKRLNQHEENDKKKKGIALKASSSIQEESDKEDLIEIYEDDDLSLFVKIFNKFLRVRGNQRRSNFK

SEQ ID NO: 130692 - protein, 128 aa, Glycine max
  Coding DNA Sequence Number=SeqID_39007
MARTRGLGRAIDRLIGRDRQDDHDAVDVPERRRLTASAHRQRVHQMTVDAPDMAADVPDMTEDVPDMAEDAPEMTVDIQGDDGAEGSHADDAEGFLGGPRDPSVLTSFADHVAHAVWSGQWRFLPSAK

SEQ ID NO: 130693 - protein, 107 aa, Glycine max
  Coding DNA Sequence Number=SeqID_39008
GGGCCPARPGELGCFHQKALPSVGTSWKAQNFTDCALTLPFDSRHVAKLHGLPNNGCQVPQSGQAKGSDWRPFVHAHDSSAFSRFGAFCIALSCLLLFYLDGYNLPG

SEQ ID NO: 130694 - protein, 75 aa, Glycine max
  Coding DNA Sequence Number=SeqID_39009
MFKIESRTIQGSRGNLISRIKNQDSRFKLPRIKIKIQDSRIKRRINQDKYEKVFRKLSSTWIFLKTCLPKSFYSQ

SEQ ID NO: 130695 - protein, 110 aa, Glycine max
  Coding DNA Sequence Number=SeqID_39010
  Homolog annotation: Hit_ID=O69421; Match level="QueryCoverage=25%, HitCoverage=29%, E-value=4e-08, Identity=100%"; Hit description=InsA protein
  Pfam annotation: Domain name=Ins_element1; Domain location=3-59; Score=-15.4; E_value=0.004; Accession=PF03811.4; Description =Insertion element protein
  Subcellular localization annotation: CTP_CleavageSite=32; ConfidenceScore=5.81e-01
APVASVSISCPSCSATDGVVRNGKSTAGTSALASVAVTLRVTTTPAALNAPLQGASHSPFRLRNCWKGRSVRPSSLLRQLAKGGCAARRLSWVTPGFSQSRRCKTTASEL

SEQ ID NO: 130696 - protein, 185 aa, Glycine max
  Coding DNA Sequence Number=SeqID_39011
  Subcellular localization annotation: CTP_CleavageSite=51; ConfidenceScore=5.10e-01
MNLTITHRLISYSQDDFLFSLSSLPVFSQQKLSKLSGTWTFLSLEISKHAKASRIAQTPSPFLISGLNRWPCWFLCALMLFDLALVFSLSGWTQAVRLAGLALAQQTCTTHPSSRFFLVLNQRSVVLSEWLAKRKDWLSERMKINTSQTCLINLKLRGNDYYTHKMGVLRIDYLSLKKSNCNTTK

SEQ ID NO: 130697 - protein, 134 aa, Glycine max
  Coding DNA Sequence Number=SeqID_39012
  Homolog annotation: Hit_ID=A5C922; Match level="QueryCoverage=76%, HitCoverage=35%, E-value=2e-09, Identity=34%"; Hit description =Putative uncharacterized protein
  Pfam annotation: Domain name=Retrotrans_gag; Domain location=52-123; Score=-0.6; E_value=0.061; Accession=PF03732.8; Description =Retrotransposon gag protein
MAQPPPRERTLREMAAPDFTYESLCIQYPDEDVPYVLKTGLIHLLPKFHGLAGLSSFFRGSGKDWLYYLAPRSITSWDDLKRVFLEKNFLASRTTTIRKDISGIRQLSGESLSYPNFVRGLLLDDMRPLFGPCK

SEQ ID NO: 130698 - protein, 102 aa, Glycine max
  Coding DNA Sequence Number=SeqID_39013
MVTMDKWMNIMDMRYAIASRYNVIVVSLSRQQNMMSYPNFVWGPLFGGMQPSLDHLEQFESRPFRNILEVGLLKEEATGRQAPPRFLKNGFLGFRKISENLG

SEQ ID NO: 130699 - protein, 82 aa, Glycine max
  Coding DNA Sequence Number=SeqID_39014
  Subcellular localization annotation: CTP_CleavageSite=34; ConfidenceScore=5.14e-01
MASVATYPSAGGRRGVHGCVFQGRKMRGVATNVYSRKTSEKPERCGLRTLIVKGSGVVFTHGEGCFPCSYVFLNYDKGIRST

SEQ ID NO: 130700 - protein, 121 aa, Glycine max
  Coding DNA Sequence Number=SeqID_39015
MAGRRARFEFAHHGGRPYFPNLCLPYLRLDDSLMPDGDVGFTLATTLVAAIATALASIIFFMLIMASIIAAICSFIAYMSAFTFSCTSSALPITLALAQKWVYDPNMVGSWYLTHATKNAS

SEQ ID NO: 130701 - protein, 82 aa, Glycine max
  Coding DNA Sequence Number=SeqID_39016
MCDRRHPVMTSFLNLDRSSFLADVGLHSFRSVRLKAQVEKDEDPSGEGQSPQVRRMKAQVEKDEDPEAETLSRQLIVAEGPN

SEQ ID NO: 130702 - protein, 65 aa, Glycine max
  Coding DNA Sequence Number=SeqID_39017
MTKLGLCLSSGPPPLDDKRVRITIRMTKLGLCVPPDTTVSEWQRGADNRKNDQTWSLRATGHDCV

SEQ ID NO: 130703 - protein, 317 aa, Glycine max
  Coding DNA Sequence Number=SeqID_39018
  Gene Ontology: Mol. function=aspartic-type endopeptidase activity; Biological process=proteolysis
  Homolog annotation: Hit_ID=A5AWY3; Match level="QueryCoverage=98%, HitCoverage=72%, E-value=3e-43, Identity=36%"; Hit description =Putative uncharacterized protein
  Pfam annotation: Domain name=MP; Domain location=11-168; Score=6.0; E_ value=6.9e-05; Accession=PF01107.9; Description=Viral movement protein (MP)
MDDWNIPEIPQDQLYVPETIKDKHNFDYIIKIVENNIHLGQDIGEEFHLLSKNSIYEHSRKYKYLHIGCVQVAIKPLIDMGIDAAVLMCLRDIRHNKFEDSLIGIVETSLGQVSLMDRNILDSLFLNIHFHGLDMKEGSIPAALIYRIQYKVMNTCASRVLLKPQKGQTTLLITDMTKANVSLPRKIKWDEVTLPERWVMDKATLSVPRPAPTIENIKQDNSEKVEITFNRRNSFSSRIEASRSEYELARRSFSVRTRSIPVGLTRSESHNQFLTVNLQGLDTTSSIPRTTYNQEQEDDQKSIQSPTYSSMEPYDVI

SEQ ID NO: 130704 - protein, 127 aa, Glycine max
  Coding DNA Sequence Number=SeqID_39019
  Subcellular localization annotation: CTP_CleavageSite=40; ConfidenceScore=5.19e-01
MYPPLELIHKRCTLSYSKSTTQVDAPFTCITKNVPSNVLRQSSQVVSPSKLCEWGNKRILRREKRDTKRIQAVSPLANSFWQREKRDKIIADKSFSLEKEKNQKTLGQAFWHNEEEEVQRDSGLVKD

SEQ ID NO: 130705 - protein, 169 aa, Glycine max
  Coding DNA Sequence Number=SeqID_39020
MTQELVARGDTLRLSAPRHSVTPSVIDEQRPIWSSAPFAEMSSFSDGDFSSLISYPELQAAGPMIRGDTLRLSAPFCHPEAAGPMIRGDTLRLSAPFCHPEAAGPMTSRDKIWSFCTLVSSRGGGPDDARRYLTVIRTLLSSRGGGPDDKQRQNLVILHPCVIQRRRAR

SEQ ID NO: 130706 - protein, 77 aa, Glycine max
  Coding DNA Sequence Number=SeqID_39021
MKMMCFLTTNDEVAKTKRVMDSVASKHFCRDREMFDTLKIDGEFSHFKLGNGGKMKVEGRGSVKTKLHDGDIQTFSM

SEQ ID NO: 130707 - protein, 78 aa, Glycine max
  Coding DNA Sequence Number=SeqID_39022
MRDGKRSLYVIGIGVNSEVGLGGMFLIALEPAPKWALPAGRVGVGAGAWGVSLWMGAGALGCTGAELEESPARAEKLG

SEQ ID NO: 130708 - protein, 70 aa, Glycine max
  Coding DNA Sequence Number=SeqID_39023
MCLPREGEYADEIFLITTNEILELNISFLNDHLEETLGSTKIEENHSKCINLTQILSGPKTFMHVSSIFF

SEQ ID NO: 130709 - protein, 284 aa, Glycine max
  Coding DNA Sequence Number=SeqID_39024
MASRKRKSIGTRPTSQYDTRRKVEIYHTKLDEFKAELERRNFHKCLTNLVDSSIDVALVKEFYANLYSSEGPSPKQVRVRGHVVKIDVDSLNTFLETPVVLAEGETLPAYSRYCRLPADIREIEVALCIPGRGVLSYSNLAPTSHTSDLTVDRARMIFSLVSQMDMNVGALISDQITSMAQPNSSRLGFKRLSPVINLAYIRKNYWNPDDLTVTIRGARRARTRPVEASSTSTTPPLARSLAAPSASALADFQCFEAMLQSIHQEQIILLQSLQMMAPPDSIPS

SEQ ID NO: 130710 - protein, 94 aa, Glycine max
  Coding DNA Sequence Number=SeqID_39025
MEDSIGKITKITFPSQEGPHLTVKNTLENGGFNRENNKDHISQSRGSALDGEGHMNSARQSIHGAPNKRREWRIALGNHYAWLQTRWWRNQTGK

SEQ ID NO: 130711 - protein, 29 aa, Glycine max
  Coding DNA Sequence Number=SeqID_39026
MAHQGPIRAILQQQQQQQQQQQQQQQQQQ

SEQ ID NO: 130712 - protein, 59 aa, Glycine max
  Coding DNA Sequence Number=SeqID_39027
MERENRIAGRQYKMEASIPSSLSRLRTLSEQLEKKIEESQELARDAAIAVERHVSPLRE

SEQ ID NO: 130713 - protein, 22 aa, Glycine max
  Coding DNA Sequence Number=SeqID_39028
MSFPTFSFGQTESVVARQPSIL

SEQ ID NO: 130714 - protein, 128 aa, Glycine max
  Coding DNA Sequence Number=SeqID_39029
MTKSKGKDPLEELGGPMTRARARKAKEALQQVLSILFEYKPKFQGENSKVVSGPLLKSAVKLLYKLNHFINKHKLSFIQKIRVYLFYLSESDSPKFLSDSPKFLSDSRTPWLYQRTFTTFVCCPRRKE

SEQ ID NO: 130715 - protein, 74 aa, Glycine max
  Coding DNA Sequence Number=SeqID_39030
MQSQGFAPFSCPTPDQFRAEVAWPGDWPEAQAGEAPPEAPGDGEEAHEDEEMADLLDFLGGSGDTAYILFRSLR

SEQ ID NO: 130716 - protein, 92 aa, Glycine max
  Coding DNA Sequence Number=SeqID_39031
  Pfam annotation: Domain name=zf-CCHC; Domain location=20-37; Score =34.2; E_value=4.8e-07; Accession=PF00098.14; Description=Zinc knuckle
MERCHNFNNGKRSQEVSPTPKCYKCNQPGHIKANCPSNETWPEKNEKKSYKERRSKKAYIAWDDNDSSDGSEKEINLLSKDYESDENISQEV

SEQ ID NO: 130717 - protein, 215 aa, Glycine max
  Coding DNA Sequence Number=SeqID_39032
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=47%, E-value=5e-76, Identity=51%"; Hit description =Photosystem I P700 chlorophyll a apoprotein A1
  Pfam annotation: Domain name=PsaA_PsaB; Domain location=1-215; Score=- 297.5; E_value=0.054; Accession=PF00223.10; Description=Photosystem I psaApsaB protein
GMYFHGARFSNYEAWLSDPTHIRPSAQIWRASGITSELQLYCTAIGALVFAALMRGSWGWDLFLGQDIKYMYLPPINQFLNAAVDPKEIPLPHEFILNRDLLAQLYPSFAEGATPFFTLNWSKYAEFLTFRGGLDPVTGAHHMYSMPPYPYLATDYGTQLSLFTHHMWIGGFLIVGAAAHAAIFMVRDYDPTIRYNDLLDRVLRHRDAIISHLNW

SEQ ID NO: 130718 - protein, 83 aa, Glycine max
  Coding DNA Sequence Number=SeqID_39033
MGDQEETQEQMKADMSALKEQMASMMEVMLGMRQLMEKNMATAAAVSSAAEADPTLLATPHHPPPNTIGRGRSTLGHNRDDLS

SEQ ID NO: 130719 - protein, 87 aa, Glycine max
  Coding DNA Sequence Number=SeqID_39034
MSLEQTNQWLAPTFQRKQRCNYERMRDNDCKDSTSDSPQISASPYHLDFAPYALGSYSAQWNALGPLHDMHMLRSSRILGKMEVEET

SEQ ID NO: 130720 - protein, 155 aa, Glycine max
  Coding DNA Sequence Number=SeqID_39035
  Homolog annotation: Hit_ID=Q6WAY6; Match level="QueryCoverage=83%, HitCoverage=23%, E-value=1e-14, Identity=33%"; Hit description =Putative uncharacterized protein
MAEVSIEAIASLAQYYDQPLRCFTFGDFQLSPMVEEFEEILGCPLSGKKPYLFLGFYPSLARISKIVQILAKELDHRKQVENGVVGVPRRCLEAKARILAGRGEWAPFIDILTLLIFGGVLFPNVDGLVDLATSNAFLAYHDRKESLVVAILADL

SEQ ID NO: 130721 - protein, 172 aa, Glycine max
  Coding DNA Sequence Number=SeqID_39036
  Gene Ontology: Mol. function=transferase activity, transferring glycosyl groups; Biological process=metabolic process
  Homolog annotation: Hit_ID=Q2HT79; Match level="QueryCoverage=40%, HitCoverage=15%, E-value=3e-22, Identity=73%"; Hit description=UDP -glucuronosyl/UDP-glucosyltransferase
MTNANCLQESLHSVSNGNLRYICKEWEIGIEIDTNVKREEVEKLVNDFMAGEKGNKMRQKIVELKKKAEEATTPSGCSFMNLDFIKERNLVYLAAIADSQPQPSPLAGQPFSVLQQQQGMHNQLGMSSSGSQGLHMLQSEATNVGGNVTIGTGGGFPDFVRIGSGKQDIESL

SEQ ID NO: 130722 - protein, 60 aa, Glycine max
  Coding DNA Sequence Number=SeqID_39037
MKAYYDKKLQRKEFQPGQQVLLFNSRLRLFPVELVDPREENFEKKWIVNGQRLKVYNGGH

SEQ ID NO: 130723 - protein, 334 aa, Glycine max
  Coding DNA Sequence Number=SeqID_39038
  Subcellular localization annotation: CTP_CleavageSite=14; ConfidenceScore=5.27e-01
MAKPSKKRKGTSSRSQRHSGSQETPIPSSIPFGSLFSSEEQRIRYTNLFSSRSIIDPKFIYMDFFSNESFKCFQAFENSNLIPFMSLKLLVYSDLVKVFYSNLEIQEDNLMSEVYGIKMLDFSVHDARRLVCTNQADMTERLHAGSLAFESCILHYLIVLIFLPRSSNLAQALRLNAPLPYPHLVTLFLQHFNIPLDSEPYVPIKRSFFIGASVITILPRKGIGILPSFLSKAHLGGEAPSSIAYSLPHKQASIKKGARHVGEEGHDEEDSSLLSKILDRFDGLQTFVGERFDNLELQVDMRFNEMESRITKVEEDVSYIRSSFDLPPPLPPSS

SEQ ID NO: 130724 - protein, 152 aa, Glycine max
  Coding DNA Sequence Number=SeqID_39039
  Subcellular localization annotation: CTP_CleavageSite=58; ConfidenceScore=5.40e-01
MDKSSTTTTPVPPFQNAAGPSKPYVPPPIQQQQSQQRQQATEALPQPSLEELNPKNVSAITLGSGNQIQVPPPVAAPAPEPVKLHSTPEKEDEIVAQKRKLPNKKFYASGTSSSNSDLPLNYRVDMGAWWCLALGARQASFVADLGMTFVDD

SEQ ID NO: 130725 - protein, 89 aa, Glycine max
  Coding DNA Sequence Number=SeqID_39040
MGDSTKVVIKQDMKGREHKYGFNNNEREKPEKKKVVDDETGDKHELDEKITLDDVNQFSFIMIILISMNVVNFFSDNITSDLSGQRTNI

SEQ ID NO: 130726 - protein, 106 aa, Glycine max
  Coding DNA Sequence Number=SeqID_39041
MELPKNYPTPLAKQPENSQADTRSITHVVYPRIQWHHLFLTTKDGEQKLIKARSSSTEKMSGSRHQRIFEENIRKTERGLRILKRRVRELFTHRKGISTPRARHKE

SEQ ID NO: 130727 - protein, 112 aa, Glycine max
  Coding DNA Sequence Number=SeqID_39042
KQAQGDAPQAADAPPPHQAGPAGSFDTERYLRHLVRQQAANHRAHSQGFTSFPCPTPDQFRAEVAWPGDWPEARAGEAPAEAPAEAPDEADEAREDKEMTDLLDFLGGSGAT

SEQ ID NO: 130728 - protein, 75 aa, Glycine max
  Coding DNA Sequence Number=SeqID_39043
  Subcellular localization annotation: CTP_CleavageSite=29; ConfidenceScore=5.25e-01
MYPLLFSLNLVDVPSVGTYPSTRGRRVTRGMRVPRKEYVRSRHQRLFEENVGKTGEDAIYELLSERLGSCIYARG

SEQ ID NO: 130729 - protein, 51 aa, Glycine max
  Coding DNA Sequence Number=SeqID_39044
  Gene Ontology: Mol. function=helicase activity
  Homolog annotation: Hit_ID=Q2A9E0; Match level="QueryCoverage=98%, HitCoverage=3%, E-value=1e-09, Identity=57%"; Hit description =Putative uncharacterized protein
MKLNQLMNDLTSGHVFGAIVGFVYTIEWQKRGLPHAHILIFLYPSNKYPNP

SEQ ID NO: 130730 - protein, 79 aa, Glycine max
  Coding DNA Sequence Number=SeqID_39045
  Subcellular localization annotation: CTP_CleavageSite=60; ConfidenceScore=5.05e-01
MKMEETLAQFMKVSMSNQNSTKSAIKNLEVQVGQLAMQLANRSSSSFTANIEKNPKEDCKATMTRSRMAIHVDESEAEK

SEQ ID NO: 130731 - protein, 78 aa, Glycine max
  Coding DNA Sequence Number=SeqID_39046
ITDLYVQYYRAGCQDIVSDIVDPAASLLHFFLAFKNSRFRAGCQDIVSDIVEDPATSLLPLTFILHLYIVQPDLYSLT

SEQ ID NO: 130732 - protein, 237 aa, Glycine max
  Coding DNA Sequence Number=SeqID_39047
  Gene Ontology: Mol. function=cation transmembrane transporter activity; Cellular component=integral to membrane; Biological process=potassium ion transport
  Homolog annotation: Hit_ID=A4TH20; Match level="QueryCoverage=100%, HitCoverage=51%, E-value=1e-110, Identity=89%"; Hit description=Trk system potassium uptake protein
  Pfam annotation: Domain name=ApbA; Domain location=14-154; Score= -32.6; E_value=0.1; Accession=PF02558.7; Description=Ketopantoate reductase PanEApbA
  Pfam annotation: Domain name=F420_oxidored; Domain location=13-203; Score=-38.4; E_value=0.0025; Accession=PF03807.8; Description=NADP oxidoreductase coenzyme F420-dependent
  Pfam annotation: Domain name=Shikimate_DH; Domain location=4-120; Score=-24.6; E_value=0.03; Accession=PF01488.11; Description =Shikimate  quinate 5-dehydrogenase
  Pfam annotation: Domain name=TrkA_C; Domain location=162-231; Score =57.2; E_value=5.7e-14; Accession=PF02080.12; Description=TrkA-C domain
  Pfam annotation: Domain name=TrkA_N; Domain location=14-129; Score =126.6; E_value=7.1e-35; Accession=PF02254.9; Description=TrkA-N domain
  Pfam module annotation: Pfam domain module=ApbA::F420_oxidored::Shikim ate_DH::TrkA_C::TrkA_N; Domain location=14-154::13-203::4-120::162 -231::14-129
MSELQRLEKPYKRIMIVGGGNVGAGLAAKLEKDYNVKLIERNQQRAAELAEQLHDTIVFYGDASDQELLAEEHVEQVDVFIAITNDDEANIMSAMLAKRMGAKKVMVLIQRRAYVDLVQGSVIDIAISPQQATISALLGHVRKADIVSVSSLRRGVAEAIEAIAHGDESTSKVVGRIVEDIKLPPGTTIGAIVRGDDVIIANGNSKIEQGDHVIMFITDKKFVPDVERLFQPSPFFL

SEQ ID NO: 130733 - protein, 107 aa, Glycine max
  Coding DNA Sequence Number=SeqID_39048
DKLAPVISRGFNKTNVETLQKVRKAWEVLQKKDKELRGSNNGPIGGYRKTAKREEVEAPEEDEEVQALRTELKQAQTVKERARREEHGRNKFRGALWGSVATYPSAG

SEQ ID NO: 130734 - protein, 100 aa, Glycine max
  Coding DNA Sequence Number=SeqID_39049
MSNVNVLGSAVLNRIFSNSTQVVTEQCHDFFFDIVILEQVLVPLVQGSPLWLDPLPLLIPLHWVKGGLQYLEWEDVGTSLSASGTKTFGVEDVGTSLSAS

SEQ ID NO: 130735 - protein, 151 aa, Glycine max
  Coding DNA Sequence Number=SeqID_39050
SLLLRKDLISEDIQTEFDIPEAYNVRTKKKILQTVGERWRQFKSDLMSKWELAADKDNVDDTVCEKYNISNEKWAQFCQSCRDPLWEDVRKKAQAIQKQNTVSHVLSCGGYEYLENKLMDEKRKKKLEEAAQSGSTDTVIDPPSPIRRHVK

SEQ ID NO: 130736 - protein, 165 aa, Glycine max
  Coding DNA Sequence Number=SeqID_39051
MERSMIDAASGGALGDMTPAEAKNLIEKMASNSQQFSARSDAIVIRGVHEVATNSSSSAETKKLEAYAANIYNRPPQPQQQNQPQQSNYDLSSNRLYVPPPIQQQQPQQPQKQQTVEAPPQPFLEEHVRQMTMQNMQFQQETRASIQSLTNQMRQLATQLNQQQS

SEQ ID NO: 130737 - protein, 38 aa, Glycine max
  Coding DNA Sequence Number=SeqID_39052
MGTYQKDNQVPGCVSKSQEIDYSTTGYMRKEANDSYPS

SEQ ID NO: 130738 - protein, 24 aa, Glycine max
  Coding DNA Sequence Number=SeqID_39053
MGIKCGIYGANSAEWIMSMQMLIC

SEQ ID NO: 130739 - protein, 95 aa, Glycine max
  Coding DNA Sequence Number=SeqID_39054
MPLRQQGVPRTSGAKEPSGLCIPIAFCARADDGAVPSPSDLLTYTSDMLEDSASSGRSSSTSAVNQPLPGEQAMPPALPVCIWKLLIGLCPTRVG

SEQ ID NO: 130740 - protein, 73 aa, Glycine max
  Coding DNA Sequence Number=SeqID_39055
  Gene Ontology: Mol. function=hydrolase activity, hydrolyzing O -glycosyl compounds; Biological process=carbohydrate metabolic process
  Homolog annotation: Hit_ID=A7P495; Match level="QueryCoverage=82%, HitCoverage=9%, E-value=4e-19, Identity=71%"; Hit description =Chromosome chr1 scaffold_5, whole genome shotgun sequence
MIDEWGRMLPDPERWPSSRGRRGFTDVANKVHSMGLKFGIHLMPGTSTQASNNNMPILDTTTVEILNYSYNIV

SEQ ID NO: 130741 - protein, 134 aa, Glycine max
  Coding DNA Sequence Number=SeqID_39056
MAPRKLASKRSRKDKTAKGTSSAPEYDSHRFRSIEHQQRFEAIKGWSFLRERRIQLRNDEYTDFQEEIVRRRWASLVTPMAKFDPDIVLEFYANAWPTEEGVRDMRSWVRGQWIPFDADAIGQLLGYPLVLEEG

SEQ ID NO: 130742 - protein, 405 aa, Glycine max
  Coding DNA Sequence Number=SeqID_39057
  Gene Ontology: Mol. function=helicase activity; Cellular component =nuclear chromosome, telomeric region; Biological process=viral genome replication
  Homolog annotation: Hit_ID=Q9LTU4; Match level="QueryCoverage=99%, HitCoverage=30%, E-value=1e-110, Identity=49%"; Hit description =Helicase-like protein
  Pfam annotation: Domain name=DUF889; Domain location=119-340; Score =305.4; E_value=1.1e-88; Accession=PF05970.5; Description=Eukaryotic protein of unknown function (DUF889)
FYFLYGYGGTNKAFVWTTLSSAICSNGGIVYIVASSGIASLLLLGGRTTHFKFVIPVPATQNSTCNIHQGSNLAELLKVTKLIVWDEAPMCHKFTFEALDKSLKDIIHNNLPFGGKVIVFGGDFRQILPIIPKGNRSDIFHATINASYIWGHCQILRLTKNMRLLSNVSGQPNNQELKQFSDCLLDIGGGKVGQADDGFSEITIPDEFLIKDYTDPIQAIVEATYPNLIHNYSNTELLAKKNSVDKSDELLNPAFGLLTPEFLNSLQTSGIPNHKLKLKVGTPIMLVRNLDQADGLCNGTRLIVTKLGSNVVETEVITGPNTGDRTYIPRMNMSPSDSLWPFKLIRRQFPFIFSYAMTINKSQGPSLEHVGLYLPHPIFSHGQLYVALSRVKSKKGLHILIHDNQ

SEQ ID NO: 130743 - protein, 68 aa, Glycine max
  Coding DNA Sequence Number=SeqID_39058
MGGELSNWGARRNLPQEASRRQAPPFFPIIGEGRGDCFKMFMTPKLCISAILGKKHVFVKKNRVEVLP

SEQ ID NO: 130744 - protein, 65 aa, Glycine max
  Coding DNA Sequence Number=SeqID_39059
MDPGCIVSVERHETQGADSISSEHFRPKKYYFPHHRTNKEEFCTSAHIELQKEPYQCWLGSYCCK

SEQ ID NO: 130745 - protein, 88 aa, Glycine max
  Coding DNA Sequence Number=SeqID_39060
  Subcellular localization annotation: CTP_CleavageSite=27; ConfidenceScore=5.47e-01
MARSVFARAPMNPGIGPFFTHMESPTVATYPSAGGRRVTRGMRVPRKEHARSRHQRLFEENVEKTGKDAIYELLSKRFGSCIYARGRY

SEQ ID NO: 130746 - protein, 58 aa, Glycine max
  Coding DNA Sequence Number=SeqID_39061
MACLDQQHSGKEGQAIVAAIVVVEDLPISDLDDSSNLDCIYCLKDHNYSAVHRLQVAH

SEQ ID NO: 130747 - protein, 163 aa, Glycine max
  Coding DNA Sequence Number=SeqID_39062
YLYLSPLEDYTSSPLRGLHVLAIRGSHAVTFRGLHVLTIRGLHALIRGLHALTSRRLHMLATRGHALTLGLRTTRPHHQRASTPSPSEDYTSSQSESCTSSPSKGCTSSPSEGSTPSPSEGCTLSQPTLRREGDARLAGCVFHERNTRGVATNVYSRKTSGIL

SEQ ID NO: 130748 - protein, 82 aa, Glycine max
  Coding DNA Sequence Number=SeqID_39063
  Homolog annotation: Hit_ID=A5BSZ8; Match level="QueryCoverage=60%, HitCoverage=5%, E-value=2e-07, Identity=56%"; Hit description =Putative uncharacterized protein
MTIANSIKTTLPKIESAKRFMGLVGEHSQTADKSVSGTLMTTLTTMNFGGSLEDKGEEVRGGAIHKGISHGRRSFTTKMSLG

SEQ ID NO: 130749 - protein, 107 aa, Glycine max
  Coding DNA Sequence Number=SeqID_39064
MDVTFNENKFFYVDSTLQGGNESEVHNHDVMSFDHNQLAQSSPQVWLDSSDVPSDLIFDNTNVDETDHEIVSLDPTLDNTNLDEIDHEIDPCLCETTSTPNTESTTI

SEQ ID NO: 130750 - protein, 126 aa, Glycine max
  Coding DNA Sequence Number=SeqID_39065
MTKLGLCLSSGPPPLDDKKVRITVRMTKLGLCLSSGPPPLDDKKGADNRKVSPRATSSCVMATKGGVVDKSEALAPTYPPMRNSDLRRFWTTCETGKRLGVFSTKMQTCFSKETNIPTDLEQHMLF

SEQ ID NO: 130751 - protein, 165 aa, Glycine max
  Coding DNA Sequence Number=SeqID_39066
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=68%, HitCoverage=12%, E-value=4e-10, Identity=35%"; Hit description =Gag/pol polyprotein, 3'-partial, putative
  Pfam annotation: Domain name=G-patch; Domain location=55-99; Score =27.0; E_value=7.2e-05; Accession=PF01585.14; Description=G-patch domain
LVIVSSEEDILVSCLSSAPYVEVEEESLETSFQALEIVNNAYVESPSIQPYLSDTSLMVARVMLKDGFEPGMGLGRNGGGAVSLLKIAENYGRFGLGYKPTSVYKRRIALERKEKSLARLQGRGSQVERVLICHINESFVSVGWLHEDQVAMLDKETNQDQSNWV

SEQ ID NO: 130752 - protein, 92 aa, Glycine max
  Coding DNA Sequence Number=SeqID_39067
MSYAYLLPYLLNNAMVVVSSIKIPQPPFPQGYNSNVTCAYHVGAPRNSIEHCMALKHKLVCSSDLRSRVDLQVCPIRNGVFYTFGGGAINDE

SEQ ID NO: 130753 - protein, 79 aa, Glycine max
  Coding DNA Sequence Number=SeqID_39068
  Subcellular localization annotation: CTP_CleavageSite=30; ConfidenceScore=5.55e-01
MKDCRNTSSGNVSSTSRTSQLLTNSSQALRMASSSSSADGLKWCASLDDPSLSEHAQLILLPDSSLRSAEECCAQRMAR

SEQ ID NO: 130754 - protein, 160 aa, Glycine max
  Coding DNA Sequence Number=SeqID_39069
MWAFQKGLQIDWAHLVRYDMHMALRLNAPLPYLHLVTLFLQHFNIPLDSEPYVLIKRSFLIGASVIASFGYQEEHDGSWVKKGARHVGEEGHDGEDSSLLSKIMDRFDGLQTFLGERFDTLELQVDMSFNEMESRITKVEEDVSYIRSSFDLPPPPPPSS

SEQ ID NO: 130755 - protein, 75 aa, Glycine max
  Coding DNA Sequence Number=SeqID_39070
MGLRKRVENGELHQAITTHGSKLEGGGRMNENAIHGLRKKVVNGELHYAITTHGSKLVGAGHMNENAIHGAPKKG

SEQ ID NO: 130756 - protein, 116 aa, Glycine max
  Coding DNA Sequence Number=SeqID_39071
MTQELVARGDTLRLSAPRHSVTPSVIDEQRPMWSSAPFPEMSAFSDGDFSSLTSYPELRHVTCTLVSSRGGGPDDTRRYLTVIRTLLSSRGGGPDDKQRPSLVILHPCIIQRRRAR

SEQ ID NO: 130757 - protein, 96 aa, Glycine max
  Coding DNA Sequence Number=SeqID_39072
MTKREMITMIVDTLTVFYYEEWWVTHLQVLGIWSSPANGLMWVRKEGENEGETHVVTTIPIRPSFSPTQQCHYSANNNPSPYPPPSYPQRSSLNQP

SEQ ID NO: 130758 - protein, 690 aa, Glycine max
  Coding DNA Sequence Number=SeqID_39073
  Gene Ontology: Mol. function=hydrolase activity; Cellular component =integral to membrane; Biological process=Mo-molybdopterin cofactor biosynthetic process
  Homolog annotation: Hit_ID=P0AAC5; Match level="QueryCoverage=32%, HitCoverage=95%, E-value=1e-109, Identity=92%"; Hit description =Inner membrane protein ybhL
  Pfam annotation: Domain name=MoaC; Domain location=15-148; Score =300.7; E_value=2.8e-87; Accession=PF01967.12; Description=MoaC family
  Pfam annotation: Domain name=MoaE; Domain location=203-320; Score =211.0; E_value=2.9e-60; Accession=PF02391.8; Description=MoaE protein
  Pfam annotation: Domain name=ThiS; Domain location=136-209; Score =54.0; E_value=5.1e-13; Accession=PF02597.11; Description=ThiS family
  Pfam annotation: Domain name=UPF0005; Domain location=399-620; Score =201.3; E_value=2.3e-57; Accession=PF01027.11; Description =Uncharacterised protein family UPF0005
  Pfam module annotation: Pfam domain module=MoaC::MoaE::ThiS::UPF0005; Domain location=15-148::203-320::136-209::399-620
MSQLTHINAAGEAHMVDVSAKAETVREARAEAFVTMRSETLAMIIDGRHHKGDVFATARIAGIQAAKRTWDLIPLCHPLMLSKVEVNLQAEPEHNRVRIETLCRLTGKTGVEMEALTAASVAALTIYDMCKAVQKDMVIGPVRELVGTDATEVAADFPTVEALRQHMAAQSDRWALALEDGKLLAAVNQTLVSFDHPLTDGDEVAFFPPPFSVGEEYPWLAERDEDGAVVTFTGKVRNHNLGDSVNALTLEHYPGMTEKALAEIVDEARNRWPLGRVTVIHRIGELWPGDEIVFVGVTSAHRSSAFEAGQFIMDYLKTRAPFWKREATPEGDRWVEARESDQQAANAGTAASGNFTAQYIRLRCVDAQPHHFAVSLRYSLYLQEIVMDRFPRSDSIVQPRAGLQTYMAQVYGWMTVGLLLTAFVAWYAANSAAVMELLFTNRVFLIGLIIAQLALVIVLSAMIQKLSAGVTTMLFMLYSALTGLTLSSIFIVYTAASIASTFVVTAGMFGAMSLYGYTTKRDLSGFGNMLFMALIGIVLASLVNFWLKSEALMWAVTYIGVIVFVGLTAYDTQKLKNMGEQIDTRDTSNLRKYSILGALTLYLDFINLILNGIWLITALGLVATAGLAWGANKDINKINAAIAGVIYLFLLSLVAIVVASLVPVYAIIIVFSTAGAMVGPGNHRECGINE

SEQ ID NO: 130759 - protein, 100 aa, Glycine max
  Coding DNA Sequence Number=SeqID_39074
  Gene Ontology: Mol. function=nucleic acid binding; Biological process= DNA integration
  Homolog annotation: Hit_ID=Q7XYU6; Match level="QueryCoverage=35%, HitCoverage=10%, E-value=7e-09, Identity=74%"; Hit description =Integrase
  Subcellular localization annotation: CTP_CleavageSite=58; ConfidenceScore=5.04e-01
MAHFIPCRKFDDANHVADLFLKEVVKLHGLPRSIMMTKVMNKKLKRSKNNSSESKNISSESRTSQEFKNQEKFKTQEESLQSRIKIQDTRSQDSRLKIQE

SEQ ID NO: 130760 - protein, 58 aa, Glycine max; identical to SEQ ID NO: 107978
  Coding DNA Sequence Number=SeqID_39075

SEQ ID NO: 130761 - protein, 126 aa, Glycine max
  Coding DNA Sequence Number=SeqID_39076
MCHMVYPIFALGDQDFFCRDVSLLLLAQPQQKTPNTNQHLISHPYQTYLCDDLQTDTDTSVNDTEKMLVACNTFHGHTPQSVGKILVLQQPSFVCQNLEFQHLTEACETLVVEIDALMLDHVPQAQ

SEQ ID NO: 130762 - protein, 242 aa, Glycine max
  Coding DNA Sequence Number=SeqID_39077
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARGLALLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130763 - protein, 56 aa, Glycine max
  Coding DNA Sequence Number=SeqID_39078
MGLLLKQRNQDQTISPNIFCEDGKENATDPFTKALGIKEFDKDKWELGMKFMNDWL

SEQ ID NO: 130764 - protein, 117 aa, Glycine max
  Coding DNA Sequence Number=SeqID_39079
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=65%, HitCoverage=75%, E-value=1e-26, Identity=77%"; Hit description=LacZ protein
MTMITPSSKLTLTKGNKSCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130765 - protein, 76 aa, Glycine max
  Coding DNA Sequence Number=SeqID_39080
MAAEWRRKRERRRHFKEKMSLEKAHHHRRSWIRAWRKKKMNEGRGREEQEILCSKRALKSEPTNPRSIPRFSTKCA

SEQ ID NO: 130766 - protein, 131 aa, Glycine max
  Coding DNA Sequence Number=SeqID_39081
MFAHSIKGCRPLGRTCGVLIPSPDQRVPMNPKRIKSVEKKCPEFEEPQDLRSNPFQGGGVATYPSAEGRRGTHGCVFQGRKAHGVPTNVYSRKTSEKPKRCGLRTLIVKGSGVVSTHGEGISTPPVRHNRR

SEQ ID NO: 130767 - protein, 233 aa, Glycine max
  Coding DNA Sequence Number=SeqID_39082
RNDTGNRKAGQRAHEGAARGKRWYLIVLSGFATTDLSVRFRDACQGGGAYGKTALPRPSHFPVKYLPGIFQEISAPFRPPPRWSSNSPYSELLQSHWPSFYNVVTGKTLASYPTLIAIEHIPLYAAGIAKGPHSIPFPTARVSGELASASDPRLHLPRDVRLGMLCANWTDNTPRSELNRREQLIEPDTPLEPQITHHYTKSKAGSPAFAQNLRSTGGGTHTFGENEYNVDRH

SEQ ID NO: 130768 - protein, 246 aa, Glycine max
  Coding DNA Sequence Number=SeqID_39083
FALLRPDPQELATKLCIPGRGFELNVDGQPLKILRKNMTTLAQTWSVFSFSNLIPTSHTFDVTLNRAKLIYGIIMKMDMNLGYLISHQISLIAQHDTSRLGFPALIITLYKARGVQSDSRSLENLSPAINLAYIKKNCWNLDDPIVTFRGTRKARGRRSEVAWPEAQPSLFGGGAASAAQEPALEEPAAVVAVEGEDELTPPKPFYFDADVHMAQEEETSTDQIPGPSPTPTPDDAIPFAPTSKLE

SEQ ID NO: 130769 - protein, 192 aa, Glycine max
  Coding DNA Sequence Number=SeqID_39084
  Gene Ontology: Mol. function=signal transducer activity; Cellular component=membrane; Biological process=signal transduction
  Homolog annotation: Hit_ID=Q5CDC4; Match level="QueryCoverage=21%, HitCoverage=32%, E-value=5e-15, Identity=100%"; Hit description =LacOPZ-alpha peptide from pUC9
MVKVGTSYVPINVSSSPKVGPGLPGINRDTRIYLFCEVIFRHSCPSCSATDGVGFPSHDVVKRRPVNCNTTHYRANWSSTAVAAALELVDPPGCRNSMGRNQINGVLLKVLKNNPNFNGTYSCWEPNALDGRDPDYQAYRYRRPRGGARYQLLFPLVRVNFELGVIMVIAVSCVKLLSAHNSTQHTSRKHKV

SEQ ID NO: 130770 - protein, 303 aa, Glycine max
  Coding DNA Sequence Number=SeqID_39085
MNCDLAGGEHHKDNCYFYSINNFDRRQELVMYDYHEKERAPDLESILANFMTFQASSKGYCYSMQQQGTQFERNQSFESYQWESYRQPYYHNKAEGVLNLDDLLMQFKDTVKSMQQAFRRTETQISKLVDEMTNAAARKEEEHAEIEIHQESIHQVTSIHHQLTNEEEKPEVSSTPEYPYLATVGYVGGKDKGRLELSVEDQKISFDLFEAMKHLDMGDAHFEEEEVEREIALSTSTMVVFEELKKLRPAENPKAELKTLLAHLKYVFLEEDETKPVIISNSLKKEEEEDQLVHILKRHKAAI

SEQ ID NO: 130771 - protein, 80 aa, Glycine max
  Coding DNA Sequence Number=SeqID_39086
DCITTPERSLEDTSEPPTPVVDLSSPQHAVDPSTPILEILEDPTTPVLTLNTSPPATPVLYLTDEEDVQTQDTQDQSQEF

SEQ ID NO: 130772 - protein, 301 aa, Glycine max
  Coding DNA Sequence Number=SeqID_39087
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILSFLPAPFPALLLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130773 - protein, 147 aa, Glycine max
  Coding DNA Sequence Number=SeqID_39088
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=74%, E-value=7e-25, Identity=67%"; Hit description=LacZ protein
  Subcellular localization annotation: CTP_CleavageSite=41; ConfidenceScore=5.30e-01
MTMITPSSKLTLTKGNKSWSLIASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130774 - protein, 157 aa, Glycine max
  Coding DNA Sequence Number=SeqID_39089
  Homolog annotation: Hit_ID=Q84VH5; Match level="QueryCoverage=61%, HitCoverage=14%, E-value=4e-34, Identity=80%"; Hit description =Envelope-like protein
MFPTSSTPNAEVLSSSSKERSTEEDDQATEETPAPRAPEPALGDLIDLEEVESDEEPIANKLAPGIAERLQSRKGKTPVKRSGRIKTMAQKKSTPITPYHIQTEQIDIEGTGNQQEIICHKGMLDCISLKNCRGQAGHLMCYEEVIAATLNVLKRLT

SEQ ID NO: 130775 - protein, 61 aa, Glycine max
  Coding DNA Sequence Number=SeqID_39090
SGEHQLDEAQRFLLDALNAQMQRLLRENDENPETGQIQAKGPSGEGRRPKWRRTKPPSGEG

SEQ ID NO: 130776 - protein, 135 aa, Glycine max
  Coding DNA Sequence Number=SeqID_39091
MLTHFCPMLILSLPLSFLLWVHNSFRNLAYLGICLMASSRGGNGRGIGGCDSEWRLLSLAKIAYSGWSFASLTLLRKVEEGPQLLVVFVVAALEEEHVACLDQQHSRKEGQTVVVVEDLSISVWMIPPTWIVFVA

SEQ ID NO: 130777 - protein, 82 aa, Glycine max
  Coding DNA Sequence Number=SeqID_39092
MNRTLELDQFPLLNDPNKACIYVIKVPTGKDPTEDLAFDTRKSSLQQREDQDEKIAKIQVVRMSPSPLGSHNHSQTHLKLSN

SEQ ID NO: 130778 - protein, 282 aa, Glycine max
  Coding DNA Sequence Number=SeqID_39093
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIISRAGASWRCSSGAIPRSMTAPCALPRDCSAKDSIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130779 - protein, 48 aa, Glycine max
  Coding DNA Sequence Number=SeqID_39094
MGRVNLGLNVRMVVMTCGKAWAEQRRKMSDKGNACALLVMGKVVHIGF

SEQ ID NO: 130780 - protein, 199 aa, Glycine max
  Coding DNA Sequence Number=SeqID_39095
MATRKLSAKRSRKDAVAEGTSAAPEFDNHRFRSAEHQQCFEAIKGWSFHRERRVQLRDNEHTDFQEEIARRRWTSLVTPMAKFDPNIVLEFYANAWPTEEGVRDMRSWADGFDEEAIAQLLCIPGQDFAQTVAGRRVRIMRINMTTLTQTWMTLLHSNILPIDHNSDLPLPKCQLVYAILTWMSVHVAQLITDAIYLFA

SEQ ID NO: 130781 - protein, 24 aa, Glycine max
  Coding DNA Sequence Number=SeqID_39096
MSHWNGPEEACLKEVQEGQGGRRN

SEQ ID NO: 130782 - protein, 17 aa, Glycine max
  Coding DNA Sequence Number=SeqID_39097
MRGYDSAEGSSWDINQH

SEQ ID NO: 130783 - protein, 427 aa, Glycine max
  Coding DNA Sequence Number=SeqID_39098
  Homolog annotation: Hit_ID=Q8H767; Match level="QueryCoverage=78%, HitCoverage=93%, E-value=1e-140, Identity=69%"; Hit description =Lysine ketoglutarate reductase trans-splicing related 1
  Pfam annotation: Domain name=DUF707; Domain location=93-410; Score =453.0; E_value=3.9e-133; Accession=PF05212.3; Description=Protein of unknown function (DUF707)
  Subcellular localization annotation: CTP_CleavageSite=51; ConfidenceScore=5.10e-01
MEFWLFWLAMDFPLFFHCLFHAILVSVKPNACSSVFVFHEGKSSLKMTQLPFMAVVCIVMLFVVYRTLKYQSYQEQIDKQWNIREEEKAYTETSGNLKGLPQGIIQATSDLELRRLWSPSNLRSKASVYSNRNLLAVAVGIKQKHNVDVMVQKFLPDNFTIILFHYDANLDGWWDLSWSSKAIHITAQNQTKWWFAKRFLHPDIVSIYDYIFLWDEDLGVEHFSPSRYIEIVKEEGLEISQPALDPNSTEIHHRITVRARTKKVHRRVYELRGNTKCSDASKGPPCTGFVEGMAPVFSRSAWYCTWHLIQNDLVHGWGLDMKVGYCAQGERTQNVGVVDSEFVVHKGIQTLGGSDDPTKVSSQKRKTPRHGAAAFDQRVEIRRQSTWELEVFNERWNRAIAEDKNWVNPFKSDKKRIRQRQKTNRFS

SEQ ID NO: 130784 - protein, 119 aa, Glycine max
  Coding DNA Sequence Number=SeqID_39099
  Gene Ontology: Mol. function=inositol or phosphatidylinositol phosphatase activity; Biological process=sulfur metabolic process
  Homolog annotation: Hit_ID=A7R1U1; Match level="QueryCoverage=83%, HitCoverage=25%, E-value=1e-31, Identity=67%"; Hit description =Chromosome undetermined scaffold_377, whole genome shotgun sequence
MGFIPMLFNFLFFFSLSFCNQPVRVYNMMKYAAIACGDAEVFMKFARAGYKEKIWDHAAGAIIIREAGGIVTDVRGHPLEFSKGLYLERLDRGIVACAGPTLHEKIIDAVDASWASSCL

SEQ ID NO: 130785 - protein, 117 aa, Glycine max
  Coding DNA Sequence Number=SeqID_39100
  Subcellular localization annotation: CTP_CleavageSite=50; ConfidenceScore=5.53e-01
MYTTHHLARSAYIGKCKASSKVSKTMNSLCRSMVAVMLAMSLILSLGVIMSQARAYPSSLVSRMSQSSQSLSRPLWHKVGQKSTLEPVVTANLRRIPPSTPNPTQNIGLTPPPGESD

SEQ ID NO: 130786 - protein, 464 aa, Glycine max
  Coding DNA Sequence Number=SeqID_39101
  Gene Ontology: Mol. function=signal transducer activity; Cellular component=endoplasmic reticulum; Biological process=signal transduction
  Homolog annotation: Hit_ID=A7QNT7; Match level="QueryCoverage=100%, HitCoverage=100%, E-value=1e-109, Identity=50%"; Hit description =Chromosome undetermined scaffold_134, whole genome shotgun sequence
  Pfam annotation: Domain name=Sad1_UNC; Domain location=313-453; Score= 187.9; E_value=2.5e-53; Accession=PF07738.4; Description=Sad1  UNC -like C-terminal
MSASTVSITAANPGTRRRPVIATEKKTATSLELLANDVAVSPAVATSGDGATGRDLSHHSIRGEALLDRAPRDLTPAKKVAGAGPNSASGPPRRTRKPAAKSEKPRWLTLVSIFGKNLVLLVVLAGLVQLIRRMSLKSGDAAAGGFAGFSEFEGRISDVEGLLKKTAKMIQVQVDVVDKKIEDEVRGLRKELNEKIEEKGVILESGLKKLEAKNEELEKYLSELKGENWLSKEEFEKFVEEVRSVKGSGYEGGGLDEIREFARGVIEKEIEKHAADGLGRVDYALASGGGTVVKHSEVFDLGRGNWFLKSARNGVNPNAEKMLKPSFGEPGQCFPLKDTRGFVQIRLRTAIIPEAVTLEHVAKSVAYDRSSAPKDCRVSGWLQEHNADSAIDTEKMHLLSEFTYDLEKSNAQTFNVLNSAASGVINMVRLDFTSNHGSPSHTCIYRFRVHGHEPDSVSMMALES

SEQ ID NO: 130787 - protein, 220 aa, Glycine max
  Coding DNA Sequence Number=SeqID_39102
MEALFMSQIKKHYQKVGTSILGVTECLGIKRYLGMLLLVGWKKNDVFNFVKEKVGNGGDGTCEWKNVAPPPSPAAHYNPPPPFPSYHRWRHFPFCPRHASPSTTLDSNSVSISLSQPNSNSNPNPLNFTFIVKVLLVPPTTSATASDNFNLFPVVDFHVIAHDGAPKQTRQQHSEDRTLNLHFSMVSLTAILLSMGATAELRFGSAVSDGRRTERQLEKG

SEQ ID NO: 130788 - protein, 304 aa, Glycine max
  Coding DNA Sequence Number=SeqID_39103
MDRGVIRPFGQGEVCEPGRAHLQGGATQAKQLALEGADKYGVAIGDDVARKPVMFAHNVEEQGCDFISSETGCDKIHRNILPDTGRRRNGVEQADRLSIDWLHLLANLALAHEVLNVCGHIWPVEAGLKAMEGLPHSQVAVNRGRVELCKEGQVEGSSRTSTAPQVSECVKGSQRQRSRAQICIGYHSRNPAAWPDDTVARGQDGEAVAQEVLAPLMHDDSDGVQLADVGGGSMDAWAECLAKERDWVSLLEEDNSHGGARRVGLNSEGQVESQKGQDWSRRHGCFEQVEGGLRLRRPAEGIFT

SEQ ID NO: 130789 - protein, 102 aa, Glycine max
  Coding DNA Sequence Number=SeqID_39104
  Gene Ontology: Mol. function=transporter activity; Cellular component= integral to membrane; Biological process=transport
  Homolog annotation: Hit_ID=Q2PF04; Match level="QueryCoverage=48%, HitCoverage=9%, E-value=2e-09, Identity=62%"; Hit description =Putative transporter-like protein
MGEENVKQPLLERKYYKDCPGCKVDQAKELSEGKGVPVKNLFIMWMVVLCAGTCGGGVAYRGCQIKDLKSSTMLARKLSWCLTSELKLNCNTSLFQVVHFLT

SEQ ID NO: 130790 - protein, 84 aa, Glycine max
  Coding DNA Sequence Number=SeqID_39105
  Gene Ontology: Mol. function=methyltransferase activity
  Homolog annotation: Hit_ID=A7PKB2; Match level="QueryCoverage=86%, HitCoverage=28%, E-value=4e-24, Identity=82%"; Hit description =Chromosome chr15 scaffold_19, whole genome shotgun sequence
MKDDYIHLFVRRPVRRSPIINRGYFARWAAFRKLLYQFLDVEKKTDGDAPIKKQILSLGAGFDTTYFQLQVPGFPCELYCASCT

SEQ ID NO: 130791 - protein, 75 aa, Glycine max
  Coding DNA Sequence Number=SeqID_39106
MKGRSDGDEHLMLARMVNSNYFSFFLHGLLLLSLNSSFFSLSFLVLNGGENECRERFSVGLCCVAVGCKLWVTPN

SEQ ID NO: 130792 - protein, 200 aa, Glycine max
  Coding DNA Sequence Number=SeqID_39107
  Gene Ontology: Biological process=multicellular organismal development
  Homolog annotation: Hit_ID=A9NZH9; Match level="QueryCoverage=75%, HitCoverage=84%, E-value=2e-63, Identity=73%"; Hit description =Putative uncharacterized protein
  Pfam annotation: Domain name=DUF667; Domain location=22-187; Score =319.0; E_value=8.8e-93; Accession=PF05018.4; Description=Protein of unknown function (DUF667)
MSGQTRMGTGSGCNSPAGDRVWYLFLWQNNLFHVQVVNGHVERPQDEDIQSNVLEIIGSNIQSTYITCPADPAATLGIKLPFLVLIVKNLMKYFTFEIQVLDDKNVRRRFRASNFQAVTRVKPYMCTMPLRMDEGWNQIHSLTWLISPREHMVHANCRLRRIYFSDRLYSEEELPPEFKLYLPMQINIARSSNIKLCRVF

SEQ ID NO: 130793 - protein, 550 aa, Glycine max
  Coding DNA Sequence Number=SeqID_39108
  Homolog annotation: Hit_ID=Q8H6Q7; Match level="QueryCoverage=20%, HitCoverage=8%, E-value=5e-08, Identity=35%"; Hit description=CTV.22
MRLPEEVLVRVCANGRGLTSWVEPLEGSWVQRMNSAYFPTVNTIYQQMNRKLQQLESSPQEPNTVERMRFNMKLLEQILAILRVNKWQITTEFKENLDKAEKFIQSKFFSKNVSSHHQGQQRSADVQSRQQSGPSHSSISPLMILEMKPSPQALGSQNYHPMKDVSQQNKMCLQEKQAAKQYGGSQQSGPSHSSISPVKTLEMRPSPQALGTQNYHMMKDVSQQNKMCLQEKQVTIKYRNLQQDVNQLSIIKGAGNTVQQQTQGTQKATEAFSVSVNSQGISASPLIENCNNLKEISRKPTLTSDEPSAAMQYFLKVLTSISPEALSASLGEIREVVYLNDAIPSPELMHGPPEMVQQQMQPCLISQTGINLASDIEPCSQARYITCNDFVPTGRKRSCSMNSMTAFDTSSTCASSCDSNQLTDTEKPDLTLVTSKHPRIVEKCSLLEEIKEINNLLIDSEIVIGEKDSIQSAAGGAAEDGEEHAKTMQTASPIGGFAVTVTRGEDATGGGLASQTGELQARAQAQPFRLFQLAAFLGGRGEYRLKGSNH

SEQ ID NO: 130794 - protein, 366 aa, Glycine max
  Coding DNA Sequence Number=SeqID_39109
MMHFQRRLLDNRLSKAHGGININKCQLNKDGVQKPIFNATYNNGGFEHCLSTMLIATYLGRCFKIGKEPLTPLSAEVTIVGYWSLLLHLNLEGKYLLLHLNFFRMLITTTFKLVFANIDNQQTQDVVTKYGLDLETWKELAATRQTPNWEDSLEDQTTHGSYVPHGRDDILNTANGRPDHGGRVGAAGAGVTINQYYGRASRASNNSSTSINQQQLDEVIADIQQLGAHVSPKGSNAETGVHSLGEDVANVIPIGALGKVLHGGSTIHSVAYADDVVKVDAEKVIHAGVEVVPHDAQITPNKVMVHVPTQVDVDTNDPMRGLIKLSFDIYKPIEFMFDESKFGIVDGAMFAGSIAILIRKCTESLK

SEQ ID NO: 130795 - protein, 202 aa, Glycine max
  Coding DNA Sequence Number=SeqID_39110
  Gene Ontology: Biological process=multicellular organismal development
  Homolog annotation: Hit_ID=A7QAC5; Match level="QueryCoverage=75%, HitCoverage=85%, E-value=3e-53, Identity=69%"; Hit description =Chromosome undetermined scaffold_70, whole genome shotgun sequence
  Pfam annotation: Domain name=DUF667; Domain location=22-187; Score =254.2; E_value=2.7e-73; Accession=PF05018.4; Description=Protein of unknown function (DUF667)
MSGQTRMGTGSGCDSLAGDRAWYLFLWQNNLFHVQVVNAHVKRPQDEDIQSNVLEIIGSNIQSTYITCPADPAATLGIKLPFLVLIVKNLKKYFTFEIQVLDDKNVRRRFQASNFQVCCHSGKALHCTMPLRMMRGGIKSSLTWLISPREHMVHANCRLRRIYFSDRLYSEEELPPEFKLYLPMQINIARSSNIKLCSDACL

SEQ ID NO: 130796 - protein, 200 aa, Glycine max
  Coding DNA Sequence Number=SeqID_39111
  Gene Ontology: Mol. function=phosphoprotein phosphatase activity
  Homolog annotation: Hit_ID=A5AKZ4; Match level="QueryCoverage=56%, HitCoverage=16%, E-value=4e-13, Identity=40%"; Hit description =Putative uncharacterized protein
MTRGMQTANPIGAFAAAVTRDMELGAAAFDLGFEDIAVPAGNLSLVDYKIPFNRVKVSFELLTEKTLWRERELHLFFLRVLPFSQNLSLRVDGVPLIGLTNLDCADLCEELLGVRSQEGELQGSVVVRRGNYHIGNNDRIVFRRKLDIMKRHESLWESYTTTVTLALPPICLVESVAWCAVVPLICFHVVEWHQPDRVLR

SEQ ID NO: 130797 - protein, 20 aa, Glycine max
  Coding DNA Sequence Number=SeqID_39112
MKRKKKKNESVPAVFISRVA

SEQ ID NO: 130798 - protein, 237 aa, Glycine max
  Coding DNA Sequence Number=SeqID_39113
  Homolog annotation: Hit_ID=A7PXE1; Match level="QueryCoverage=54%, HitCoverage=82%, E-value=4e-32, Identity=59%"; Hit description =Chromosome chr12 scaffold_36, whole genome shotgun sequence
MVVGEQTNGWPPIGAPLNVHRDEHWTNFDSSVNAVSFGFVATAILISMFLVMAIFERYLRPTSPPLSPSATTRRRSPSDVEAQIGFSGKLAHASPKMSVYASGVSVLMPGDEIPTFIAHPAPCYPERISWPSHQHNNTLPCSSSNTLPTTTINQVVNLRLHHDAFVDVVEGVRGSTEFGGEPLVVVAAAVAVAVGGVSFCWRLALPLWWVSQRDMVAGEECREVAGGGEDEDVVGIK

SEQ ID NO: 130799 - protein, 887 aa, Glycine max
  Coding DNA Sequence Number=SeqID_39114
  Gene Ontology: Mol. function=protein heterodimerization activity; Cellular component=microtubule; Biological process=cell division
  Homolog annotation: Hit_ID=A7R3U5; Match level="QueryCoverage=65%, HitCoverage=99%, E-value=0.0, Identity=56%"; Hit description =Chromosome undetermined scaffold_569, whole genome shotgun sequence
  Pfam annotation: Domain name=WD40; Domain location=103-141; Score =28.6; E_value=2.3e-05; Accession=PF00400.23; Description=WD domain, G-beta repeat
  Pfam annotation: Domain name=WD40; Domain location=145-183; Score =40.0; E_value=8.4e-09; Accession=PF00400.23; Description=WD domain, G-beta repeat
  Pfam annotation: Domain name=WD40; Domain location=187-225; Score =51.1; E_value=3.9e-12; Accession=PF00400.23; Description=WD domain, G-beta repeat
  Pfam annotation: Domain name=WD40; Domain location=229-267; Score =43.7; E_value=6.4e-10; Accession=PF00400.23; Description=WD domain, G-beta repeat
  Pfam annotation: Domain name=WD40; Domain location=25-64; Score=27.1; E_value=6.4e-05; Accession=PF00400.23; Description=WD domain, G-beta repeat
  Pfam annotation: Domain name=WD40; Domain location=278-315; Score =13.9; E_value=0.6; Accession=PF00400.23; Description=WD domain, G -beta repeat
  Pfam annotation: Domain name=eIF2A; Domain location=75-245; Score= -82.7; E_value=0.0081; Accession=PF08662.2; Description=Eukaryotic translation initiation factor
  Pfam module annotation: Pfam domain module=WD40::WD40::WD40::WD40::WD4 0::WD40::eIF2A; Domain location=103-141::145-183::187-225::229 -267::25-64::278-315::75-245
MAKTGYKLRILFYIYKFCASENAFCCNVEEFAAHSGNVNCLKLGRKANRLFITGGDDHSVNLWMIGKPTSLMYSKIVWALGIVLTTSTQSSEMVSAWLTQPTHLGSKSLCGHTSSVESVTFDSAEVLILSGASSGVIKLWDLEEAKMVRTLTGHRLNCTAVEFHPFGEFFASGSLDTNLNIWDIRKKGCIQTYKGHSQGISTIKFSPDGRWVVSGGFDNVVKVWDLTGGKLLHDFKFHEGHIRSLDFHPLEFLMATGSADRTVKFWDLETFELIGSTRHELSRHCSMVSGVRSIAFHPDGQILFAGFEDSLKVYSWEPVICHDAVDMGWTTLGDLCIHDGMLLGCSFYSNSVGVWVSDISLIEPYNGGLETEKKESTKQKLSLQGRQMEKVEAGVGPAFGLCSMSADNESKEIKNIYIDSSGGNPDTLIRSRSYNSPKVDLPEESKEMLNWSPATRAHAKQNEQTLRKSYIMPNFVPRDIVNGKNSATFSKTKPGMLLKPVHVQGASTDILDVDGFSSDLDSRTFCDTGSKSDSPKDPNFQMKLGSQNEVRESIEDKHPIKSVTEKFEKTLTPDRFSDQDKCNQSSPYSKEMSPVKYVNGVAVLQGRTRSLVERFERRERTPTDENQANATPTTIFENKEKILKEDQTNASPITSITSEKGERFPFGDDQNNMPNVPNTTSETDKSANFLKVEPQVLGSDSNSANDGEIIEGLMQTHDVTLSNLRSRLTKLQGYRKKGSGSPKVVQHFWERNDTKGAISALRKLPDQSVQADVISVLVDKMEIITLDLFSCLLPVLTGLLDSNIERHVKVSLDMLLKLVAVFGPTIRSTISAPPSVGIDLHAEQRRECSNQCFMQLQKIRMILPILIRRGGILAKSAQELNLVLQQP

SEQ ID NO: 130800 - protein, 311 aa, Glycine max
  Coding DNA Sequence Number=SeqID_39115
  Gene Ontology: Biological process=embryonic development ending in birth or egg hatching
  Homolog annotation: Hit_ID=A7P3Y3; Match level="QueryCoverage=74%, HitCoverage=51%, E-value=2e-57, Identity=58%"; Hit description =Chromosome chr1 scaffold_5, whole genome shotgun sequence
  Pfam annotation: Domain name=DUF747; Domain location=205-311; Score= -127.6; E_value=1.7e-05; Accession=PF05346.2; Description=Eukaryotic membrane protein (cytomegalovirus gH-receptor) family
  Subcellular localization annotation: CTP_CleavageSite=29; ConfidenceScore=5.08e-01
MRHRGAPEEPPQPQPSFPHRKKKRKRRATATATVGSTSVSFETSHTDAPDQLNTHIHDAAVACEQSKATAAGDGFRFGELRQRSVNGRDSFVDLAVTAVGDGYVTETVESLELKRVLGNDSIPKRLPVSSFLEKVLHGNSVWSTTTVGDEKGRERVYDTIFRLPWRCELLIDVGFFVCFNSFLSLLTIMPTRIVMTIWRLLKTRKFKRPSTIELSDFGCFLIMICGVIVLQQIDISLIYHMIRGQETIKLYVIYNMLEAITLSACIVSHYNALPALLVSNNFSEIKSYVFKGYSKDNVHSMVYSGELSFLQ

SEQ ID NO: 130801 - protein, 130 aa, Glycine max
  Coding DNA Sequence Number=SeqID_39116
  Homolog annotation: Hit_ID=A5C3T9; Match level="QueryCoverage=98%, HitCoverage=4%, E-value=6e-10, Identity=31%"; Hit description =Putative uncharacterized protein
ENVCPLCRNEQEEAGHLFFNCNLTIGLWWESLRWIQVIGVLPASPASHFIQFCDGFGEGRNHSRWCGWWIALTFTIWKHRNLLVFQGIPFVSTKVLDDALFLAWSWLKARDKGFNTLFNHWSTNLSEAFA

SEQ ID NO: 130802 - protein, 105 aa, Glycine max
  Coding DNA Sequence Number=SeqID_39117
  Subcellular localization annotation: CTP_CleavageSite=50; ConfidenceScore=5.52e-01
MGKIGRNLEEKLSCKHVPNASSARLASRLSFLTLSAPSSLSQSSLTRSKRAFEDRKSFLKPEVKNEKGGLRREVSSASVQLCLPMFTLRCLSSMCAILKSKKLHV

SEQ ID NO: 130803 - protein, 198 aa, Glycine max
  Coding DNA Sequence Number=SeqID_39118
GTIVDDWKFDYSSHDACRMVCNDQTEMTAQASEEDLILMWAFLTGRQIDWAHLVWYRMHKALRANAPLPYPHLITLFLRHFQIPLDDEPFVQVKCSFAIGAGVVTSFGYRKDRNGQWLKKDALPPQDERTPSPLPQRDDSALMNEVLSELRGLRSYVGDRFDSLDTRFAGMDIRLTQLEEDVGYIRQSFDLPPPPPPS

SEQ ID NO: 130804 - protein, 194 aa, Glycine max
  Coding DNA Sequence Number=SeqID_39119
MASGNRLPRVCNRLPRVCNRLQGLKNEDRKLRWPLVSMFRSCVTRVWALITMAAQLIHDRVEMECLEGVWETLEGNERCRFRGTIRLTATSLVHPEEPARTLQQTVEWILPTPTPYRLVEPVQVIEVSSSEEDPEEDREELPPEPAVDALDFLEGDEDPLPDVDSPEDVMSASEADSTEESGPGGTATSGDSSS

SEQ ID NO: 130805 - protein, 66 aa, Glycine max
  Coding DNA Sequence Number=SeqID_39120
  Gene Ontology: Mol. function=aspartic-type endopeptidase activity; Biological process=DNA integration
  Homolog annotation: Hit_ID=A5C737; Match level="QueryCoverage=100%, HitCoverage=15%, E-value=9e-20, Identity=58%"; Hit description =Putative uncharacterized protein
MKKECPKYAAWRVKKDTWWIDSGATTHISMTMQGCLWSQSPSDDERFIFVGDGKKVAVEDIGTFRL

SEQ ID NO: 130806 - protein, 159 aa, Glycine max
  Coding DNA Sequence Number=SeqID_39121
MSLAVGRMYWSHSSVLVRTCHSLWVACTGDLVLRGGLTKGGPWTGCDPEWAFPVGAKLSHSRIFSGFSLDSSYEVTRLKGSWLNLCIVFPCCSKFGSFFHDPRYFLDFVCDFKFYPHIFFILLLLEQRSPCRWLLDFNGDHGVCTMCESIRSFISCCLG

SEQ ID NO: 130807 - protein, 347 aa, Glycine max
  Coding DNA Sequence Number=SeqID_39122
  Homolog annotation: Hit_ID=Q2HW90; Match level="QueryCoverage=31%, HitCoverage=26%, E-value=3e-10, Identity=35%"; Hit description =Putative uncharacterized protein
INAFLAFHDYKESPVVAILADLYDTFDRRCEKSSTRIVFCTPALYVWLASHLFRQEVIHACPLESHRSCTEKREARFPNVPLIGTRGCISYNPVLAIRQLGYPMRGAPLKEEELAPIIARGSNNGPIGGYHRWLKAHMQGLDWLPSLRTSKVVEVEAPEEDEEVQALRAELEKAQTVKERFKSAALKIRKENAELRDVNIANTKALEQETKRAQLKLWREERDQSRVDSLILKDGLKVCLRSKRSLSQCLCETKTNMLAIISKYQEELNLATAHEHKVADEYARVYAEKEARGRVIDTLHQEATMWLDQFALTLNGSQELPRLLAKAKAMVDTYSGPEGDPRTSQLL

SEQ ID NO: 130808 - protein, 137 aa, Glycine max
  Coding DNA Sequence Number=SeqID_39123
  Subcellular localization annotation: CTP_CleavageSite=30; ConfidenceScore=5.12e-01
MASFSQMQSQMQSQGLARPAEPLVGPSGPRVSTKGSCVDPPGNDLETGDSDRCGLYVEADLARLVALGRVSVEEVTDADAPVPIPTNEVVVSSTKPPPKPDPEVDDPVTWDATVFGVFNPDFLVYIKHEDLSEIAHG

SEQ ID NO: 130809 - protein, 97 aa, Glycine max
  Coding DNA Sequence Number=SeqID_39124
MRSDTNTSVREKVSFLLIACERSGEYRPKKKDLVRTCTGNTKCGCLFKLRVKPVLGGEGWMVKSTMPTIIQQSNKFTMLEMLIVLPQEGVTPKCNSS

SEQ ID NO: 130810 - protein, 129 aa, Glycine max
  Coding DNA Sequence Number=SeqID_39125
MAFLGETSSQTIVNSTLAFIFPNDSIVHNDNGVYFQTSTPVPFRLPNVCDFQTLKTRIHNTLQLTDEQYLDEIYYQQSFTDTALVEHQMEKIPKKFDIPSKCTMDELKDLVKQVVPQGIPPCGIHEIQM

SEQ ID NO: 130811 - protein, 58 aa, Glycine max
  Coding DNA Sequence Number=SeqID_39126
MKGIVHEPQVNIGADQKSFEFGMTGPLDESISCFLIRVDLWVLVPIAFRGLHVLAFKG

SEQ ID NO: 130812 - protein, 61 aa, Glycine max
  Coding DNA Sequence Number=SeqID_39127
MPFCGRAKAKLTGALSKGGKMCEVATNVYLWKTSEKPKETGRQKRGFCSYVPSFGEEIRPT

SEQ ID NO: 130813 - protein, 154 aa, Glycine max
  Coding DNA Sequence Number=SeqID_39128
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MFISRHLGKLQKQDKNDKDRRLSRRVQLEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130814 - protein, 219 aa, Glycine max
  Coding DNA Sequence Number=SeqID_39129
  Gene Ontology: Cellular component=integral to membrane
  Homolog annotation: Hit_ID=A7MHT0; Match level="QueryCoverage=41%, HitCoverage=43%, E-value=7e-42, Identity=91%"; Hit description =Putative uncharacterized protein
AAVLDLGRNPYDKLGHFFQGLVPALVAREILLRGGYVQGRKMLGFVVCCIALAISAVYELIEWWAALALGQGADEFLGTQGDPWDTQSDMFCALLGALCGLLLGLHLIAFTAGSAYLCYITGSERLFECETEFDHYPLIPKSKLTISVINNTSFADVVASYLRLILYLPFGLLAIVLTLLFCARRLCDTRLFVLAWPISLAVFLVFWFVNVAFPGHLNL

SEQ ID NO: 130815 - protein, 78 aa, Glycine max
  Coding DNA Sequence Number=SeqID_39130
VQDASSEATIPEPFIFKAGGTQLADPPTPMHEMPADPSTPLLEIPEDPATPVLGLTTTPPASPVLHFTDAEGTQDQDT

SEQ ID NO: 130816 - protein, 260 aa, Glycine max
  Coding DNA Sequence Number=SeqID_39131
RHPNGVIGGYHGWLRIHTRGLDWLSKLKVIDEENFEAPEEDEEVRALKLELGKARLTKEKFKSAATHIRKECIELKEENAATARALEQETKRARKEEYGREKFRGALWDSNNELKLRREERDRSRVHGMILKEELVACARSKRSLAQHLEAMEQSMLAIIGQYKEELNQSMAHEQKLVEDFAQVYAEKEARGRVIDALHQEATIWMDRFALTLNGSQDLPRLLAKAKAMAEVCTAPEEIHGLINYCQHMIDLMAHIIRNR

SEQ ID NO: 130817 - protein, 83 aa, Glycine max
  Coding DNA Sequence Number=SeqID_39132
MEAQKKEAVATIDYSGPALLPEKGHAYFIFTECINLLGRYLLERIQHLLHCMLSGSVGIGILSAFLFDFPSHLPFALSGDWIG

SEQ ID NO: 130818 - protein, 251 aa, Glycine max
  Coding DNA Sequence Number=SeqID_39133
MGDQEETQEQMKADMLALKEQMASMMEAMLGMRQLMEKNAATAAAINSAAEADPTLLATAHHPPSNIVGRGRDTLGHDGNPHLGYNRAAYPYGLPPNYSPPVLQDDAGHIASPVLEREPPQQPDEVHKDPQDYARRDVEFYPPIPEGPAPSTLPQPNITTQPIVLSTEGPPPATEEKRKLDLLEERLRAVEGFGDYPFRRHDGSLLGTPMLLFPRSSKCRTSTSIKGRLVPKTISRCTVARWAHTLRMRNY

SEQ ID NO: 130819 - protein, 73 aa, Glycine max
  Coding DNA Sequence Number=SeqID_39134
MYPLLVPQRMYPPVATYPSAGGRRETRGMRVPRKEYARSRHQRLFEENVGKTGKDAIYELFSERFGSCIYARG

SEQ ID NO: 130820 - protein, 111 aa, Glycine max
  Coding DNA Sequence Number=SeqID_39135
MRSIVVHNIPLLHGQVKVGVDEVKDAEAPVPVPTDEAAVSPAKPPDRPDHEVYDPLYLMTLTIPQLFSKPLQVMWDATVFGVFNQDFPLYIKHEDLSEIAHGGQCLSISVI

SEQ ID NO: 130821 - protein, 169 aa, Glycine max
  Coding DNA Sequence Number=SeqID_39136
WAEGKEAPSVKVACLAQEVGTVENKVANGLTKPMMLSWSFRMISHTGTETRPRTPTGGSSGESWTMGESPIQQYRVSEEGQCRLSGSFVECAIMTGLEEEAPANSVPAAAVRRGGQVFFGMTGRKGHVGGESGVKSADLRRNAKSEGSSLGPYRRWSAKAWGANGIRYP

SEQ ID NO: 130822 - protein, 338 aa, Glycine max
  Coding DNA Sequence Number=SeqID_39137
  Gene Ontology: Mol. function=subtilase activity; Biological process =proteolysis
  Homolog annotation: Hit_ID=Q3D528; Match level="QueryCoverage=55%, HitCoverage=84%, E-value=2e-10, Identity=30%"; Hit description =Putative uncharacterized protein
MVWGDILAKFDIPEAEKAKKKVMSTVGTRWRQFKSSLTTKFVYADTQAGQEENPSAKYGMDKQTWDEFVASRKTPDWQEIRKKAKESQKYNDCPHVLSRGGYDLLEKKMLDEKTKQRQQQALLTENPLSDLEEPPSPIKRHVKWKMARTKRYGQMTSKAAKEISDRIDSLEEQTTQGSFVPHGRDDILNTAHWQTGTSRATRTSSSSSATLMQQQWADIIGNIKEQVRNEYEEQHKRSLEEFKKELSSQIFIQLSQMGSQYSPLIEVDLQALAARLSTKGSNVETADVDPSGDKNVSLKPTMGLYVQRQNTTVLVALGKICEGGSAIHNVTYADDVVR

SEQ ID NO: 130823 - protein, 141 aa, Glycine max
  Coding DNA Sequence Number=SeqID_39138
MIMRGQDIYSSQEKTTSSPSSSGIEDEIRGEESTPMKKVAKDQLTMKDKRDEEEKLEKQKKKKDSKALSTKVKGKEKEEKDFSKKIVKKENHFATKCDIKRALLLKQSFYLLLSRETSLSIAIPLELEVIPQVKELLDEGL

SEQ ID NO: 130824 - protein, 54 aa, Glycine max
  Coding DNA Sequence Number=SeqID_39139
ALIELVRNHVPSWEDVHERGVEGRSPEFEEPLDLRSNPFQDGGDDAILSPKGIG

SEQ ID NO: 130825 - protein, 175 aa, Glycine max
  Coding DNA Sequence Number=SeqID_39140
MGAKHLTRTKEWSHVIEQRSPDEIRGDAGLTGASSMGGKCAESPPTFIRGKRLKNRKRCGLRTLSVKAEGTMMFKSPEEAIVIIDSIAANGLKKADWPTSSAISPRRIKLTKMVTVQHLVMDNKKRRPIINGTKLDLNKTFKEATKAIEVAQDPRQQQAQPDRMSYMEDTLTHFM

SEQ ID NO: 130826 - protein, 152 aa, Glycine max
  Coding DNA Sequence Number=SeqID_39141
  Gene Ontology: Mol. function=glucose-1-phosphate adenylyltransferase activity; Biological process=glycogen biosynthetic process
  Homolog annotation: Hit_ID=Q6AA20; Match level="QueryCoverage=22%, HitCoverage=8%, E-value=3e-13, Identity=100%"; Hit description =Glucose-1-phosphate adenylyltransferase
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIAADAQVYDFRDNEVPGNTEKDADYWRDVGTIDAYIKLIDTVDLEGGPGTSFCSL

SEQ ID NO: 130827 - protein, 166 aa, Glycine max
  Coding DNA Sequence Number=SeqID_39142
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=5e-25, Identity=52%"; Hit description =Putative uncharacterized protein
  Subcellular localization annotation: CTP_CleavageSite=60; ConfidenceScore=5.40e-01
MTMITPSSKLTLTKGNKSWSKGLKLKDLRIQSIGPSFSYPFKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130828 - protein, 137 aa, Glycine max
  Coding DNA Sequence Number=SeqID_39143
MPSTICRDRAHKTPSGPGEVQQGLGVSSSGYGPLSVYRVPVPPARSRHHGIGIAPARHPVDPKKSNRVLGFASLITGLCQFYGVSIAPSKVIRPPINRTFIEKYCAPKQAHGKASQQWATGAPPPPLEFTSAHPQKG

SEQ ID NO: 130829 - protein, 53 aa, Glycine max
  Coding DNA Sequence Number=SeqID_39144
GKPVVPTALLNLPTRGERRFAYWALSECIQSYYVDTEKGVSEELHVAREIRLH

SEQ ID NO: 130830 - protein, 398 aa, Glycine max
  Coding DNA Sequence Number=SeqID_39145
  Homolog annotation: Hit_ID=Q6WAY6; Match level="QueryCoverage=65%, HitCoverage=43%, E-value=3e-26, Identity=33%"; Hit description =Putative uncharacterized protein
ELNRQKQVENGVVGIPRKCLEAKARILAGKGEWALFIDILALLIFGGVLFPNVDGLVDLAAIDAFLAYHDHKESPVVSMLADLYDTFDRRCEKSSTTIFCYTPTLYVWLVSHLFCQEVRHACPLESHRSCTEKGRANWDQLLANREGASVNWFPRWKEGITGVVISCGGFPNVPLDGGTRGCINYNPILAIRQLGYPMRGAPLEEELAPVISRGFNKTNMETLQKVRKAWEVVQKKDKELRGSNNGPISGYREWLKAHVQGLDWLPSLRTTKREEVEAPEEDEEVQALRTELEQAQTVKERFKSAALKIRKENTELRDVYVATTKALERETKRARREEHGRNKFRGALWGSNSELKLRREERDQSRVDSLILKDELKGLLEVQRKVCLSGYARQRPTC

SEQ ID NO: 130831 - protein, 258 aa, Glycine max
  Coding DNA Sequence Number=SeqID_39146
VLQRKDKELRGSNNGPIGGYRKWLKVHMQGLVWLPSLRTDKREEVEAPEEDGEVQGLRAEFEQTQTVKERFKSAALQIRKENAELRDINIATTKALEQETKRARREEHGRNKFRGALWGSNNELKLRREERDQSRVDSLILKDELKVCSRSKRNLSQRLCETETNMLDIINKYQEKLNLAMAHEHRVADEYAQVYTVKEARGRVIDSLHQEATMWMDRFALTLNGSQELPRLLAKAKAMADTTPPPRRSTNFSAIVGI

SEQ ID NO: 130832 - protein, 226 aa, Glycine max
  Coding DNA Sequence Number=SeqID_39147
  Gene Ontology: Biological process=transposition, DNA-mediated
  Homolog annotation: Hit_ID=Q6UUU1; Match level="QueryCoverage=26%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130833 - protein, 68 aa, Glycine max
  Coding DNA Sequence Number=SeqID_39148
EIAPKKLSTKRSRKDATGEDSSAALEFDSHWFRSAEHQQHFEAIKGWSFHRERRVQLRRMSTLTTRVR

SEQ ID NO: 130834 - protein, 155 aa, Glycine max
  Coding DNA Sequence Number=SeqID_39149
  Gene Ontology: Mol. function=endonuclease activity
  Homolog annotation: Hit_ID=Q9AY32; Match level="QueryCoverage=40%, HitCoverage=95%, E-value=7e-27, Identity=96%"; Hit description=RRNA intron-encoded homing endonuclease
MEGKSGASSRVKKLVVGPWVGSIGPPPVCTGRLVPSAGDALLSLTGRVVPPHGITPQDSDPIVLAFGIGVMINRDSRGHSYFIVRERKLGARRRSDTVLVSTINDADQGSADVAFRTPLAPYEKSKSLGSGGSMVARLKLKGIDGRAPPGVEPAA

SEQ ID NO: 130835 - protein, 294 aa, Glycine max
  Coding DNA Sequence Number=SeqID_39150
  Homolog annotation: Hit_ID=Q6WAY6; Match level="QueryCoverage=100%, HitCoverage=47%, E-value=8e-24, Identity=30%"; Hit description =Putative uncharacterized protein
RGEWAPFIDILALLIFGGVLFPNVDGLVDLAAIDAFLAYHDHKESPVVSMLVDLYDTFDRRCEKSSTRIVCCTPALYVWLVSHLFRQEVRHACPLESQRSCTEKGGANWDRLLANKEGASVKCFPRLKEGRTGVLISCGGFPNVPLMGTRGCISYNPVLAIWKLGYPMRGAPLEEELVPVISLGFNNTNVETLQKVRKAWEVVQKKDKELRGSGPIGGYRKWLKAHVQGLDWLPSLRTAKREEVEAPEKDKEVQALRAELEQAQTVKERFKSAALKIRKENAELRDINIATTKA

SEQ ID NO: 130836 - protein, 145 aa, Glycine max
  Coding DNA Sequence Number=SeqID_39151
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MAFHYSLFLSREGSSSSPADPLFMRHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 130837 - protein, 103 aa, Glycine max
  Coding DNA Sequence Number=SeqID_39152
  Subcellular localization annotation: CTP_CleavageSite=85; ConfidenceScore=5.78e-01
TYNCQQLPVSASTPSLSQIPSYNSLSAPSVPPDFSATSLNQTSPESTSCHPQSSNIVSSSESIPTAPSPTHPQSSNTMSHSESVSASTPIPINTLPMETRSKS

SEQ ID NO: 130838 - protein, 122 aa, Glycine max
  Coding DNA Sequence Number=SeqID_39153
  Subcellular localization annotation: CTP_CleavageSite=99; ConfidenceScore=5.21e-01
MTLPLSNILSNDHNADLPLQKYQLGSRPQDTQWTRRSPTGPWGFQLGLRASVSPTGCPSPPARDHARKTPSGPREVQQGLRFYEVPVAPNKVIRPPINRAFIKKYCAPRQAHDETPQQPGDG

SEQ ID NO: 130839 - protein, 124 aa, Glycine max
  Coding DNA Sequence Number=SeqID_39154
MGETHEIPHHNLADFEPWLGYATEGQAVGGIPFENTLEGPQFRPQPQPLHFAVGRAPPAMAEKGKADHLKERLRAIEGEHVQKGGQIFKEHAQKVEGSGGPGGTPNDGKGDDNRDGRHIIDTLL

SEQ ID NO: 130840 - protein, 71 aa, Glycine max
  Coding DNA Sequence Number=SeqID_39155
MKVEQIFVCHHISKERKVPLATLSFQGEWRIHGDPLVEYWNDLKSALRKRHIPSYYEGSLWTSSKGLDKGV

SEQ ID NO: 130841 - protein, 365 aa, Glycine max
  Coding DNA Sequence Number=SeqID_39156
MSFTKGKMCVTEIAPKKLSTKRSRRDATGEGSSVASKFDSHHFQSAEHQQCFEAIKGWSFHRERRVQLREDEYPDFQREIACRHWARLVTPMAKFDQEIVIEFYANAWPTEEGVRDMRSWVRGHWVPFDAYAISKFLGDPLILEEDQQCEFSQRRSQVDGFDEEAIAQLLCISVQDFTQTAAGKWVWIMRTSMTTLTQIWMTLLLSNVLPSDHNSDLPLPKCQLVNGAYLGFSALITGLFQSYGVPVTPSKVIQPPITRPFIEKYCTPRQAQGDAHQDAGAPPPPRQADSAGPLGVERYLQHLVRQQAANQRGQVQIHECLYRFSLSPDAQAGEEPAGSPGEVDESRMDEDMTDLLGFLGGSGAT

SEQ ID NO: 130842 - protein, 80 aa, Glycine max
  Coding DNA Sequence Number=SeqID_39157
MIIIKTSKPIASTEATSEPPALVVDLPSPQHTADPSTPMLEIPTTPVLAMDTSPPATPVLHLKDEEDVQTKNTQDQSQEF

SEQ ID NO: 130843 - protein, 161 aa, Glycine max
  Coding DNA Sequence Number=SeqID_39158
  Pfam annotation: Domain name=G-patch; Domain location=1-42; Score =20.7; E_value=0.00059; Accession=PF01585.14; Description=G-patch domain
MVARVILGNGYKPGMGLGKNNCGRINLVNTRGNRGKFGLGYKPTQADIRISVAGRKSRSQGSQLGRQVEGDPPCHISSCVISAGLGHEGQVVAICEDDSPSGSDDESLEGTNTWDPTIDFKQEADQTESEEDEDVGLPPELEKIVTHEDQEMGPHQEEHET

SEQ ID NO: 130844 - protein, 79 aa, Glycine max
  Coding DNA Sequence Number=SeqID_39159
  Subcellular localization annotation: CTP_CleavageSite=47; ConfidenceScore=5.51e-01
MGQMIPACKSLVTSFFTTSRSTGLSHCCGCLTGLAPSSKTLATTFPLAQQQGEAEMITRNFSLSSKEAHLRVASKGFNS

SEQ ID NO: 130845 - protein, 89 aa, Glycine max
  Coding DNA Sequence Number=SeqID_39160
MLQDKHINYLSQPTISRAREARLTGASSKGGKCAELPPTFISGKRQKNRRKPVMKNIPDSGVVFTLEEGRQKRGSCSYVPSIEEEIRPT

SEQ ID NO: 130846 - protein, 103 aa, Glycine max
  Coding DNA Sequence Number=SeqID_39161
MGRVYQGSAVVHNTPLLPGQVKVSVEEVTDADAPIPVPTDEVFLVGQTLHTFLAWPTHLVKSLSQQVALSLAKPPPKPDPEADDLLYLMTLTIPELFLEALSG

SEQ ID NO: 130847 - protein, 69 aa, Glycine max
  Coding DNA Sequence Number=SeqID_39162
MLRDFYFQNNYPLSQRALRGRARARLTGALSKGGKMRGVATNVYLWETLEKPKETGQNENSKFGSCIYA

SEQ ID NO: 130848 - protein, 69 aa, Glycine max
  Coding DNA Sequence Number=SeqID_39163
MCNLRKTNALPLLRLNEMTPQPSCMKFFRSYEASTPMLVSALIPWMVVLMPLMLALQAWIPASLSLKRI

SEQ ID NO: 130849 - protein, 93 aa, Glycine max
  Coding DNA Sequence Number=SeqID_39164
MATMMEAMTSMKKILEANAVIVAATSTVAKANPMPPSGLKQIAPPAMPEKGKVNHLKERLRAIEGGEDYAFANLEELFLIPKHGHSQVQGAGL

SEQ ID NO: 130850 - protein, 289 aa, Glycine max
  Coding DNA Sequence Number=SeqID_39165
MAGQTDNADIVGKIFPAKLRAETEILRFLQQLLLQLHIAEGLTVLVACGRQVVIIAGGSQLNGLQRRFRRGAANHKGDVVRRAGRGTEEVGFVGRAAAFCHAEEFVFVAVDAVEIDLCRQVGAGVHLFIHIQRGVLGVAQVIFDVGVVHALAQRSFIAAAGPDALAFFTHDDCRAGILTGWQHAFGRDFRVAQELQGDVFIVLARFRVVENSGNLLLVRRAQHKGRIVECLLCQQGQRFRLDLQDLLAFELGNGDVLFGQQIVFGVVMGEREGVLINKRFIRHSIAPQK

SEQ ID NO: 130851 - protein, 92 aa, Glycine max
  Coding DNA Sequence Number=SeqID_39166
MPISPCRCIGIVPTRCPVGPKKSNGALGFPALVTGLCQSYRLPIPPARSCHRDIRIEPARHLVDPKKSSRVLELSSSNYGSLTSSKGIRPLY

SEQ ID NO: 130852 - protein, 238 aa, Glycine max
  Coding DNA Sequence Number=SeqID_39167
  Homolog annotation: Hit_ID=Q6UUU1; Match level="QueryCoverage=25%, HitCoverage=40%, E-value=3e-18, Identity=78%"; Hit description =Putative uncharacterized protein
YIEQLTEMPQNVLTMPLGYINGVGTSYVPINVSFSPKVGPGLPAVPPVQLLTGWCVTAKAPPDISAGKCSGRVPFAIQAAQLLGRAIGAGLFAITPAGERGMCCKAIKLGHVNLTISQSRVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130853 - protein, 59 aa, Glycine max
  Coding DNA Sequence Number=SeqID_39168
MEDLINKTQFSPKIIPTSSHRLGGSTKESHFTYSTTIILLPRTKVRDHHRSNHTVQKLR

SEQ ID NO: 130854 - protein, 233 aa, Glycine max
  Coding DNA Sequence Number=SeqID_39169
  Homolog annotation: Hit_ID=A5C169; Match level="QueryCoverage=57%, HitCoverage=11%, E-value=9e-08, Identity=28%"; Hit description =Putative uncharacterized protein
DGIIISEVHQSLFFPLTNLPSQGAPFEGTIVNDWKFDYSSHDARRMVCNDQAEMIGRLLAESLTFDNRIMHYIIVRILLPRSSNLAQVSEEDLILMWAFLTGRQIDWAHLVRYRMHKALRANAPLPYPHLITLFLRHFQIPLDDEPFVQVKRSFAIGAGAVTSFGYRKDRNGQWLKKDALLPQDERTPSPLPQRDDSALMNEVLSELRGLRSYVGDRFDSLDTRFAGMDIRLT

SEQ ID NO: 130855 - protein, 89 aa, Glycine max
  Coding DNA Sequence Number=SeqID_39170
RTQGLDWLPNLKTVRDNEVKASEECDEVQALKAKLERARVVKEKFKAAIVSSSSEDVKGIIMGQRHDLEGRAKSLPQVEKKFVPTVKRD

SEQ ID NO: 130856 - protein, 67 aa, Glycine max
  Coding DNA Sequence Number=SeqID_39171
MVLASCVRVIPLWERGLEDLFGSYHDQMFLVALELPARRVVFGVGTWGASLWVGVLGCIGAELEAFP

SEQ ID NO: 130857 - protein, 134 aa, Glycine max
  Coding DNA Sequence Number=SeqID_39172
  Gene Ontology: Mol. function=chitin binding; Cellular component =extracellular region; Biological process=chitin metabolic process
  Homolog annotation: Hit_ID=UPI00006A17C9; Match level="QueryCoverage =50%, HitCoverage=69%, E-value=6e-08, Identity=37%"; Hit description =UPI00006A17C9 related cluster
  Subcellular localization annotation: CTP_CleavageSite=47; ConfidenceScore=5.74e-01
MARACSPLKVRTCSPLMARACSPLKVRTCGPLKVRVCSPTKVRTCSPQMARACSPLKVRTCSPLMARACSPLKVRIDYPFEKGDNSCNLYPIFLQISPGNSPQSEGTYWVNTSNLPLGSLEVFAWCLSLPQCRA

SEQ ID NO: 130858 - protein, 59 aa, Glycine max
  Coding DNA Sequence Number=SeqID_39173
GQDHLGLPSGVETKHERQKPIKVLKDERKRGWGHDRPIVALLCAKQAGNAWASHPCTKL

SEQ ID NO: 130859 - protein, 106 aa, Glycine max
  Coding DNA Sequence Number=SeqID_39174
MCKKEHESFKECAQRWRDLAAQEKMMGYMPSSFVDLVFAGEKIQVGLRRGKFDCPALMNRKPEANGENKEGGTHVVTVISTWPNFPLAQQYQYSASIIPSHYPPPY

SEQ ID NO: 130860 - protein, 226 aa, Glycine max
  Coding DNA Sequence Number=SeqID_39175
  Gene Ontology: Mol. function=arylesterase activity; Cellular component=plasma membrane; Biological process=antibiotic biosynthetic process
  Homolog annotation: Hit_ID=A7MRG8; Match level="QueryCoverage=92%, HitCoverage=76%, E-value=8e-94, Identity=79%"; Hit description =Putative uncharacterized protein
  Pfam annotation: Domain name=Abhydrolase_1; Domain location=48-226; Score=14.0; E_value=0.00038; Accession=PF00561.11; Description =alphabeta hydrolase fold
MATFKAKDGTQIYYKDCGAGKPVLFSHGWPLDGDMWDSQLNYLAERGFRAIAFDRRGFGRSDQPWNGYDYDTFASDINDLITTLDLQDVTLVGFSMGGGDVTRYINNYGSARVAGLALLGAVTPIFGKSATFPQGVDQSVFDGIRDGLRKDRAQFISDFATPFYGINAGQTVSAGALTQTLNIALLASLKGTIDCVTAFGETDFRPDMAKSTCDAGHSRQHDRSCV

SEQ ID NO: 130861 - protein, 126 aa, Glycine max
  Coding DNA Sequence Number=SeqID_39176
  Homolog annotation: Hit_ID=Q84VH6; Match level="QueryCoverage=61%, HitCoverage=4%, E-value=6e-08, Identity=39%"; Hit description=Gag -pol polyprotein
MGVKAMDDIKADVPLHLKKSECEKDFHVNFRSEYQRVNKESEVLRAADQRTHCYLWTPQETSYSSTCFLYPPKKMKSEYGIKDWTSLHLRGIRRSLQRSGGFENRRRHMKRRSSERLNRRSRFSEL

SEQ ID NO: 130862 - protein, 115 aa, Glycine max
  Coding DNA Sequence Number=SeqID_39177
MVLGRKTKMFVDPQNANMATLAEVAETLQYMVSPQGRNTWTVDDLVPYVEKITILFEEQERIIEPVSHGPASKRQFPAQQFHILQSSVETQGTDRRREAVEAEEYSQQMAERGHG

SEQ ID NO: 130863 - protein, 93 aa, Glycine max
  Coding DNA Sequence Number=SeqID_39178
KGPVTKAMSKRLQENWARVTEEGPRGSHEPQGRFQSPWAKVEGELSYLMGVSSPLLASQGSFLPCILRKLPSLLLKEASHCIILAWGELSYWR

SEQ ID NO: 130864 - protein, 271 aa, Glycine max
  Coding DNA Sequence Number=SeqID_39179
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVTFIVTTVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 130865 - protein, 192 aa, Glycine max
  Coding DNA Sequence Number=SeqID_39180
KYNYQAEFEITEASVSRTKRKLLQTVSERWRQFKSDLTRKWALAADQDGVEDTVCEKYDISKEKWAQFCQTRRDPSWEKLLDEKTKKKLEEAAQSGSVDGAIDPPFPVRRHVKWKMARMKKIGEMMIEVAKEIAEKIDSFEEQATQGSLEKTWTSGCSHRCYWTSRAPWMCPCCWSRCHHQAILWIDSTDVL

SEQ ID NO: 130866 - protein, 113 aa, Glycine max
  Coding DNA Sequence Number=SeqID_39181
MSKSCGFGMTGPLDESISCFLIRVDPWVLVPITFRGLHVLANRGLHALTFRGLHVLALRGLHALTLVTLTVERTTRPHLERTTRPHHQRAARPHLQRTTCPRLERATRPHLGY

SEQ ID NO: 130867 - protein, 58 aa, Glycine max
  Coding DNA Sequence Number=SeqID_39182
MATTNASATYAILFEYLKQLVVIKEPIFATEQCMPYLRSTGWYTGYPHHTTPRTNGQA

SEQ ID NO: 130868 - protein, 127 aa, Glycine max
  Coding DNA Sequence Number=SeqID_39183
MGEVEEVQEQMKADMEVMKEKMATMREAMMSMKKIMEANAVAITTTSIVAKVNLTPPSGLNQMNNPTSDMVGKDLGSTCGPHYVQIQNKHAFPPYGLPPDYTPPNVAYTPNKNVNNSTPIIIESQQP

SEQ ID NO: 130869 - protein, 110 aa, Glycine max
  Coding DNA Sequence Number=SeqID_39184
MGTNQTGKRFYQVKVKSLDTTSIKELGRLMEPLQMQAFRKTYGKILELTIAEQRGVYLVKMGVQIAPRPTWALQNIPPEGGCFWRKQPCSPGRAELAWASWAATTSPILL

SEQ ID NO: 130870 - protein, 56 aa, Glycine max
  Coding DNA Sequence Number=SeqID_39185
MWYHFQWKNLVGHLGVHDKTGLTMGKSGLDFEESVRASLMEACLWSFYGGWIFELQ

SEQ ID NO: 130871 - protein, 163 aa, Glycine max
  Coding DNA Sequence Number=SeqID_39186
  Subcellular localization annotation: CTP_CleavageSite=87; ConfidenceScore=5.60e-01
MRACSPLKARTCSPLMVRACSPLMVRTRSPLKARTCSPLNGEVPKVRACSPLKARTCSPLKVRACSPLLARTCSPLKVIGTSTQGSTLMRKQEIDSSRGPVHPYEIARDPQWSRQLSQPTLRREGDARLAGCVFHERNTREVATNVYLRKTSEKPEKTRSTNF

SEQ ID NO: 130872 - protein, 39 aa, Glycine max
  Coding DNA Sequence Number=SeqID_39187
MKEKKELVLWVLQKVRGGGGQQQRWSENDDGRQLVGHVS

SEQ ID NO: 130873 - protein, 151 aa, Glycine max
  Coding DNA Sequence Number=SeqID_39188
MTRSKRFMEAEDEDSVVHKKKTADKKGTDDKKNEVRGESNQEKEEQIMVNNNELKDQENEKEEKNNKNAKKGRSEKAVDEGVEVPYPVETGNNHVSQPTLLRASEARLTGASSIRGKCAESPPTFIERKMLEKPKEIGHEEYSRFGSYLYV

SEQ ID NO: 130874 - protein, 295 aa, Glycine max
  Coding DNA Sequence Number=SeqID_39189
  Gene Ontology: Mol. function=metallopeptidase activity; Cellular component=membrane; Biological process=proteolysis
  Homolog annotation: Hit_ID=A1FXV7; Match level="QueryCoverage=98%, HitCoverage=38%, E-value=1e-120, Identity=77%"; Hit description =Endothelin-converting enzyme 1
  Pfam annotation: Domain name=Peptidase_M13_N; Domain location=103 -295; Score=-3.6; E_value=2.5e-09; Accession=PF05649.4; Description =Peptidase family M13
  Subcellular localization annotation: CTP_CleavageSite=49; ConfidenceScore=5.06e-01
MTFDTLAGQAGGVSFGPRPSPRPFPDSLGLEAIKVTRTPKIVLLTLAVSAALVGCGKNETPAKDATASTPAAAEATQYTLDESKLPAYNAFQPSDLDTSKDACGAFGDYVNSKWLAANEIPGDRTSWGAFTILDERSVAVQHQLAEQVAQVKNPNHIEKIVGDLWATGMDEAKINAQGIEPLKADLTAIDGLQDKAAIADYLRSSAAKGDNVLFGFGAEADFKNSAVNLAYASQGGLGLPDSTYYTDAKNADKLKAYQAHVAKVLELSGVAAADAAKQAEDVVKFETRLAKPPIA

SEQ ID NO: 130875 - protein, 602 aa, Glycine max
  Coding DNA Sequence Number=SeqID_39190
QPDVPGLGRADGVVVRIAASQIQRQAADARDVGQQRDVGFGEHFLDVVRTATAVDGVEEGGTGGCQRIGTLLALLLAVLGAGRNADITGRQREQRVVAHRRAEHGLLQFAEVVRTGIEPVGRILRHGAITEDAEGNAARTDQVAVVSAATGIGVGGIGIAVDTADDLAAGIADCVQTGLPALVDAVVDVDAVDLGLAIVARGLVAPVVTEHAFHAEDEALGLALDFLAAAARVDIESGYLQLGQTVGIHQGAQLRADESIVATDADGVVESGLAEEGRFRLGVLAFEEQAVLVVQVEVGDGVDAQAVELRLQVGNSVQIGEVTVDARGRADHWPIETVAAEAAIRIEVIAVLVGVGLGEIERATGLERTAVGGGVVAARAGQDGLRVALARRLGAIEIRIGHGHVVAFTDRTVATAETILLAVLDRHGDIASAVGEIGARGSRHEAAIEAAFARNTLLRAGLEALVVLLHDEVDHAGHGVGAIDGRCAAGDDFNALDPLHRDGVDVDRGAAGIGTDMATAVDQHQGTVVAHAAQVHQAQAGGTDVASGVAEGERRCQLRHLVHQVADGQRAGLADFFGGDGGNRRGCHEARTRDARAGHADP

SEQ ID NO: 130876 - protein, 153 aa, Glycine max
  Coding DNA Sequence Number=SeqID_39191
  Homolog annotation: Hit_ID=A0PAV3; Match level="QueryCoverage=24%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSILLTVESLKDVPGRKGKPCTGLDTIAAGTTAATSSLSIPSTSRGGPVPAFVPFSEG

SEQ ID NO: 130877 - protein, 234 aa, Glycine max
  Coding DNA Sequence Number=SeqID_39192
  Homolog annotation: Hit_ID=UPI00006A2D9E; Match level="QueryCoverage =72%, HitCoverage=97%, E-value=4e-13, Identity=17%"; Hit description =UPI00006A2D9E related cluster
MHALTFRGLHVFAFRGLHALTFRGLHALAFRGLHVVAFRGLHALTFKGLHALAFRRLDALAFRGLHVLAFRGLHALAFRGLHVLAFRGLHALTFIGLHVLTFRGLHALTFRGLHVLAFRGLHALVFTGLHALAIRGLHILAFKGRHVLDFRGLHALTFRGLRVLTFSGLHIHTSLGHPPDLGGGPTVRAQPKGGYRAATVHTRARFHPCRCKETKADHAHQHDHSYTDMDNVVT

SEQ ID NO: 130878 - protein, 79 aa, Glycine max
  Coding DNA Sequence Number=SeqID_39193
MAVGYDVCMIHDLEGELYVHDFEGETAADDDCCKLLEDAAIFQKKIDLLQHQAVAAQKRKLLYNHGGCTSSVPSPGLKC

SEQ ID NO: 130879 - protein, 84 aa, Glycine max
  Coding DNA Sequence Number=SeqID_39194
MVAITLAKVHQPPFIREYDSNATCACHGEAPGHSIEHGRALKRKVQECGCKPLVCLLKRPVLLSLDFQDRSIRDYSSCTLVGVP

SEQ ID NO: 130880 - protein, 197 aa, Glycine max
  Coding DNA Sequence Number=SeqID_39195
  Homolog annotation: Hit_ID=Q6WAY6; Match level="QueryCoverage=23%, HitCoverage=8%, E-value=2e-09, Identity=60%"; Hit description =Putative uncharacterized protein
MDQLQRQAFRKAYGKIWDLAMVEVSTGAIASLAQYYDQPMRCFTFGDFQLSPMVEEFEEILGCPLGGRKPYLFSGFTPFSPRGEACLPARKPLFMHRERRGKLGPLLASKEGAFVNWFPRWKEGRTGVLISCGGFPNVPLMGKRGCISYNPVLVRRQLGYPMRGAPQGEEHGRNKFRGALWGSNSKLKLRREERDQS

SEQ ID NO: 130881 - protein, 243 aa, Glycine max
  Coding DNA Sequence Number=SeqID_39196
  Pfam annotation: Domain name=RRM_1; Domain location=39-109; Score =23.5; E_value=0.00079; Accession=PF00076.13; Description=RNA recognition motif. (a.k.a. RRM, RB
MKVMQKSSLAGRQSQNLEIGDNNRHYRLNWRNNADITSFYFTHFPDEANEELLWRHFKNWGDVREVYIAKRLNKDGRRYGFMRFKGVSDAKGLEVRLDNIFINDCKLFVNLPRGGCQGDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFLIQVWEMKNLRRL

SEQ ID NO: 130882 - protein, 92 aa, Glycine max
  Coding DNA Sequence Number=SeqID_39197
MTGPLHESISCFLIRVDPWVLVPITFRGLHVLAFQRTTCPPSEDYTSSPSREDSIRPHLPKDYASSPSEEYTSSPSDGLHALTFKGRHVLNF

SEQ ID NO: 130883 - protein, 94 aa, Glycine max
  Coding DNA Sequence Number=SeqID_39198
MEAIKEQMATMMKAMISMKKIMEANVVIVAAISAVAKYGPHDVQIQNEHAFPPYGLPLNYTPPNVAYTPNKNVNNSTPIPIESQQPQTDHAHVS

SEQ ID NO: 130884 - protein, 631 aa, Glycine max
  Coding DNA Sequence Number=SeqID_39199
  Gene Ontology: Mol. function=porphobilinogen synthase activity; Cellular component=chloroplast; Biological process=tetrapyrrole biosynthetic process
  Homolog annotation: Hit_ID=A6T598; Match level="QueryCoverage=53%, HitCoverage=87%, E-value=1e-179, Identity=92%"; Hit description=Beta- lactamase/D-ala carboxypeptidase, penicilling binding protein
  Pfam annotation: Domain name=ALAD; Domain location=341-631; Score =634.8; E_value=7.5e-188; Accession=PF00490.12; Description=Delta -aminolevulinic acid dehydratase
  Pfam annotation: Domain name=Beta-lactamase; Domain location=1-322; Score=217.4; E_value=3.5e-62; Accession=PF00144.15; Description=Beta- lactamase
  Pfam module annotation: Pfam domain module=ALAD::Beta-lactamase; Domain location=341-631::1-322
MAMVVIDGNQRVFRSFGETRPGNNQHPQLDSVIRIASLSKLMTSEMLVKLLDQGLVKLDDPLSKYAPPGARVPTYQGVPITLVNLATHTSALPREQPGGAAHRPVFVWPTRQQRWNWLSTATLKTTPGSQAAYSNLAFDLLADALSTAAGKPYPQLFEEQITRPLGMKDTTFTPSPDQCQRLMVAEKGASPCNNTLAAIGSGGVYSTPGDMMRWMQQFLSSDFYTRGQQADRMQTLIYQRTQLTRVIGMDVPGKADALGLGWVYMKPKNGHPGIIQKTGGGGGFITYMAMNPQANVGVFVVVTRSALTRFSAMSDGVNDLVSALSGVQPNMETASQQTMTDLITRPRRLRQSASLRAMFEETTLSLNDLVLPIFVEEEIDDYKAIEAMPGVMRIPEKHLAREIERIANAGIRSVMTFGISHHTDATGSDTWNENGLVARMTRIAKQAVPEMIVMSDTCFCEYTSHGHCGVLCEHGVDNDATLENLGKQAVVAAAAGADFIAPSAAMDGQVQAIRRSLDAAGFTNTAIMSYSTKFASSFYGPFREAAGTALKGDRKTYQMSPMNRREAIRESLLDEAQGADCLMVKPAGAYLDILRDIRERSNLPLGAYQVSGEYAMIKFAAQAGAIDEEKV

SEQ ID NO: 130885 - protein, 84 aa, Glycine max
  Coding DNA Sequence Number=SeqID_39200
MANMALVKRQNFQLIRATYAFWMKNNVSIGEGEGSTGFNKNRRKSLKVYQSHTGEKVASAQDFGWQSKGEDHFRSWFPFILFTW

SEQ ID NO: 130886 - protein, 147 aa, Glycine max
  Coding DNA Sequence Number=SeqID_39201
MDYGLWLQKGNWEIVEASGNRLPVCVIDYTEEWVTGNRLPDRDGGAANPMTRVEMECLEGAWETTRRQHEVPISGHDSIYGYFIGASQMNPCARFQRTVRVDTTPRLTPIPSKWEPVQSDRGERHPRKDPEEDPRGATSLSLLWMHL

SEQ ID NO: 130887 - protein, 35 aa, Glycine max
  Coding DNA Sequence Number=SeqID_39202
QAQGETPQQPRDGRQQATDTLPPPLEFTSAHPQKG

SEQ ID NO: 130888 - protein, 119 aa, Glycine max
  Coding DNA Sequence Number=SeqID_39203
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=100%, HitCoverage=26%, E-value=2e-57, Identity=81%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=23-118; Score=-112.4; E_value=0.042; Accession=PF00361.11; Description=NADH -Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGIGFKLSPAPSHQWTPDVYEGVRFVR

SEQ ID NO: 130889 - protein, 243 aa, Glycine max
  Coding DNA Sequence Number=SeqID_39204
  Gene Ontology: Mol. function=phenylalanine-tRNA ligase activity; Cellular component=cytoplasm; Biological process=phenylalanyl-tRNA aminoacylation
  Homolog annotation: Hit_ID=A7MNY8; Match level="QueryCoverage=100%, HitCoverage=30%, E-value=1e-116, Identity=86%"; Hit description =Putative uncharacterized protein
  Pfam annotation: Domain name=B3_4; Domain location=1-152; Score =297.3; E_value=2.9e-86; Accession=PF03483.8; Description=B34 domain
  Pfam annotation: Domain name=B5; Domain location=170-238; Score =113.3; E_value=7.2e-31; Accession=PF03484.6; Description=tRNA synthetase B5 domain
  Pfam module annotation: Pfam domain module=B3_4::B5; Domain location =1-152::170-238
MREKLRRCGIRSIDPVVDITNYVLLELGQPMHAFDLDRIDGGIVVRMAKEGETLTLLDGSEATLHSDTLVIADHHKALAMGGIFGGEHSGVNEATQNVLFECAFFDPLAITGRARRHGLHTDASHRYERGVDPALQHKALERATQLLLAICGGEAGPVIDQTDASKLPARATITLRREKLDRLIGHVIADEQVTDILTRLGCDVTVGNGEWQAVAPSWRFDMAIEEDLVEEVARVYGYNNIPD

SEQ ID NO: 130890 - protein, 137 aa, Glycine max
  Coding DNA Sequence Number=SeqID_39205
  Gene Ontology: Mol. function=RNA-directed DNA polymerase activity
  Homolog annotation: Hit_ID=A5AEG6; Match level="QueryCoverage=93%, HitCoverage=37%, E-value=1e-12, Identity=27%"; Hit description =Putative uncharacterized protein
MERYLPSKGVGGWLWALASTQDQLWARILISKYGGWADLNNGSDTPWHSHWWKDIRKVGDGSIVKFWKDKWLGVDSNLEQQFNRLFLISKQQTSSISNMGIMSHGHWCWDLKWRRNLFDHKQGAIVAFMEIISNVHI

SEQ ID NO: 130891 - protein, 117 aa, Glycine max
  Coding DNA Sequence Number=SeqID_39206
MGLPGTTTYPARVLLFGLSSSEISEAARQIAAVTWRRIDRDRRQQRLRRRWLIGDHHFAGGRRAPWQYRSPAGACRQRADAGNARRVPASGQRAPAARPRDAVPRRRPAGYVPAAAP

SEQ ID NO: 130892 - protein, 189 aa, Glycine max
  Coding DNA Sequence Number=SeqID_39207
MVEASGNRLPACVIDYTEEWVTGNRLPGMCNRLHRAFLHISCPEIVMAAQLIRDRVEMECLEGAWETLEGNTRCRFRGTIRFMATSLVHPDELARTLQRTVEWILPTPTPYRLVEPVQVIEVMSSEEDPEEDLEELPPEPAVDAIDFLEGDEDPLLEVDSPEEVMSASEADSTEDSGPGEMAISGGSSS

SEQ ID NO: 130893 - protein, 78 aa, Glycine max
  Coding DNA Sequence Number=SeqID_39208
MRDGKRSSYVIGIGVNSGVGFGGKFLIALEPVPKWALPAGRVVVGAGAWEASLWMGAGALGCTGTELEESPVRAEKLG

SEQ ID NO: 130894 - protein, 67 aa, Glycine max
  Coding DNA Sequence Number=SeqID_39209
MNVLSGATLFCKITRAPNIFMICVHKDSLGSDQGVPMNPKKIKDILEWPTPPSVEGRKAQSMKNLRI

SEQ ID NO: 130895 - protein, 40 aa, Glycine max
  Coding DNA Sequence Number=SeqID_39210
DWPEAQAGEVPAGAPDDVEEARMDEEMTELLGFLGGSRAT

SEQ ID NO: 130896 - protein, 312 aa, Glycine max
  Coding DNA Sequence Number=SeqID_39211
GIRKGVIGGYHGWLRIHAQGLDWLSKLKVIDEENFEAPEEDEEVRALTLELGKARLAKEKFKSAATHIRKECTELQEENAATAKALEQETKRARKEEYGREKFRGALWGSNNELKLRREERDRSRVHGMILKEELVACTRSKRSLAQHLEATEQSMLAIIGQYKEELNQSMAHEQKLVEDFAQVYAEKEARGRVIDALHQEATMWMDRFALTLNGSQDLPRLLAKAKAMAEEQMKADLSALKDQMASISEVMLKLQKTIEDKATTTASSTIREAEPVLQPTLNPGRDRNTAVFGRRYSPQAYPYGLPPDFTP

SEQ ID NO: 130897 - protein, 108 aa, Glycine max
  Coding DNA Sequence Number=SeqID_39212
  Subcellular localization annotation: CTP_CleavageSite=33; ConfidenceScore=5.40e-01
MNVLPKIKGISESSVMFMTTTSAGKVKCFTWTRTSSITSYGLVMERSVSYKVILVGIISNSPNLLHMESGIKLILAPRSMRAFPTETSPIEQGMVTLPGSLCFGGRIF

SEQ ID NO: 130898 - protein, 313 aa, Glycine max
  Coding DNA Sequence Number=SeqID_39213
  Homolog annotation: Hit_ID=Q2HW90; Match level="QueryCoverage=94%, HitCoverage=63%, E-value=2e-24, Identity=29%"; Hit description =Putative uncharacterized protein
MASQEEWVPFVDILALLIFGVVLFPNVDGLVDLAAIDAFLAYHHSKESPVVAILADLFDTFDRRCEKNSARIVCCLPALCVWLVSHLFQQDIRHPCPLQIYCSCVEKRRVDWDQYLAGIGGSTINWFPRWKEGKGGVLFSCGDYPNVPLIGTRGCINYNPALAIRQLGYPMRGAPTEESLSPFLVRDFGVQSLKVVQRVHKAWKSPLRKDKELRGIRNGIIGGYHEWLRVHTRGLDWLSKLKVINEENFKAPEEDEEVQALKLELGKARLAKEKFKSAATNIQKECTELREESVATARALEQETKRARKEEHG

SEQ ID NO: 130899 - protein, 38 aa, Glycine max
  Coding DNA Sequence Number=SeqID_39214
GGLRIWALAEVYTGLTMLALMEGVSEGASCGREKKGCT

SEQ ID NO: 130900 - protein, 76 aa, Glycine max
  Coding DNA Sequence Number=SeqID_39215
MTRKTLLSRLSVYWLIWKRLYNHEGNINEAFNNEGAPAQVSNEGDVRPLAERYSTLLKDNRGKGPIEPMKGLRCEK

SEQ ID NO: 130901 - protein, 226 aa, Glycine max
  Coding DNA Sequence Number=SeqID_39216
MAFKRKVQSLIEAGWLTFQEDRPNVKTNPLANHGGGAVNAVESGRPCRSKPLKDVTTPRRFIYEALQNGGMIPHGGLEKGSCLMHPGAPHSIEACLAVGDLLQQMIDQRGDTTPQMSRHLSVVRPIPFPYKNSHAVPWRYVPPSKRKEGATDTSSLSAKVTNITGLSGMTLSGCVFAPPDLSTQPANAKGKARMTKGQNVKVIPAPDEDVPMKGLYEGRDGRDKKE

SEQ ID NO: 130902 - protein, 233 aa, Glycine max
  Coding DNA Sequence Number=SeqID_39217
  Homolog annotation: Hit_ID=Q6WAY6; Match level="QueryCoverage=81%, HitCoverage=34%, E-value=1e-09, Identity=26%"; Hit description =Putative uncharacterized protein
DYPNVPLIGTRGCINYNPALAIRQLGYPIRGAPTEESLSPFLVRDFGAQSFKIVQRVHKAWESPLRKDKELRGIRNGIIGGYHEWLRVHTRGLDWLSKLKIINEENFEAPEEDEEVQALKTELGKARLAKEKFKLVATDIRKECAKLREENAATARALEQETKRARKEKHGRDKFRGALRGSNNELKLRREERDQSRVHGMILKEDLAACSRSKRSLALHLEGMEQSMLAIIG

SEQ ID NO: 130903 - protein, 151 aa, Glycine max
  Coding DNA Sequence Number=SeqID_39218
MTLLLSNILPNDRNANLPLQKYQLVCVVPTWGSHPQDTQWTRKSPTGPWGFQLWLRASISPTGCPYPPGKGSHLQDTQWTRRSPTGSWSCQALITGLCQFYGVPVTSSKGIRPPTNRAFIKKYCAPDRRRAKHHNSIGMVGSGKQTHRHHL

SEQ ID NO: 130904 - protein, 140 aa, Glycine max
  Coding DNA Sequence Number=SeqID_39219
MQGLDWLPSPRTAKREEVEAPEEDEEVRALRVELEQAQTIKEREEHGRNKFRGALWGSNSELKLRREERDQSRVDSLILKDELEVCLRSKRSLSQRLCETETSMLAIVRKYQEELNLSTAHEHKVADEYARVYVEKEARG

SEQ ID NO: 130905 - protein, 167 aa, Glycine max
  Coding DNA Sequence Number=SeqID_39220
MAPTRHPLDPDKSNKALGFPALITGLGQTFGVPVAPNKVIRPPITRAFIEKYCTQRQAQGDAPQAADAPPPHQVGPAGSFDTEQYLRHLVRQQAANYRAHSQGFTSFSCPTPDQFRAEVAWPGDWPEARAGEALAEAPVEAPDEADEAREDEEMTDLLDFLGGSGAT

SEQ ID NO: 130906 - protein, 131 aa, Glycine max
  Coding DNA Sequence Number=SeqID_39221
MTPVNRKAGTGERTREPPGGNAGIFIVLSGFATTDLSERVSNSCPGGSTSSRAAAIRGGSSNSPLISESVLSYSAGPSAFFLTNVRLGNTLAQLPNIVIAVEHIPLYASWRIAKGPHSIPGCRIKQLPQVS

SEQ ID NO: 130907 - protein, 429 aa, Glycine max
  Coding DNA Sequence Number=SeqID_39222
  Homolog annotation: Hit_ID=Q2HW90; Match level="QueryCoverage=75%, HitCoverage=69%, E-value=1e-29, Identity=30%"; Hit description =Putative uncharacterized protein
RFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMANQGDWVPFMDVLALLIFGVVLFPNVDGLIDLAAIDAFLAYHHSKESPVVAVLADLFDTFDRRCEKSSARIICCLPALCVWLVSHLFQQDTRHPCPLLSHRSCTEKRRMRLGPALGRDRRGCINYEGALAIRQLGYPMRGAPTEESMSPFLVRDLGAQNSKTIQRIHKAWETPLRKDQELRGIRNGIIGGYQEWLKVRIRGLDWLAKLKVVSEENFEAPEEDEEVQALKSELGKAKLAKEKFKLTATHVRKECAGLREENAITARALEPETKRARKEEYGRNKFRGAPM

SEQ ID NO: 130908 - protein, 70 aa, Glycine max
  Coding DNA Sequence Number=SeqID_39223
MPNNAPFKVCQISDIVEVESGTGAARIRERSQSFSLISLLILSPKLMLSVPPELLHLLSFTFLVQVYTVL

SEQ ID NO: 130909 - protein, 75 aa, Glycine max
  Coding DNA Sequence Number=SeqID_39224
MTGAKRKGELGYRGHESFYNNSRAHYNAYFEKRALKATRGTTFAERPRFCNQREISELQSDCEMLRRGRGIPLLA

SEQ ID NO: 130910 - protein, 169 aa, Glycine max
  Coding DNA Sequence Number=SeqID_39225
MASRKRKAPASVSQARYDRSRFVSQDAWDRYIDNVLGRKILPKGMREIERRNWHKELTNFSEGSIDMALVKEFYPNLYDLEDKSPKQWSSRKGESLPSYSRFYRLRPDPQELAAHLCIPGRGFELHADGLPLKILRKNLTTLVQTWSVLSFSNLAPTSHTSDITLDKTS

SEQ ID NO: 130911 - protein, 110 aa, Glycine max
  Coding DNA Sequence Number=SeqID_39226
MAEELLQGMMDKGLIEVCSARKGERDVCMQSYDKRPCKSKPLVIHFTRGVATQKPQGFQPVPIKKPTPFPYKSDKSVPWKYATQGPDRRKDASVVHVKDDLSSAKVTNMA

SEQ ID NO: 130912 - protein, 69 aa, Glycine max
  Coding DNA Sequence Number=SeqID_39227
  Gene Ontology: Mol. function=RNA-directed DNA polymerase activity; Biological process=RNA-dependent DNA replication
  Homolog annotation: Hit_ID=Q1AKH8; Match level="QueryCoverage=46%, HitCoverage=8%, E-value=1e-08, Identity=90%"; Hit description =Reverse transcriptase family member
MERRQTIRGRGRPKNTIREVIKKDLELNDLDRKNPSRGASVTFPWVITQRFSTVLRHSSFVLHCSSVFN

SEQ ID NO: 130913 - protein, 128 aa, Glycine max
  Coding DNA Sequence Number=SeqID_39228
MEEAAQSDSTDTVIDPPSPIRRHMKWKMARTKKTRQMTSKAAKEIADKIASQDFFVTHGCQDVLTAAIGRLEHPSRVRGARPGVMIKKYFGPASRTSRTSSSMASKDLEKLTQKIRDQLEESITKKVT

SEQ ID NO: 130914 - protein, 79 aa, Glycine max
  Coding DNA Sequence Number=SeqID_39229
LIRQIGKNVVFTFSLSQSAGLKPGEDELLGSLSAPLQVIKRTASAHPLSERNALSQNPLMRAKRFRFTLSARARTNPPI

SEQ ID NO: 130915 - protein, 272 aa, Glycine max
  Coding DNA Sequence Number=SeqID_39230
  Subcellular localization annotation: CTP_CleavageSite=43; ConfidenceScore=5.04e-01
GEFVPQGRQDILNTTIGIPDHGGRVRAAGSGVTISQYYGRTSRASTTSSISFTKEQLVEIVVTIREQVRNEIEEEKKRSLHAWKNELKDAIITDIFNGDKVSAPANFDLNVLGARVSTKESNAEIVVNPSGEEHVGRVTPPMGLYVQSQDCTKLVALGKIHDGPSTIHCVAYADDVVRVSVEKVIDGEAEVPLATSEIKYVRDVVNTFIAWPLPLHSGITPDKAANAAELNNDVPKQDPLHELIKTLVEIYDKPVEFVWDLTKFGIPNVKNA

SEQ ID NO: 130916 - protein, 98 aa, Glycine max
  Coding DNA Sequence Number=SeqID_39231
  Homolog annotation: Hit_ID=A1R9L6; Match level="QueryCoverage=73%, HitCoverage=27%, E-value=8e-10, Identity=45%"; Hit description =Putative uncharacterized protein
  Subcellular localization annotation: CTP_CleavageSite=50; ConfidenceScore=5.27e-01
MQTTFVSPHRNTDHHLHQPGGSGRPDDVQPRTGQSRRTVLTGAVWSMPIVAETGMTPIAVKSTTTRSLPWTSTNTSLPTLQMLDGGGRITASALVTPP

SEQ ID NO: 130917 - protein, 80 aa, Glycine max
  Coding DNA Sequence Number=SeqID_39232
MYSANGFSRFLKVEGTSTWVVVIENKRGYISCGSVQMEHTSIWLFKENKGGYIPCGSLLVKVFTRLKKDLKDRRLLGDWM

SEQ ID NO: 130918 - protein, 341 aa, Glycine max
  Coding DNA Sequence Number=SeqID_39233
  Gene Ontology: Mol. function=transcription factor activity; Cellular component=phosphopyruvate hydratase complex; Biological process =regulation of transcription, DNA-dependent
  Homolog annotation: Hit_ID=A4WEG6; Match level="QueryCoverage=86%, HitCoverage=100%, E-value=1e-141, Identity=85%"; Hit description =Transcriptional regulator, RpiR family
  Pfam annotation: Domain name=HTH_6; Domain location=56-154; Score =3.8; E_value=0.00045; Accession=PF01418.8; Description=Helix-turn -helix domain, rpiR family
  Pfam annotation: Domain name=SIS; Domain location=183-308; Score =33.7; E_value=6.7e-07; Accession=PF01380.13; Description=SIS domain
  Pfam module annotation: Pfam domain module=HTH_6::SIS; Domain location=56-154::183-308
PERLPDRTLRADLTRGGHLEFVRLVRADGRAGAVADCRASAAGGITVIRKEKGRVDVYGERFRARAHQLTPRLLQVARYIHDNREAVMEQTAMEIATQLKTSDATVVRAIQALGFAGLRDLKQTLEQWFGPVVTSSEKISSTVNTLTSDVNASIDFVLEGHQHTCEVLSQPHNRYAMAQAVSLLAQARQVALFGIGASGILAEYTARLFSRMGLPATPLNRTGIGLAEQLIALQRGDVLVMMAQKSAHREGQTTLREAKRLGIPTILLTNALDSRFSKEASVVIHVPRGGEKGKIPLHGTVLLCLEMLILSVAATEPQRTIRSMKRINELHRGLKPGKKSS

SEQ ID NO: 130919 - protein, 47 aa, Glycine max
  Coding DNA Sequence Number=SeqID_39234
MRKAWSSSCNLLQKEVNWMKMENIIVLASIDWARAVEEGPRDLMNLR

SEQ ID NO: 130920 - protein, 25 aa, Glycine max
  Coding DNA Sequence Number=SeqID_39235
MDTRLRVIGDPMNGIQWGWRSHPTL

SEQ ID NO: 130921 - protein, 93 aa, Glycine max
  Coding DNA Sequence Number=SeqID_39236
MQLIKHIIKPRNRVPILLNYVVDGPTICTHSPLIILLWHQQQRHTPLELVGLGSSSSMDSFASWIINGSGMEKEEREVTPLQGEDESRRSSPP

SEQ ID NO: 130922 - protein, 59 aa, Glycine max
  Coding DNA Sequence Number=SeqID_39237
CGSNAFQDYFDDAKESRVKQIPKFQESRFTIQESSFKNQDSRIKFQDSRFKNQEKTQSR

SEQ ID NO: 130923 - protein, 66 aa, Glycine max
  Coding DNA Sequence Number=SeqID_39238
MSASDHAILRDGTHQPTKKSLLQVVPSVVRLMKQADVFPLKKTLKKFIIWEINNDKGILKENFSGF

SEQ ID NO: 130924 - protein, 331 aa, Glycine max
  Coding DNA Sequence Number=SeqID_39239
  Gene Ontology: Mol. function=motor activity; Cellular component=cell projection
  Homolog annotation: Hit_ID=P15305; Match level="QueryCoverage=89%, HitCoverage=96%, E-value=6e-22, Identity=23%"; Hit description =Dynein heavy chain
GLQAHAFKGLHALTFRGLHVLAFNGLQVLAFRGLHVLPSRGLHALAFRGLHVFAFKGLHVLTFRGLHVLAFIGLHVLPPRGLHALAFRGLHVFAFRVLHVLTFRGLHVLTFKQMHVFTFRGLHALAFRGLHALTITGLHALAFRGLHSLTFRGLQALAFRGLHFLTLRGLHVLAFRGVHDLTFRGLHVLAFRGLHVLPFKGLHVLAFRGRHVLAFRGLHALTFRGLHVLAFRGLHVLTFSGLHVLALRELHDLTFRVLHTLAFRELHAVAFIRLHALYFRGLHVLSFRGLHVLGFRGLHVLAFRGLPDLTFRGLHDFTFRGLQVLTFRRLH

SEQ ID NO: 130925 - protein, 133 aa, Glycine max
  Coding DNA Sequence Number=SeqID_39240
RGKAPVDSTMFDLEIIKTERKNRKKKKQATPKTLGLSFSSDYLSTDKPLVENNMAKRGEGNIPPRRTLGDYAYQQGPKHYNSIVIPSFNNKVMELKPALLSLIGLHPFGGMDHKDPYTHLSTFMGTMQYYGSF

SEQ ID NO: 130926 - protein, 125 aa, Glycine max
  Coding DNA Sequence Number=SeqID_39241
MCYMGIVKDLYQQRTMRLGVYEQFKQRDPCWSFIQLLDYLKLVLLDEAEELMGLFQSHCFSLKTLFLFNPSYHRRIYFFRGGSYICGLLDHGRFPLGGQLRRAGGSEHPATAGHATEAGDVGHLS

SEQ ID NO: 130927 - protein, 175 aa, Glycine max
  Coding DNA Sequence Number=SeqID_39242
MQPVLNGLNEWNSRYERRVEQTLPQTGTLSLNSEYMRWYTRKIKVYVDPKHARRGLLGEIVETLYFMVSSVGRRVCTFDDLLPCTEKITLLYDEEDRILEAHEDAPSSQPQFEHQQFNILQRSVETRGLVRFQETVDSALYNFPSDARTTIWNVLHIAGIHPRTVVDAVDIFLPT

SEQ ID NO: 130928 - protein, 175 aa, Glycine max
  Coding DNA Sequence Number=SeqID_39243
MIMRSKDIYSSQDEATTSPSSSESEEAKGEESSEEIYPQEEGQPVMVNEECKEVSVSSKRLVKKESHFEIKTNIKETSPLRQPPHLLLCKKTLVSIATPLGLEVIPQVKKLLDEGLVRKSLNPCALLVPKIGVPTDPKRIKVIPNWPTPPSIREIWGCHDLTNFYKRCRGKDSKV

SEQ ID NO: 130929 - protein, 73 aa, Glycine max
  Coding DNA Sequence Number=SeqID_39244
  Homolog annotation: Hit_ID=UPI0000ECBAF8; Match level="QueryCoverage =56%, HitCoverage=48%, E-value=1e-16, Identity=100%"; Hit description= UPI0000ECBAF8 related cluster
MTYCNRLQVFVIDYRTNKPTGMQAWHWPSFYNVVTGKTLALPNLIALQHIPLSPAGVIAKRPAPIALPNSCAA

SEQ ID NO: 130930 - protein, 146 aa, Glycine max
  Coding DNA Sequence Number=SeqID_39245
  Gene Ontology: Biological process=transposition, DNA-mediated
  Homolog annotation: Hit_ID=Q1J7G7; Match level="QueryCoverage=28%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPICSLTWDKSQISERQVPHPWDEI

SEQ ID NO: 130931 - protein, 44 aa, Glycine max
  Coding DNA Sequence Number=SeqID_39246
MGVKYLEAVNRRLHATKQWSPDEIRGVALAPYVSSRCDEEFRST

SEQ ID NO: 130932 - protein, 110 aa, Glycine max
  Coding DNA Sequence Number=SeqID_39247
MQRIDVLNVSITYKHGSRNRNERGHWQLVVLCPTTNVIAWFCSLYVDHAIIISSAMKSANTTAKGTNNPATPKWIEVKSHVQSGGYECGYYVMHWMWNIVSGGLKNDWSM

SEQ ID NO: 130933 - protein, 110 aa, Glycine max
  Coding DNA Sequence Number=SeqID_39248
MIVLRATKILTKPTSEPCSGFHFERFDIYIAYFRKRAPTGAEKREELEPEKWHVNRGRILAFKRFQKKLFLPLPTLLFFFLSPPPLLPFEAPNLLIISTPNCKGKPFSES

SEQ ID NO: 130934 - protein, 114 aa, Glycine max
  Coding DNA Sequence Number=SeqID_39249
  Subcellular localization annotation: CTP_CleavageSite=76; ConfidenceScore=5.49e-01
MVFLRCSSGFCFYQLSSVQLLTGWCVTAKAPRTSALASVAVTLRVTTTPAALNAPLQGASHSPFRLRNCWEGRSVRASSLLRQLAKGGCAARRLSWVTPGFSQSRRCKTTASEL

SEQ ID NO: 130935 - protein, 51 aa, Glycine max
  Coding DNA Sequence Number=SeqID_39250
MTEARQKGVRKVNENENKREELATQLTQARKVASSRSNCLLEEESGRPKWA

SEQ ID NO: 130936 - protein, 242 aa, Glycine max
  Coding DNA Sequence Number=SeqID_39251
  Pfam annotation: Domain name=Transposase_23; Domain location=18-86; Score=-12.3; E_value=0.026; Accession=PF03017.5; Description =TNP1ENSPM transposase
MRRLLSTHVRLIIFAPIEPPMGLYVQCQDSIQLVALGKTYDGGSTIHNVAYADDVVRVSVEQVIDSDAEVPFPTSEIKCVKQALHTFIAWPTPLVKKIYIEHEGTGLTKDTEAVGPINDVVIDDPLRELIKSLVDIYEKPIELVWDLTKFGILNAAASLFVTCADVNEIISGVQCLNITILQLWTMYMDELSQRDGLGSVYGFLEPQAILNANDRRGQCQEYIEKWLKESNRHVYLGAYLNK

SEQ ID NO: 130937 - protein, 107 aa, Glycine max
  Coding DNA Sequence Number=SeqID_39252
  Subcellular localization annotation: CTP_CleavageSite=52; ConfidenceScore=5.43e-01
MTDVWGANTFLGRKYNSRAFHLKVRRSRLFRFFRRFPQINVGGDSVRIPFVEHASRESRVALPPKVPTAAVCSSKGMIPLETIKRDMTTLGVTTKILVSSLPYRFLK

SEQ ID NO: 130938 - protein, 104 aa, Glycine max
  Coding DNA Sequence Number=SeqID_39253
MFAHSIKGCRPLGRTCGVLIPSPKYLFDLMHTNTNTYLHPVKKKGPSTRSASVTLPISDSVEVNSVMLQSFFPFFIRLRSSTGKFEPSSRDFIHLKLVVAVLSL

SEQ ID NO: 130939 - protein, 96 aa, Glycine max
  Coding DNA Sequence Number=SeqID_39254
MDKVDIFVPHPLTNACLLIQLSPECGCKPLVCLLKRPALLGVDFQDCSIRRLLVLHVGGGAVKQRESSTTRDPRSLNPFSEIRRREEEVSRKRGRL

SEQ ID NO: 130940 - protein, 101 aa, Glycine max
  Coding DNA Sequence Number=SeqID_39255
MAALEREGSDGLGSTEAQLTTSKDWKAVSNDSSAASTYAVEGTTSPGHESKAFPRGSYRPGFISINLKQHITSVGAYLNGISISPITSRRVPSMARTTIEL

SEQ ID NO: 130941 - protein, 168 aa, Glycine max
  Coding DNA Sequence Number=SeqID_39256
MTLLLSNILPSDRIANLPLQKYQLVCVVLTWVRIAPTKTPSGPEKVKQGPGVSSSGYGPLSVLQGAHTPPARSRHHRDCARKTPSGPEEGQQGLGVASSKYGSLSVLGSACRPQQGHQVPPTNRAFIKKFCVSRQAQGETPQQPGAGRQRATDAPPSPLEFTSAHPQK

SEQ ID NO: 130942 - protein, 144 aa, Glycine max
  Coding DNA Sequence Number=SeqID_39257
KAVILVDVLSRVFCLCSVLLGCDSLCCLNVVLLGCCGSLGGLMGTRGWWVYACIVDVENLLCTIARPPPSTTCDGVKLPAFIVDHRVVPGDMSRGSGDLGDVRRAPGSQQIKGTKTTKQGGLWWLASCEFCVICGLWPLVIDYQ

SEQ ID NO: 130943 - protein, 310 aa, Glycine max
  Coding DNA Sequence Number=SeqID_39258
MTTLAQTWSVLSYSNLVPTSHTSDITLDRAKLIYEMIMKMDRNLGYLISHQISIIAQNDSSRLGFLALITTLCKARGVTSDSRTLKSLSPTIYLAYIKKNCWNLDDPIVTFRGPKKTRGKRLEAPTTSAAPETAAPSSSTPPAPSSSTPSTQIPLPAHSSFGPSNFLFTSEMLHSMLQSLHRGHVIIMQSLQSSGLPFIMSTDEFLTQVASLGVQPSPSGGGGTSAAQELEDEPTPPEPFEFVSDSVVAQEEVPSPEPIPEPSPTPVPEDTMLAEDTQPSEPVLEHEQLTIQDSSATPILDLNEDQPQED

SEQ ID NO: 130944 - protein, 189 aa, Glycine max
  Coding DNA Sequence Number=SeqID_39259
CAGLREENAATARALKQETKRARKEKHGCNKFRGALWDSNNELKLRREERDQSRAHNMVLKEELAACSRSKRNLSQCLCETETNMLAIVSKYQEELNLATAHEHKVADEYAQVYVEKEARGRVIDVLHQEATIWMDQFALTLNESQELPRLLAKAKAMADTYSSPEEIHRLLGYCQHMIDLMAHIIRNH

SEQ ID NO: 130945 - protein, 163 aa, Glycine max
  Coding DNA Sequence Number=SeqID_39260
SLSPFLVRDFGVQGFKVIQRVHKAWEGPLRKDKELRGIRNGIISGYHEWLKIRTRGLDWLSKLKIINEENFKALEEDEEVRALKTELGKARLAKEKFKLVATDIRKEYAELREENAATARALEQETMRARKEEHGRDKFCGALWGSSSELKLRRGRERPITST

SEQ ID NO: 130946 - protein, 176 aa, Glycine max
  Coding DNA Sequence Number=SeqID_39261
  Homolog annotation: Hit_ID=Q6WAY4; Match level="QueryCoverage=86%, HitCoverage=28%, E-value=5e-16, Identity=35%"; Hit description =Putative uncharacterized protein
MGTNQIRKRFYQVKIKGLDVTSLKELGRLMGPLQRQAFHKVYGNILDLTTHEVFTKVVVSLAQYYDQPLRCFTFGDFQIVLTVEEFGEILGCPLGERKPYLFSGFLPSLSKIAAVVGDSAKELDHMKQTRNGVVGLSRKYLEGKARDMANQEEWVPFADILALLIFAVVLFPCISP

SEQ ID NO: 130947 - protein, 103 aa, Glycine max
  Coding DNA Sequence Number=SeqID_39262
MSVEEFIQSVAWPGVQSSPSGGGKASAAQESQPKEEDDTIILEPTPPESFTFEADTVEPSPSPSSEPKPSALAPVPDQSTSQDPSSIPLLDLNEHAEDHSKDD

SEQ ID NO: 130948 - protein, 75 aa, Glycine max
  Coding DNA Sequence Number=SeqID_39263
VSVDTWMDITEMGYVIASRYNVYLKDRCPLSPLALLWSRNSHPQAKQWSAPYISRMQKYISFMMFKRDYVDINED

SEQ ID NO: 130949 - protein, 170 aa, Glycine max
  Coding DNA Sequence Number=SeqID_39264
MWMCHEEYPWSSISILETIHIFLRRLSFSDQGLSETQVTITEEMETISKRFGQLDVCGKIHLKSKLREIAYPDMNSMCPPLEKEYVDALQFVQISNSSVKRSASSFEDPIQRQNIPMLNEFHPCIQDSVENIIDVIVNDNYGYRAIATLLGMGEESWSLVNNHLHKQMTS

SEQ ID NO: 130950 - protein, 74 aa, Glycine max
  Coding DNA Sequence Number=SeqID_39265
KAVASGGSNPARLGELGGNHLPYFAINRGGNEEGRAEALPKRFRNVFREESRKGFNRSSTFFIRSSSFFDLQRG

SEQ ID NO: 130951 - protein, 107 aa, Glycine max
  Coding DNA Sequence Number=SeqID_39266
MTLRGRLLLLMMTDVLETCNWVPTIIQIPTVATSWIHDVGYNVQSKPPEKYWSCWILDQKSQVVALMMKLSSEDRATEAAEEEEEAAEEEEDAAEETESDDDSEATP

SEQ ID NO: 130952 - protein, 132 aa, Glycine max
  Coding DNA Sequence Number=SeqID_39267
MPSQNKFVGCAFTGKNPKKFQIPSTCTIDELKNLIKQVAPKGIPPLGIHESQTVRRFFFREPARFEYSDTVIKYEINELITNEELLKVLVQSNYWKKYGPIEILAVFTKYVEDELTELGNGTIFFGFFDVQT

SEQ ID NO: 130953 - protein, 161 aa, Glycine max
  Coding DNA Sequence Number=SeqID_39268
ETTLVSACYQAFRLTDSKKVYTDNHSGISARQRDSKVSMTDLVSVEDDAFRLTDSKKFYTDNHSGISARQRDSKVSMTDLVSAEDDAFRLTDSKKVYTDNHSGISARQRDSKVSMTDLVSAEDDAKKKVYTDNHSGISARQRDSKVSMTDLLSTEDDVNLR

SEQ ID NO: 130954 - protein, 178 aa, Glycine max
  Coding DNA Sequence Number=SeqID_39269
MVGYTPSSFADLDFASGRIKAGLKRGKFNHPTWTNEKTGANEEGEKEGETHAVTTIPIRSSFPPTQQCHYSANNKPSPYPPPSYPQRPSLNQPQSLSTALPMTNITFSTNQEHQPRNEFCKPVEFTPVPVSYADLLPYLLDNSMGSHNPNQGSSTFISPRIRLERNVCLSRRSLGASH

SEQ ID NO: 130955 - protein, 156 aa, Glycine max
  Coding DNA Sequence Number=SeqID_39270
  Homolog annotation: Hit_ID=UPI0000ECBAF8; Match level="QueryCoverage =37%, HitCoverage=69%, E-value=8e-23, Identity=88%"; Hit description =UPI0000ECBAF8 related cluster
SNPPPGTMTDIDTFQQPQNYIAEMERCHEEELKKLKANRDQLQAHFSGRHRGGAPIRPIVSRITIHWPSFYNVVTGKTLALPNLIALQHIPLSPAGVIAKRPAPIAPSQQLRSLNGEWDAPCSGALSAAGVVVTRSVTATLASADVPRCFCRYAPP

SEQ ID NO: 130956 - protein, 131 aa, Glycine max
  Coding DNA Sequence Number=SeqID_39271
  Subcellular localization annotation: CTP_CleavageSite=2; ConfidenceScore=5.26e-01
MRGETHAVTAIPVRPSFPPTQQYLYSANNKLSPYPPPSYPQRPSLNLPQSLSTALPMTNTTFSTNQKHQTKNHNPSQGSSTSISPRIQLETQRVLVTEKAPGRSIEHGRALKRKVQGLIDAGWLKFEENCV

SEQ ID NO: 130957 - protein, 134 aa, Glycine max
  Coding DNA Sequence Number=SeqID_39272
MAPRKLASKRSRKDKAAEGTSSAPEYDSHRFRSAVHQQRFRGHQGDGRFSGSDASSPMAKFDPEIVLEFYANAWLTEEGVRDMRSWRARNVSMARGGTGLMGSMRRPSPSCYVYRGRILPGLLQGGECESCAPT

SEQ ID NO: 130958 - protein, 238 aa, Glycine max
  Coding DNA Sequence Number=SeqID_39273
MAKFDPNIVLVFYANAWPTEEGVRDMRSWVRGQWIPFDADALSQFLGDPLVLEEGQECEFGQRRNRADGFDEEAIAQLLSTPGQDFAQTVAGRRVRIMRTSMSTLTLMWMTLLLSNVLPSDHNSDLPLAKCQLVNAILTRMSIHVAQLIADAIYLFAGMPPTRHPLDPDKSSRALGFSALITGLCQSFGVPVNPSKVIRPLITRAFIEKYCTPRQAQGDAPQSADAPHQLIRLIQLGH

SEQ ID NO: 130959 - protein, 171 aa, Glycine max [sequence omitted]

SEQ ID NO: 130960 - protein, 79 aa, Glycine max
  Coding DNA Sequence Number=SeqID_39275
  Subcellular localization annotation: CTP_CleavageSite=63; ConfidenceScore=5.53e-01
MMLDIVLYTGNGARKMLSNHVSFSAAALRAFSGGTSPSKLSHNSSQYKKIGPATTRPSTLMPRCSATSLSVMVHSPYGR

SEQ ID NO: 130961 - protein, 129 aa, Glycine max
  Coding DNA Sequence Number=SeqID_39276
  Subcellular localization annotation: CTP_CleavageSite=41; ConfidenceScore=5.30e-01
PSSSEKYIKGVSGGVVVSPRTGVAGSSGISSNGVDGSAGISCTSPPALPDVSSIGACRPRIFFINGFLCFLEDEWQRNGERKRERRRHFKEKMSQEEAHHHRRPWIRAWRKKEMNEGRGREEHEILCSK

SEQ ID NO: 130962 - protein, 181 aa, Glycine max
  Coding DNA Sequence Number=SeqID_39277
  Homolog annotation: Hit_ID=Q6WAY6; Match level="QueryCoverage=87%, HitCoverage=32%, E-value=1e-18, Identity=34%"; Hit description =Putative uncharacterized protein
MVEEFEEILGCPLGGRKPYLFSGEWAPFIDILALLIFGGVLFPNVDGLVDLAAIDAFLAYHNHKGKPEVRHPCPLESHRSCTEKGGANWDQLLATKQGASVNWFPRWNEGRTGVLISCGGFPNVPLMGTRGCISYNPVLAIRQLGYPMRGAPLGDELAPVISRGFNKTNMETLQKVRKAWE

SEQ ID NO: 130963 - protein, 237 aa, Glycine max
  Coding DNA Sequence Number=SeqID_39278
MRGAPTEESLSPFLVRDFGAQSLKIVQRVHKAWESPLRKDKELRGIRNGIIGGYHECLRVHTRGLDWLSKLKIINEENFEAPEEDEEVQALKSELGKARLAKEKFKSAATSIRKECAELREENVATAKALEQETKRAHKEEYGRDKFRGALWGSNNELKLRREEKDQSRVHGLILKEELAACSRSKRSFAQHLEATEQSMLAIIGQYKEELKQSLTHEQKLVEDFTQAYTEKEARGG

SEQ ID NO: 130964 - protein, 67 aa, Glycine max
  Coding DNA Sequence Number=SeqID_39279
MENKMKNKELNSIGACRPWIFFINGVLCFLKFDGSRMEKEKDDWRRHFKDKMSQEEAHHHRKTWIRA

SEQ ID NO: 130965 - protein, 50 aa, Glycine max
  Coding DNA Sequence Number=SeqID_39280
MKEISLNELNQGMRLQSPNPMELSPLLKFYLAYKKQATTECDTLYPSHIY

SEQ ID NO: 130966 - protein, 233 aa, Glycine max
  Coding DNA Sequence Number=SeqID_39281
MLYDALTELSARARVMGEVEEMQEQMEADMEAIKEKMATMMEAMMSVKKIMEANAVAIASTSVVTKVNPTSPSGLKQMNHPTSNMVGKDLGSTGGPHDVQIQNEHAFPSYGLPLNYTPPNMAYNPNKNTHEIPHHNLADFEPWLGYATEGQAVGGIPFENTLEGPQFHPQPQPLHFAVGRAPPAMAEKGKADHLKERLRAIEGGEDYAFANLKELFLEPNIITPPKFKVLDLD

SEQ ID NO: 130967 - protein, 193 aa, Glycine max
  Coding DNA Sequence Number=SeqID_39282
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARLGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFE

SEQ ID NO: 130968 - protein, 137 aa, Glycine max
  Coding DNA Sequence Number=SeqID_39283
  Homolog annotation: Hit_ID=A7PHV0; Match level="QueryCoverage=84%, HitCoverage=45%, E-value=7e-09, Identity=27%"; Hit description =Chromosome chr13 scaffold_17, whole genome shotgun sequence
DPPNLDWAELCEELLGVRPQEGGVIFVDKSSSKVSLRATDYKIKSIGGMCILIQIWAWERCTTLAPKRTPPVIQNKPLEHRWLRRGNQHIGNDDLIVFRRKLDIMKRHEFLWEPYTTTVMSSLPPICLVGSVAWCAV

SEQ ID NO: 130969 - protein, 157 aa, Glycine max
  Coding DNA Sequence Number=SeqID_39284
EFDHSAPLYHPEAVGPMIRGDTLRLSAPFCHPEAAGPMTSRDQIWSFCTLVSSRGETKFGHSAPLYHPEAAGPMIRGDTLRLSAPFCHPEAAEPDDKQRPKTDIVFCTFCSSGNNKSFTCGNFMVARDSRQPRGAKLVSYTDFRGPLLDDMRPLFGP

SEQ ID NO: 130970 - protein, 239 aa, Glycine max
  Coding DNA Sequence Number=SeqID_39285
MERSMIDAVSGGTIGDMTPAEARNLIEKMASNSQQFSARNDAIVIRGVHEVATNSSSSAETKKLEGKLDALVNLAEAYAANIYNRPLQPQQQNKPQQNKYDLSSNKPYVPPPVQQQQQQQQQQQQPQKQQTVEAPPQPSLEELVRQMTMQNMQFQQETRAYIQSLTNQMGQLATQLNQQQSQNSDRLPSQSVQNPKNMSAITLRSGKQCQGPQPATSSSSANEPAQLHSTPEKEWMTKI

SEQ ID NO: 130971 - protein, 549 aa, Glycine max
  Coding DNA Sequence Number=SeqID_39286
  Gene Ontology: Mol. function=drug transporter activity; Cellular component=membrane; Biological process=polysaccharide biosynthetic process
  Homolog annotation: Hit_ID=Q04TJ1; Match level="QueryCoverage=69%, HitCoverage=85%, E-value=6e-31, Identity=26%"; Hit description=O -antigen flippase
  Pfam annotation: Domain name=MVIN; Domain location=140-548; Score= -218.9; E_value=0.039; Accession=PF03023.5; Description=MviN-like protein
  Pfam annotation: Domain name=MatE; Domain location=325-483; Score= -28.2; E_value=0.062; Accession=PF01554.9; Description=MatE
  Pfam annotation: Domain name=Polysacc_synt; Domain location=115-385; Score=35.8; E_value=1.6e-07; Accession=PF01943.8; Description =Polysaccharide biosynthesis protein
  Pfam module annotation: Pfam domain module=MVIN::MatE::Polysacc_synt; Domain location=140-548::325-483::115-385
MTLAVTLLVMFFSRYEIEIQVHLDWYRNSSTSCNSIKDFDFWIFLNIKHRYCCVSEIVNFMIHNLTDDMFTGRGKLWHSVLIMAKSNLEQGVGIAVMWGADRASEIAQSQIYLEQWVQELTSADGGYVDLIGSLGFVAMVARVFGPENMGRLSIVQSASAIFIFFATLGLDHFVVREFTRKPDDHELKCSLLITQTLGWLFYVAAVVIYFVIKGNLQHEIYLIANVTLSTFFLRVIYLKLYLQAINQAKVIAVAATTSRVFALIYLLIGTFMHFSYDIMIVYLPIQAFIQTVMMWFGYRKVVKSSEQPFTYSFKRMFPLLREAFPVLIATAVYYGYSQADVLIVSYFMNDHDVGIYAAAMRLIPQAAFVGHIAAITFYSSISVSFDKDFSLFLLQTKRVIKLQIMLAMCLVIIGSLLSTLIIYCLYGEKFMQSAQILSVGVWAWLFMFPAALFSRLLVLTKLAKFELMKALIVAPISLSLNFALIPKFGPIAASFVTVMTYFMGDFLVYLLFKKTRFMFFIGVTAFKEVLLHPVISARESFKLITEKHV

SEQ ID NO: 130972 - protein, 90 aa, Glycine max
  Coding DNA Sequence Number=SeqID_39287
MKNGGKSSRNLSRKRLKSVTEGPQLGFSSRKQSLSLILSESQIQEGEKREVVATQLPRRAGFLPPEGTAFCWNILEGPSGSDCYLHTPVY

SEQ ID NO: 130973 - protein, 133 aa, Glycine max
  Coding DNA Sequence Number=SeqID_39288
MGAKITVAKYWAELKIATAVPLSCAGNQAATIRLFPGKEGASARPTRKRSEKSATIMPKPLKTSTKPCKRAHEKRGENVTHAHRIKADIFCHFRAGNRQRGAVAIVKGCDDKQHHHYPIASIGALLSAARCVT

SEQ ID NO: 130974 - protein, 132 aa, Glycine max
  Coding DNA Sequence Number=SeqID_39289
MECLEGVWETLEGNARCRFRGPIRLTATSLVHPEEPARTLQHTVEWILPTPTPYRLVELIQVIEVTSSEEDPEEDPEELPPEPVVDALDFLEGDEDPFPEVDSPKDVMSASEADSMEESDPGEMTTSGGSPS

SEQ ID NO: 130975 - protein, 39 aa, Glycine max
  Coding DNA Sequence Number=SeqID_39290
MATPPLPPPPPTVINLSLKGVPKPGKNPPRPIFPPLGKW

SEQ ID NO: 130976 - protein, 67 aa, Glycine max
  Coding DNA Sequence Number=SeqID_39291
  Subcellular localization annotation: CTP_CleavageSite=60; ConfidenceScore=5.28e-01
RSPTLFEVSLVMWFPGSFPFTSYPNFVNINQCTLRVRLIASEPNLRSCLMDEGLTGSGAGAATGGGT

SEQ ID NO: 130977 - protein, 154 aa, Glycine max
  Coding DNA Sequence Number=SeqID_39292
MKADMEAIKEKMATMMEAMMSVKKIMEANAVAIAATSVVAKVNLTSPSGINESSNLKYADFEPWLGYATEGQAVGGIPLQNPLEGPQYHPQLHLLHSMTSKNPHAMAEMGKLDHLEERLRAIEGGEDYSFANLEELFPIPNIITPSKFKVLDFD

SEQ ID NO: 130978 - protein, 31 aa, Glycine max
  Coding DNA Sequence Number=SeqID_39293
MARSRIVSSHGQKSRLVNDQPRYLGMEANGG

SEQ ID NO: 130979 - protein, 148 aa, Glycine max
  Coding DNA Sequence Number=SeqID_39294
  Subcellular localization annotation: CTP_CleavageSite=35; ConfidenceScore=5.17e-01
MAHEMVLRIESGCSGSRNGSCSTTFAARGFGTRPYAAGGGSGGEAGSRSTFAESTESTARSTDSTMSFFIDCFHQQNRRNQPALLKQLLTLDLLLEDMNIGIGKDTLVIDMDETDLPNALHHHYTIDRYIGSGNTGRTFPSATTEGSL

SEQ ID NO: 130980 - protein, 109 aa, Glycine max
  Coding DNA Sequence Number=SeqID_39295
MSRRNQEQFKTQEEKLKTTSRFKKKDEFKNQDSRIKLQESRSRFKIQDSRIKRRLNQDKGYFYLGLTENKRGYISCGSVLVEGTSTRFKENKGGYIPCGSLLLKGFLQG

SEQ ID NO: 130981 - protein, 56 aa, Glycine max
  Coding DNA Sequence Number=SeqID_39296
MTENKRGYISCGSVLVEGTSTRVSKRTREEACVESMSTDKKESSSDVTRNPRGSSR

SEQ ID NO: 130982 - protein, 94 aa, Glycine max
  Coding DNA Sequence Number=SeqID_39297
  Gene Ontology: Mol. function=catalytic activity; Cellular component =chromatin; Biological process=auxin mediated signaling pathway
  Homolog annotation: Hit_ID=P33081; Match level="QueryCoverage=77%, HitCoverage=89%, E-value=2e-36, Identity=100%"; Hit description =Auxin-induced protein 15A
  Pfam annotation: Domain name=Auxin_inducible; Domain location=6-94; Score=164.6; E_value=2.6e-46; Accession=PF02519.5; Description=Auxin responsive protein
MTTNTECMIISPGILNHIILLKASKAADAPKGYLAVYVGEKLKRFVIPVSYLNQPSFQDLLSQAEEEFGYDHPMGGLTIPCSEDVFQCITSCLN

SEQ ID NO: 130983 - protein, 81 aa, Glycine max
  Coding DNA Sequence Number=SeqID_39298
MFEVEEAYDPMSQRGGQKCINFYQYINVVYTNDHILRAYSPSWWPLGNEDAIPPSDASWTLVPDPSFNRMKGRPKINTAKE

SEQ ID NO: 130984 - protein, 41 aa, Glycine max
  Coding DNA Sequence Number=SeqID_39299
MNDALLQPKTSYFQLKHGLHHLQTQAFIPYSEIHAKTITYY

SEQ ID NO: 130985 - protein, 60 aa, Glycine max
  Coding DNA Sequence Number=SeqID_39300
MHIYEDNDIPVILGRPFMLTASCIVDMGRKKLELDFEDQKIDFDLFVEDKPAPEQNVCLQ

SEQ ID NO: 130986 - protein, 156 aa, Glycine max
  Coding DNA Sequence Number=SeqID_39301
MRTCDVPKQASSWQSTNKRTKSTKQGGLCGGWPAMNLEWYLEFGPGNRLPRVPIPWHDSTHCYFISTSGGTRTHASVACGVDTTYTYSISTSGANPEEDSEELPPEPAVDTLDFPKDDEDPLPDVDSPEDIMSASEADSTEESGPGGTANSEDSSS

SEQ ID NO: 130987 - protein, 270 aa, Glycine max
  Coding DNA Sequence Number=SeqID_39302
  Homolog annotation: Hit_ID=A9CJ18; Match level="QueryCoverage=97%, HitCoverage=97%, E-value=1e-125, Identity=82%"; Hit description =Putative uncharacterized protein
  Pfam annotation: Domain name=Exo_endo_phos; Domain location=2-269; Score=51.4; E_value=3e-12; Accession=PF03372.14; Description =EndonucleaseExonucleasephosphatase family
MECACAYLLNGWGGKLHDELVPYISLSDPDILCLQEVVHTPAAQEDWLTYRDHGIELPQRANFLRDVADALPDHVAIFCPAAQGDLWHGTTRYFSQWGLATFVRKSITIVAQAQGFVHGTFSADGYGDHPRSRTGHAIRVFDFATGQPAVIAHMHGLRDLDGKHDTAARLAQAKRLVNLVKNIAENGDRVIVCGDFNVLPDSETFTVLNELNLVELVTTRGFTDTRTSHYAKQNRYADYLLVNPAVKVDHFDVVRQPEVSDHCPLLLEFS

SEQ ID NO: 130988 - protein, 192 aa, Glycine max
  Coding DNA Sequence Number=SeqID_39303
MEGRKRRSPFLMWKIPKHSAGRNEGDFGAQNSKTIQRIHKAWETPLRKDQELRGIRNGLIGGYHEWLKVHIRGLDWLAKLKVVSEESFEASEEDEEVQALKSELGKAKLAKEKFKLTATHVRKECAGLREENAITARALEQETKRARKEEYGRNKFRGALWGSNSELKLRREERDQSRAHSMVLKEELIACS

SEQ ID NO: 130989 - protein, 144 aa, Glycine max
  Coding DNA Sequence Number=SeqID_39304
MTQDLVARGDTLRLSAPHHSVTPSVIDEQRPMWSSTPFSEMSEFLIGGYVGARALFCRPPHNLCHTDPETQSCSMARQRQIMVILHPFVIQRRRARCTCGDKLWSFRTPFAIQTQSCPMARRDKLWSFCALLSSRGGGPDDMRR

SEQ ID NO: 130990 - protein, 88 aa, Glycine max
  Coding DNA Sequence Number=SeqID_39305
MGIAPARHPVDPKKSNRVLGFPALITGLCHFYGVPVDPSKFIRPLLIGLPSRNTPPPPLEFTSAHPQKGLERCLRHMADQQATKSKAK

SEQ ID NO: 130991 - protein, 24 aa, Glycine max
  Coding DNA Sequence Number=SeqID_39306
MARCRAGSRGKDQSRYLGTDESRG

SEQ ID NO: 130992 - protein, 206 aa, Glycine max
  Coding DNA Sequence Number=SeqID_39307
  Gene Ontology: Mol. function=binding; Cellular component=plasmodesma; Biological process=protein amino acid phosphorylation
  Homolog annotation: Hit_ID=A7P079; Match level="QueryCoverage=34%, HitCoverage=6%, E-value=1e-24, Identity=81%"; Hit description =Chromosome chr6 scaffold_3, whole genome shotgun sequence
MLKSWISGDCQYYDAVMPYLKAILVNATDKSNHMLCATSMECISLVGMVVGNEKFRADANQVMEVLMSLQVSQMETNDPTTIGYGLDSANVWDKIFFLTWSLSCLHYFNQPFVSATKKQKYDKICEKKVSTPIEVSCKSHHVEFASYFHYCQGIVFPFFVMTNHHTWLLIFLFAESLDHITGCPALWAIYEKLVSIKMDLSIICED

SEQ ID NO: 130993 - protein, 45 aa, Glycine max
  Coding DNA Sequence Number=SeqID_39308
MAILGCDIKRKANRMEKEKDDWRRHFKEKMSLEEAHHHRKPWIRA

SEQ ID NO: 130994 - protein, 63 aa, Glycine max
  Coding DNA Sequence Number=SeqID_39309
MDPKANHESLTTSLKKECAILLNLSTTTKIESTPLWLLGSPRTKSILMSTQGADGIGKGVYSP

SEQ ID NO: 130995 - protein, 264 aa, Glycine max
  Coding DNA Sequence Number=SeqID_39310
MAPRKLASKRSRKDKAAEGTSSAPEYDNHRFRSAEHQQRFEAIKGWSFLRERRIQLRDDEYTDFQEEIVRRRWASLVTPMAKFDPDIVLEFYANAWPMEEGVRDMRVRSASMARGGTGPMGSMRRPLPICYVYRGRILPGLLPGDRHPLDPDKSNRALGFPALITGLCQSFGVPVAPSKAADAPPPHQAGPAGSFDTKQYLRHLVRQQAANHRAHVQTHDCLYQMSLSLQSQGFTSFPCPTLDQFRAEVAWPGDWPEARAGEAP

SEQ ID NO: 130996 - protein, 166 aa, Glycine max
  Coding DNA Sequence Number=SeqID_39311
MIRGDTLRLSAPFCHPEAAGPMTSRDQVWSFCTLVSSRGGGPDDTRRYLTVIRTLLSSRGGGPDDMRRYLTVIRTLLSSRGGGPDDKQRPKAAGPMIRGDTLRLSAPFCHPEAAGPMTSRDQIWSFCTLVSSRGGGPDDTRKYPSGYPYKHSFAICKTERLIACRD

SEQ ID NO: 130997 - protein, 93 aa, Glycine max
  Coding DNA Sequence Number=SeqID_39312
MSGFTRDSPQISASPHQLDLAPYASEPYNAQWNAPGLLRDKHTLRSSRILGEMEVDEPWLGLSRCKIHFLVGVFGFAKGMAFVDNWVVGKEKG

SEQ ID NO: 130998 - protein, 135 aa, Glycine max
  Coding DNA Sequence Number=SeqID_39313
  Homolog annotation: Hit_ID=A0PAV3; Match level="QueryCoverage=28%, HitCoverage=17%, E-value=5e-07, Identity=74%"; Hit description =Restriction endonuclease
MVKVGTSYVPINVSFSPKVGPGLPGINRDTRIYLFCESDLPSQVLQWLLFLSAVPPCSATDGGGCVTAKSTRRTSALASVAVTAARNHPHPPRLMRRYRARPIRHSGCATVGKGDRCGPLRYYASWRKGDVLQGD

SEQ ID NO: 130999 - protein, 118 aa, Glycine max
  Coding DNA Sequence Number=SeqID_39314
  Pfam annotation: Domain name=Transposase_23; Domain location=33-103; Score=-12.6; E_value=0.028; Accession=PF03017.5; Description =TNP1ENSPM transposase
MASFSQMQSQMQSQGLALPPEPLVGPSGNDPETGDPDRCGLYIEANPNRLVALGRVYEGSIAVHNTPLLLGQVKGGVEEVKDADAPLPVPTDEVSLVGQAIDTFLAWPTHLVKSLSQQ

SEQ ID NO: 131000 - protein, 179 aa, Glycine max
  Coding DNA Sequence Number=SeqID_39315
  Gene Ontology: Mol. function=phosphoprotein phosphatase activity; Biological process=intracellular signaling cascade
  Homolog annotation: Hit_ID=A7UQU7; Match level="QueryCoverage=64%, HitCoverage=20%, E-value=2e-19, Identity=44%"; Hit description=IMP dehydrogenase/GMP reductase, putative
  Pfam annotation: Domain name=DUF1723; Domain location=108-157; Score =66.1; E_value=1.2e-16; Accession=PF08330.1; Description=Protein of unknown function (DUF1723)
MTQDVPDMTEDVPDMAKDAPEMTADVQGDDGAEGSYADGFPGGPRDPSVLTSFADHVAHAVWSGQERPDLKLVSHRRKVTLIGRPVPEIKGLVSASGLSPLIDCSIVTGDPGLISAFVERWHSETSTFHLPVGELTITLDDVSLLLHLPITGALHSFHALSTEETIFLLTELLEVSAEE

SEQ ID NO: 131001 - protein, 128 aa, Glycine max
  Coding DNA Sequence Number=SeqID_39316
  Gene Ontology: Biological process=transposition, DNA-mediated
  Homolog annotation: Hit_ID=Q1J7G7; Match level="QueryCoverage=25%, HitCoverage=45%, E-value=3e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNASVFPSHDVVKRRPVNCNTTHYRANWSSTAVAAALELVDPPGCRNSI

SEQ ID NO: 131002 - protein, 129 aa, Glycine max
  Coding DNA Sequence Number=SeqID_39317
  Subcellular localization annotation: CTP_CleavageSite=28; ConfidenceScore=5.48e-01
MCPPPAKVYTKGAPKKAMSRNPSNSSVRRTASSSEQPNRRTIMPMLDQFQPFMHDFIDKIVDVKVDGNCGYQSVAGLLGMGQDSWSVKTISSSLVAWRDFRNFEELRMSLLVDGLTKVTTDKWMDITDM

SEQ ID NO: 131003 - protein, 249 aa, Glycine max
  Coding DNA Sequence Number=SeqID_39318
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDDQAYRYRRPRGGARYQLLFPLVRVNFELGVIMVIAVSFGKPVVAAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131004 - protein, 117 aa, Glycine max
  Coding DNA Sequence Number=SeqID_39319
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=50%, HitCoverage=47%, E-value=3e-25, Identity=94%"; Hit description =Putative uncharacterized protein
MASATLRTKRSSYALPGSSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131005 - protein, 368 aa, Glycine max
  Coding DNA Sequence Number=SeqID_39320
  Homolog annotation: Hit_ID=Q6WAY6; Match level="QueryCoverage=55%, HitCoverage=37%, E-value=2e-14, Identity=30%"; Hit description =Putative uncharacterized protein
MGHVCPLEGHHSCTEKKEANWDRLLASKEGASINWFPRWKEGRIEILISCGKFPNVPLMGTRGCINYNPVLAIRQLGYPMKGAPSEEGLTPFITQGFNSTNAGVLQRVHKAWEMSQRKDKELRRSSNRPIDGYHRWLKAYAQDLDWLPGLRTTKGMEGEASKEDEEVQALKTELEKAQTVKEKLKSAVVRIRKENAELRDVNIATTKALEQETKKARKEEHGRNKFRGALWGSNSELKLQREERDQSRVDGLILKDELKACLRSKRSLSQRLCETETNMLAIINKYQEELNLATVHEHKVADKYAQVYTEKEARGRVIDSLHQEATMWMDRFALTLNGSQEFPRLLAKAKAMADAYSAPEENHGLLSY

SEQ ID NO: 131006 - protein, 99 aa, Glycine max
  Coding DNA Sequence Number=SeqID_39321
  Gene Ontology: Mol. function=malate dehydrogenase (acceptor) activity; Cellular component=plasma membrane; Biological process =tricarboxylic acid cycle
  Homolog annotation: Hit_ID=Q1N491; Match level="QueryCoverage=94%, HitCoverage=18%, E-value=2e-30, Identity=69%"; Hit description =Malate:quinone-oxidoreductase
  Pfam annotation: Domain name=Mqo; Domain location=2-99; Score=-370.4; E_value=0.00033; Accession=PF06039.6; Description=Malate:quinone oxidoreductase (Mqo)
MATTDLDVLLVGGGIMSATLAVLLHRLDPTLHVCMVEQLEEVALESSDALNNAGTGHAGYCELNYTPQAKNGDIQIRRALEINAAFEISLQCWSTAGKR

SEQ ID NO: 131007 - protein, 78 aa, Glycine max
  Coding DNA Sequence Number=SeqID_39322
ELKSLYFVGSQNRYYEAPNPYDSAPIIEWVRNHVPSWEDAHENGVDGRSPEFQEPLDLRSKPFQGGENDAILPHKGIG

SEQ ID NO: 131008 - protein, 146 aa, Glycine max
  Coding DNA Sequence Number=SeqID_39323
PGPSPDIGRRPTVQAHPEREAITHLLCIPGQDFTRAAAKRRVRIMRTNMTTLTWIWMTSLFSNILPSDHNANLPLQMYQLGSRLQDAQWTRRSPTGPWGFQLWWRASVSPTGCPFPQRGIAPTKTLSGPGEVQQGPGVSNSGYGPL

SEQ ID NO: 131009 - protein, 287 aa, Glycine max
  Coding DNA Sequence Number=SeqID_39324
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
LELLRADQRLISPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLDMDEAGSHYLQQTNTGIENQTPHVLTYKWEMNNENTWTQGGEQHSGAYQGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 131010 - protein, 95 aa, Glycine max
  Coding DNA Sequence Number=SeqID_39325
  Subcellular localization annotation: CTP_CleavageSite=51; ConfidenceScore=5.48e-01
MTRKPRQDFSVSKPHIFKSSLSLSLTLLFLSPSFSIEAPNKAPTFGHHFCSKSRKEGIFGVVKRISMCGTSKFQVKGRVNLGLEGENMLLWVEKE

SEQ ID NO: 131011 - protein, 182 aa, Glycine max
  Coding DNA Sequence Number=SeqID_39326
MDAKHLTRTKEWSHVIKQRSPDENQCMTLISLLSVDESRGNKRCRRLCQSLHAIKPFCLTDSKRMFIRITVLGYFRVSSGPPPLDDTRVQNDQIWSLLVIGPAASGMTKGMTKLGLCLSSGPPPLDDKRVRITVRMTKLGLCLSSGPPPLDDKRGQYDKDYGAADKSKALAPTYPPMRNSDL

SEQ ID NO: 131012 - protein, 62 aa, Glycine max
  Coding DNA Sequence Number=SeqID_39327
MAEISQGKTMTGHDWSHIIWLLLDRIATDRAPPLPGAKQVENVAARQPSILCVRSFFYYCLF

SEQ ID NO: 131013 - protein, 81 aa, Glycine max
  Coding DNA Sequence Number=SeqID_39328
MGSGRSRRRCYQLRQEGGLRTIGRFELVYVRVEVKAARFLDLAQFLTKFHKISSTSSNVDNRSKEQLCAYKVYVAGHLALG

SEQ ID NO: 131014 - protein, 115 aa, Glycine max
  Coding DNA Sequence Number=SeqID_39329
  Subcellular localization annotation: CTP_CleavageSite=16; ConfidenceScore=5.18e-01
MLSVAGAFSQVKRVTSAKPESTYPRKARRITGTHFDVSSIGACRPRIFFINGFLCFLEDEWQWNGERKRGRRRHFKEKMSLEEAHHHRRPWIRAWRKKEMNEGRGRKEHEILCSK

SEQ ID NO: 131015 - protein, 46 aa, Glycine max
  Coding DNA Sequence Number=SeqID_39330
MATLMTTASYLGKDETDQSIDIKKYRGVQDFKQIPKNLTLVQLRES

SEQ ID NO: 131016 - protein, 2452 aa, Glycine max
  Coding DNA Sequence Number=SeqID_39331
  Homolog annotation: Hit_ID=A5C0S8; Match level="QueryCoverage=90%, HitCoverage=91%, E-value=0.0, Identity=46%"; Hit description =Putative uncharacterized protein
  Subcellular localization annotation: CTP_CleavageSite=47; ConfidenceScore=5.65e-01
MAANSGTKYVSVNLNKSYGQHSSAFGSARTPRPAAGAAAAPSSSRPRSSHKAGPKLSVPPPLNLPSLRKEHERFDSLGSGGGPAGPGGSGTGARPSSSGLGWTKPIAEDVSRPVVKPAAAAAAVPVSSAVLRGEDFPSLRATLAPGPGPNQKIQENQNSIQNQNLNQKQKHSLGDENVFVEEKEGSLVTDQFSVPRRVNVVGGGDGGRGSRVVHPKYGGGLGRKQEEYFPGPLPLVRLNPRSDWADDERDTGYSLSREGRDHGFRGEAFWDVDMPRVGGLPHKHDQRGQLRGNEVGKVMNSEVEAYDRMGPEGNSWRSSNLSFPKDAGNERNGVGVGVRPSSGSRDVGKDSNKYVPSPFRDEDAGKRDGQGGKQQPWNNVVEPYGDRNHDQLNRSRADSVQSSVSRTAFLMGGKGLPVNDPLLNFGREKWALPKSEKGFLEDPFMKDFGGSGFDGRDLLGGLVGVVKKKKDVLKQTDFHDPVRESFEAELERVQRMQEQERQRIIEEQERALELARREEEERLRQAREQEERQRRLEEEAREAAWRAEQERIEALRKAEEQRLAREEEKQRIVLEEERRKQAAKQKLLELEQRIARRQAEVSKSGSNAPVVVDEKMPAILNEKEASRATDVGDWEDSERMVDRILTSASSDSSSVNRALEMGSRSHFSRDLSSTFVDRGKPVNSWRRDGYENWNSSAFYPQDQDNSHNSPRRDLSIGGKPFMRKDYNAGAGFVSSRPYHKGEISEPHLDEYAHVKPQRWNQSADGDHLSRNTEIDSDFHENYFERFGDGRTQGHSRGNPCPPFPERTYPNSESEGPYALGRSSRYSVRQPRVLPPPSLGSVHRTYKNENEHPGPSSFLENEMHYNQATRSDSTLPTGYDNGNRGQPEVVDARQETTENEDHKVEITPRCDSQSSLSVSNPPSSPTHLYDEDDLDDSGDSPTILTSEGSKNGPLTAPDNESIATPAGNENVVTPCPVSSGDDDEWTTENNEQFQEQEEYDEDEDYQEEDEVHEGDDHAQLNQDFEDMHLQEKGLPHLMDNLVLGFDEGVQVGMPNEEFERTLKDEETTFMAPQASEECVSYDNARDNGKALQPVNDTSQVNLNSTSTVFQESEKPAQDLVIQPSNSLSPVVSESLVNEEASNGLLTQHSTTPSPVTVAPHYSSSNAPSQAEVPIKLQFGLFSGPSLIPSPVPAIQIGSIQMPLHLHPQVGAPLSHMHPSQPPLFQFGQLRYTSPISQAIMPLGPQSMSFVQPNIPSSFSYSHNPGGQMPVQTAPETSDSFMKNEIRHHSVDSQPGNSRNLPQSSLPSEDAENIAGIKGRFEAAHDPNNSSRTSSFQLDKKGNQNVVGKSSNISSSAKESEVQPVTRDASLHPVSKENFMESKTQFCGRGKRYAVTVKNSNPRSSGPATRVNRPDSGGFMRRPRRNMQRTEFRVRESAEKRQSTSSVLTDQFGLDNRSNINGRGAGVSGRTGHRKAMANKLGKQTVESATENSQGMDSGSRGEKVDGKESAKTQGFSHSGQSNLKRNLCSEEDVDAPLQSGIIRVFEQPGIEVPSDEDDFIEVRSKRQMLNDRREQREKEIKAKSRVAKAQRRPRSGSQSVVAVANSTKGSITAVEVANSIHADFVAADVRGMTKMDASSGFNSSLLSQALPPIGTPPLKIDAQPDLRSQMSRSHKTSLPAVSGGEKDPGSGVIFESKNKVLDNVQASLGSWGNAQISQQVMALTQTQLDEAMKPQQFDSQVSVGNMTGAVNEPSLPTSSILTKEKIFSSASSPINSLLAGEKIHCLTDGGYCTLYSGAVTSPTVLPSNSRVVSHGIGPPRSSRSDMQMSHNLTGSDNDCSLFFDKEKHGNETHGHLEDCDAEAEAEAAASAVAVAAISSDEIVGNGLGTCSVPASDGKSFVAADIDRVVAGVGCEQQLANQSRSEEPLSVSLPADLSVETLPISLWPPLPSTQNSSGQMISHFPSVPPHFPSGPPSHFPFYEMNPMMGGPVFAYGPHDESASTTQSQPQKSTTSASRPIGSWQQCHSGVESFYGPPTGFTGPFIAPPGGIPGVQGPPHMVVYNHFAPVGQFGQVGLSFMGTTYIPSGKQPDWKHIPTSSAAGAGEGDINSMNMASSQRNPANIPSPIQHLAPGSPLMPMASPVAMFDVSPFQPSTEMSVQARWSHVPNSQLPLSMPLQQQEGIQTSQFSHVPSVDQPLNAKRFTGSRASTSSEGDRNFPRATDVNVNQLPDELGLGDTSNSTPTKTSAQSVVNKTPSVIPITDTLKVDVLNGNSHSSNNQNASSSFKNQPSQFDHSSGHGNYQRGGISQRNNSGGEWSHRRGYQGRNQSLGSDKNFSSTKGQRRNRRKGKEGSTVEKEELFGEGRRERANLKESGRRIFALCALSFISHGLTIRLPLTLVARHRYPIVILGPSLVFTHWERMRCEFNLEWGKDGVLRRSNNSNSNTGKEEGLL

SEQ ID NO: 131017 - protein, 86 aa, Glycine max
  Coding DNA Sequence Number=SeqID_39332
MDDLDFFLKIHLHLTTRLLSDISVEAMFSKVILMMPKNQELNKVSSKDSRIKFQISRPSFKFQESRIIKIKIQDSRFKNQEKTQSR

SEQ ID NO: 131018 - protein, 92 aa, Glycine max
  Coding DNA Sequence Number=SeqID_39333
MFVFNSALKGLNDTPQSKSKVVVRWIVVKCNRQKGSTECGYYVMHWMSTIILGSFKNNWKMYFNDARPLEPKRLKALRIQWAKYYLKIKNET

SEQ ID NO: 131019 - protein, 172 aa, Glycine max
  Coding DNA Sequence Number=SeqID_39334
MREFGTIAAHPGELMLSPEENGSPRLVGPFSPKQFGGPGEPEASLGELGQTQVDVPSTYTTKDVPSNVLRQRSQAVKPLILCEWGYKRILRREKGDTKEFRRLVLCSFGKGRRETQKEFRQSVLGEFFLAKGEEMKRMNSTSFQGLEKQKTLESFWHKEEEEVQRDSRLVKD

SEQ ID NO: 131020 - protein, 224 aa, Glycine max
  Coding DNA Sequence Number=SeqID_39335
  Gene Ontology: Mol. function=protein serine/threonine kinase activity; Cellular component=cytoplasm; Biological process=protein amino acid phosphorylation
  Homolog annotation: Hit_ID=A7PG28; Match level="QueryCoverage=32%, HitCoverage=18%, E-value=7e-29, Identity=79%"; Hit description =Chromosome chr6 scaffold_15, whole genome shotgun sequence
  Pfam annotation: Domain name=Pkinase_Tyr; Domain location=74-223; Score=-161.5; E_value=0.016; Accession=PF07714.8; Description =Protein tyrosine kinase
MGSGCDGGVATAILANSGHKVIVFEKGEYFVSHDYSSLEGPFMDELYESGSIMLSLDGKMMILDGSTFGGGSAVNRSATFGFVYKGWIDENTYTPTKPGIGIVVAIKKLKPESFQGHREWLAEVNYLGQLHHENMVKLIGYCTDGKNRLLMRGPLFVSISNPLMFVLVAIASSLMLNENLYVGSVVGAVLIVCGLYMVLWGKSKEMKNITQLVPSETIREAEFG

SEQ ID NO: 131021 - protein, 90 aa, Glycine max
  Coding DNA Sequence Number=SeqID_39336
MAPKKLLNKKARKDIAGEGSSAAPQAKIEFDRHRFRSEEHQCRFEAIKGWSFLKERQVQLREGEYTKFQEEVARRQWTQLTEPWLNMTPR

SEQ ID NO: 131022 - protein, 416 aa, Glycine max
  Coding DNA Sequence Number=SeqID_39337
MAPRKLPAKRSRKEKAAEGTSVAPEYDSHRFRSAEHQQRFEAIKGWSFHRERRVQLRDDEYTDFQEKIACRRWTSLVTPMAKFDPDIVLEFYANAWPTQEGVRDMRSWVRGQWIPFDADALSQFLGYPLVLEEGPKCEYGQRRNRADGFDEEAIAQLLCIPGQDFAQTAAGRRVRIMRTSMTTLTQIWMTLLLSNIQPNDHNSDLPLPKCQLVYAILTRMSVHVAQLIADAIYLFAGMAPTRHPLDPDKSNRALGFPALITGLCQSFGVPVAPSKVIRPPITRAFIEKYCTQTQAQGDAPQAAGAPPPPHQADPAGSFDTERYLRHSMRQHVANHKGLGQVHECLYQLSLSMQSQGFAHFPCLTPDQFRAEVAWPGDWPEAQAGEAPAEAPDDGEEAGMDEEMSDLLGFLGGSGAT

SEQ ID NO: 131023 - protein, 122 aa, Glycine max
  Coding DNA Sequence Number=SeqID_39338
MDEQEKRAQEEEFGVAATTKEQVVTIQAKAFVKAVDDNIVCKVIIDLTNTGVMEETPKASNAVVVDEIVHQDKELSYAALAPIAPTPPTLVHQLPLLEPTQPSPPPSSPPPTQPPPPPQVQD

SEQ ID NO: 131024 - protein, 131 aa, Glycine max
  Coding DNA Sequence Number=SeqID_39339
METKIEKLAKQLQTSSIGFSTTTKENPKGHCKAIISTIECDVGGEEEEEVEESTMLEEEMKAQANPSTQEDDQQVPIILGRSFIRIAHVTIDVRKGVYTLRESKKQIFFYIQGIEDFPNVSAHQQHHHTTP

SEQ ID NO: 131025 - protein, 135 aa, Glycine max
  Coding DNA Sequence Number=SeqID_39340
MDASKPHMVVVRNLCVGLSVQDSMSSMPSKPSFFIDGIVTPLEHTDALHPTLPYYHFVVLMLGVVIPSESHSPPADDSRVSPRVDLVDLVSKDEGEELEEDTPFKEDPWMDEENPVTGSEFMEEDSLEDSSHESC

SEQ ID NO: 131026 - protein, 128 aa, Glycine max
  Coding DNA Sequence Number=SeqID_39341
MKMRTCDLEKISRHRIDEGVLTGVGSKDCVELLDDERVLEDPVDTSERYGGGRRASRNNDIGCKTCTSLRIVGFNPEMKQLKTNGADNPTILLANDSNSERYADTEERYCNLQSNPVGSSYVDVAKRE

SEQ ID NO: 131027 - protein, 139 aa, Glycine max
  Coding DNA Sequence Number=SeqID_39342
  Subcellular localization annotation: CTP_CleavageSite=77; ConfidenceScore=5.27e-01
MGEKLATQLAQASKVVSSKSNRLLGESSGGPKWACMSRNFTNCLTMGAKYLKMVKRKLHATKQRSPDEIRTLRARVVAKTEEKKLKLLFLRWSEPHKRLSNFISTKVEPSIYTIFLASPWMKILYHLRSAKKRLSNLDI

SEQ ID NO: 131028 - protein, 38 aa, Glycine max
  Coding DNA Sequence Number=SeqID_39343
MGGAVTLLDIPGGENIVMRGVVILLDIPGGGNRVVKEF

SEQ ID NO: 131029 - protein, 444 aa, Glycine max
  Coding DNA Sequence Number=SeqID_39344
  Subcellular localization annotation: CTP_CleavageSite=20; ConfidenceScore=5.20e-01
MTLSQVQRPYNLSQKKSYVPQANVPTNKWFRPRNEGSKSHFKEFKVNSLELRRGGIIEGCSRKGYYDYQNPHWRDVILEMQHKNAARLPFFDRISEGLPPGFEKKMSTKDREEKEMITESFKFGFEDSLEAIRGVISILPTEYAEDYQNRNILSDYAREDYFDDPYLCPKVVWVTQVSCFTPHRNVAAFDPSTNDIRCHMKPLHLIALVEDQIINKILVDGGDTFNILPRSMLCSRRRPMVFLDGKLIMVGGDQSSYGICVAFASEADQAMARTTPFEIEDSFYVNNILGDEKDQFFYWDTNKGFLLINKQFLRHDVNRRPTRSTFRQDTAAKVHEDVGDFSHDEDHTSSEIAFYQDVIGEELLEGEMLSSDEEYDSLGDENTTAKVHEDVGDFSHDEDLTSSEIAFYQDVIGEEILEREMLSSDEECDSLGDESNPSKDMTSP

SEQ ID NO: 131030 - protein, 132 aa, Glycine max
  Coding DNA Sequence Number=SeqID_39345
MLRRQVAGSRCCLFGPCFCGFGPSSGIHEVIAIIRRPLPRCLRRIFLRSGGTRMKFEACKKATSGLSVACFGKTLAPPCLNSNRVISLRSLLPEITKMNRMKKPTTEVVSIKNMVICFEDQETGRCLKEIPT

SEQ ID NO: 131031 - protein, 227 aa, Glycine max
  Coding DNA Sequence Number=SeqID_39346
MSLSYSQCLIFLGSREDEKMRPPSKPNPRRLLGHSLHDFSGTTYEEAKALRAFTRTATVFVAGIRINASLSVNPTYAVRSRGLVRGREGMGNLASREGSWVSMLFVWALLLRFRAQFWYPRGDCYQYPHPRRPPCPQGGEGLELLTTVPRWCPQGVDPTIALARVALVETMMCQDHDARVGVNNGIRGGSLPPQLNIDPLADAEGHVAALVIRQSLHGVLCLLKTML

SEQ ID NO: 131032 - protein, 95 aa, Glycine max
  Coding DNA Sequence Number=SeqID_39347
MMITKDDDKGDDKTLKDQSKNNSSESKINQRTTQVNQEEFKTQEESLESRIKIQGSRSQESRFKVQDLKNQDQAISNDGSWGPLVVMGGGEGVRV

SEQ ID NO: 131033 - protein, 107 aa, Glycine max
  Coding DNA Sequence Number=SeqID_39348
  Homolog annotation: Hit_ID=A5AW34; Match level="QueryCoverage=58%, HitCoverage=5%, E-value=1e-14, Identity=60%"; Hit description =Putative uncharacterized protein
ATLAKAYSQVYNGKSRHLGVRHNMVRELIMHGVISVEFVRTQHNLDDHLTKGLSRDLVKRSTRLEHIIESIPKGARKKMTTYISMKFSRFKKLGLGFDMLMKDRDTG

SEQ ID NO: 131034 - protein, 111 aa, Glycine max
  Coding DNA Sequence Number=SeqID_39349
MACLLLGFICEMMWLWLDSIYEIMRPYFVIPDRLSMVHVVSVDKPNVMPITINHRRYSYIPWGFTSCRQLEWFEDISFYLGMEVPHDAQEFEVTPVRFDVRGNVLSWRFKL

SEQ ID NO: 131035 - protein, 83 aa, Glycine max
  Coding DNA Sequence Number=SeqID_39350
MADPCLLLSLLTAPCLPSIPPSLVGRVCIKVGGITDITFVPNDDTGKIECNKWLHGDVETDEAEGASSDKVIFLWLPTYHRKE

SEQ ID NO: 131036 - protein, 46 aa, Glycine max
  Coding DNA Sequence Number=SeqID_39351
MAFYHGGHLVFHGLHLLLHLLYFTHYSSSDTRSWKMQGSFMSEHNM

SEQ ID NO: 131037 - protein, 237 aa, Glycine max
  Coding DNA Sequence Number=SeqID_39352
  Gene Ontology: Mol. function=heat shock protein binding; Cellular component=endoplasmic reticulum; Biological process=protein folding
  Homolog annotation: Hit_ID=A7PT19; Match level="QueryCoverage=99%, HitCoverage=50%, E-value=3e-77, Identity=61%"; Hit description =Chromosome chr8 scaffold_29, whole genome shotgun sequence
  Pfam annotation: Domain name=TPR_1; Domain location=172-205; Score =9.9; E_value=0.35; Accession=PF00515.19; Description=Tetratricopeptid e repeat
  Pfam annotation: Domain name=TPR_1; Domain location=88-121; Score =19.2; E_value=0.015; Accession=PF00515.19; Description =Tetratricopeptide repeat
  Pfam annotation: Domain name=TPR_2; Domain location=134-167; Score =4.1; E_value=9.3; Accession=PF07719.8; Description=Tetratricopeptide repeat
  Pfam annotation: Domain name=TPR_2; Domain location=172-205; Score =9.5; E_value=2; Accession=PF07719.8; Description=Tetratricopeptide repeat
  Pfam annotation: Domain name=TPR_2; Domain location=88-121; Score =24.7; E_value=0.00035; Accession=PF07719.8; Description =Tetratricopeptide repeat
  Pfam module annotation: Pfam domain module=TPR_1::TPR_1::TPR_2::TPR _2::TPR_2; Domain location=172-205::88-121::134-167::172-205::88-121
MLKPGDSATENKLSQLLQAQSALETTQSFYDSGNFSKSLEYIDKVVLVFSSTCNKAKLLKVKVLIADKEYENAIAESGFLLKEDENNLEAFLLRGRAHYYLADHDVATRHFHKGLRLDPEHSELKKAYFGLKNLLKKSKSAKDNASKGKLRMAVEEFKAALAVDPIHLAHNVHLHLGLCKVLVKLGRGKDALDSCSEAFKIDEELVEALVQSGEAKLLTEDWEGAMEDLRSAAQKSP

SEQ ID NO: 131038 - protein, 104 aa, Glycine max
  Coding DNA Sequence Number=SeqID_39353
MCFLLVSSNVDHNLDSLRMIQSETVVGKAGVDGVAATKNVATRVGDSLLGNESLGGRVSGFGVQEVGQEAFLVDQSWGRCDQHFDVPAKAPETTSRLERERENE

SEQ ID NO: 131039 - protein, 89 aa, Glycine max
  Coding DNA Sequence Number=SeqID_39354
MPRAQNSTAHHSAYFGKRALEVARGAAFAEIPRFWHSHIEPVEDTIMAEEPRRLTLEDYSSSNVPQFFTSIAQSEVQAQTITYPPSLIS

SEQ ID NO: 131040 - protein, 71 aa, Glycine max
  Coding DNA Sequence Number=SeqID_39355
MEHIRVMPPVGNAQEGDTDEDITKGKDHEALEGPMTRGRLKQAQHVIETRLVICIAAIDDDRRPKWRKMKA

SEQ ID NO: 131041 - protein, 178 aa, Glycine max
  Coding DNA Sequence Number=SeqID_39356
MSQGQAVPFVGKWQHFTVRNDGEKVVPEPHGDAEQTETWESEVMIPFAVERTVYAFGGPLPDQASLSSKMSKVFPCYQTCEPRIFDSEPYNFNCLSKPNKLFRSTPSIAHRDYLPWLDRVEQAYEDFWKTYGIFDLIQFSRSGPEYRPEMLIAAMHFVESSTKDFQFKCGMMTPKSLR

SEQ ID NO: 131042 - protein, 121 aa, Glycine max
  Coding DNA Sequence Number=SeqID_39357
MDLGGKQKSMHPSRCGYIFSSVRVLFLVQYLQAAILRQHICQWKENNGHLLLFDLHPTARELGFQRVSDWKDANWVTTLSSPRANSSTATTWRMSDDTLFHIDRDEVRDREETIFISEKPF

SEQ ID NO: 131043 - protein, 125 aa, Glycine max
  Coding DNA Sequence Number=SeqID_39358
MSVEQFIEKVSWPGTLPSVVREGVEMRPDEDVLPEPIVPEAATPERTPQTSEGPLSPWMDLSFAQQVADPPTPVHERQVDPPTPIMEMPEDPTTPVLRLSATLPATPILHLTNEEDMQDTQGTQD

SEQ ID NO: 131044 - protein, 111 aa, Glycine max
  Coding DNA Sequence Number=SeqID_39359
MKLLSLPVFALLLLLLSDHLFFFLLLLHSLGVFFFIPCASSLCLFFFFVEEVAEVACGGAARKLPRRATVVEEVSASTVEVSTVNLSFLWSSVADDGGNRCQKSLGALRIT

SEQ ID NO: 131045 - protein, 652 aa, Glycine max
  Coding DNA Sequence Number=SeqID_39360
  Gene Ontology: Mol. function=protein binding; Cellular component =nucleus; Biological process=ubiquitin cycle
  Homolog annotation: Hit_ID=Q9FE83; Match level="QueryCoverage=78%, HitCoverage=96%, E-value=1e-157, Identity=56%"; Hit description=F -box protein SKIP2
  Pfam annotation: Domain name=F-box; Domain location=29-75; Score =25.0; E_value=0.00028; Accession=PF00646.24; Description=F-box domain
  Pfam annotation: Domain name=PPR; Domain location=539-573; Score =18.5; E_value=0.026; Accession=PF01535.11; Description=PPR repeat
  Pfam module annotation: Pfam domain module=F-box::PPR; Domain location=29-75::539-573
MGQAPSTPVSSTDLSHRDIFTTDESIGRDYTADIPDECLAGIFQFLSSVDRKTCSAVCRRWLRVDGENRQRLSLNAKASLVDFVPSLFSRFDSVTKLALRCDRKSTSVNDDALVLISLRCRNLVRLKLRGCREVTEHGMADVAKNCTNLKKLSCGSCAFGAKGVYAFVNNSIVLEEVSIKRLRGVEKDNNDGVDGAESLPLSVTSSSLRSICLKELVNGHCFAPLIVNSKKLETLKLIRCLGDWDVTLESVGKLNSGLVEIHLEKVQVSDVGLLGVSKCLKLESLHLVKTPECSDVGLCEVAERCKMLKKLHIDGWRTNRIGDCGLMSVAKHCPNLQELVLIAMYPTSLSLAAIVSGCQGLERFALCGICTVGDAEIESIVAKCGALRKLCIKGCPVSNAGIAALASGCPNLVKLKVRKCRRVNGEVVEWLRERRSSLVFSIDYSTEVEALDGSGSDVGAQESSMASPPIDTTQVSMVDDPPSSSNNSSSNNNNNRLSMFRNKFGFLAGRNLGDKFREAEELFDNLLNDENSALKPDPKMFNMMIYIHKKAGSYEKARKTFALMAELGIQQTTGLVTTERNSLDPAAAPFAKNPRDIEGLTEGASIIEVVKKIRSHVLLGLSGVGGIFNEEAREAAMAVQGKMVDSQCKKSK

SEQ ID NO: 131046 - protein, 70 aa, Glycine max
  Coding DNA Sequence Number=SeqID_39361
MDEEWEVGSCSNVQEDFEGIDEESGYEWCSNKQEEMALGDEDMSVYSNDQCWSGDMLIVMMRFLLNMNVK

SEQ ID NO: 131047 - protein, 78 aa, Glycine max
  Coding DNA Sequence Number=SeqID_39362
MDEAVGVSKKAKVDPKIEEDASSGFGKCDTNAHSNEIEALDERLKQKKEANNVAMAWIGGWSNEFKGMLLTRVLIKLW

SEQ ID NO: 131048 - protein, 324 aa, Glycine max
  Coding DNA Sequence Number=SeqID_39363
  Gene Ontology: Mol. function=galactosylgalactosylxylosylprotein 3 -beta-glucuronosyltransferase activity; Cellular component=membrane
  Homolog annotation: Hit_ID=Q4VZ78; Match level="QueryCoverage=43%, HitCoverage=44%, E-value=4e-30, Identity=69%"; Hit description =Glycosyltransferase
  Pfam annotation: Domain name=Glyco_transf_43; Domain location=170 -315; Score=9.6; E_value=3.3e-10; Accession=PF03360.7; Description =Glycosyltransferase family 43
  Subcellular localization annotation: CTP_CleavageSite=91; ConfidenceScore=5.18e-01
MKLSALQQSYLNRRSNSFRGSLPLDSSGEHLLAPPPSCVLHRQRRHRLPLLPSRLPLPLLRRLPRRRNLRSARRAFSPRHREPDREERVRRVSSGESDRRRKPRGGRAARDPCPAVAASESGGGDEGTPHNRENPEGAEDAVRSEKAENGYCGHADAGAHVPEASLEQRHALAHARAAGRVTNETASIIAKSGLRTIHVGFNHRMTISWSDRHKLEAMMRLHALRIVRKERLDGIVIFADDSNMHRKLEWAGFVLNSKLLWKDLDDKPEWIKDLEVFDGVDDIESPLYLLGDTSVVEPLGSCGRQVLLWWLRVEARTDSKFPAQ

SEQ ID NO: 131049 - protein, 60 aa, Glycine max
  Coding DNA Sequence Number=SeqID_39364
MVVRLSTRTFAKERTVTRVRVRALVKGESESETEAPWTERANVDGVGSSGLRIIKKGGLN

SEQ ID NO: 131050 - protein, 63 aa, Glycine max
  Coding DNA Sequence Number=SeqID_39365
MRALGGLVARPGELMLHSEVTLLAQASWFRPQKEQDKTQRNLNSTQFMVQEQEQEIWTIENQI

SEQ ID NO: 131051 - protein, 32 aa, Glycine max
  Coding DNA Sequence Number=SeqID_39366
MAHQGARPATAPGDDGGAQEDDDMADLFVISL

SEQ ID NO: 131052 - protein, 492 aa, Glycine max
  Coding DNA Sequence Number=SeqID_39367
VEGRSPKFQQPLDLRTNPFQGVGLMQFYPLMALDRRLQEDWARDAGEGPRVLMSLRGGELSYWRGMCSLGGELSYWRGVTLASQGSFSRKPSSFMYFGMVVSLAIEELKDPACIEASQASFHQWLHHNPEFGRLVAHGHGKIRNPNKEHKHAKREEDFVKIHPNCDLRTPLQLRLPDDPLLCQNSQELHANQVQNPPLQYEPNIDKIFQKLRAKISEDREKVMVANQSHTLMDYLASTFGEANTIHLLDLPEGVTFDIKQGFLKMLENNPFDGVSHEDLMQHLRKFIKFTNMNEVVVPIDQHTIPLITKKVKQPSQPKPNPKKEDVNAVMTRSKMIQKDSEENEATRKVKVPTDGNPVASKKGEKETIVTEPHPSVGKEDPPRKKVIPKDPRWSKKNGDSITIQTLGYGVDDYLGGSMQKGKITMFEGSFFENSSRIGVKNAFDKRVHRRKFSKGNLVLKKAFLGGALLLMNMDDEDLPSPVNSDIVKRYYK

SEQ ID NO: 131053 - protein, 70 aa, Glycine max
  Coding DNA Sequence Number=SeqID_39368
MPAGLHYPYLGITPPRHPVDPEKSNRALGFLALITGLCQFYAVSVMPIKLIRPPINRSFIEKYCMPRQAQ

SEQ ID NO: 131054 - protein, 55 aa, Glycine max
  Coding DNA Sequence Number=SeqID_39369
MARKPRQDLSVSKTAFSLPHVAFLLPHSPLKLHTKLQPLVLISAPNRERRAFLES

SEQ ID NO: 131055 - protein, 149 aa, Glycine max
  Coding DNA Sequence Number=SeqID_39370
  Homolog annotation: Hit_ID=A5B589; Match level="QueryCoverage=98%, HitCoverage=33%, E-value=4e-08, Identity=32%"; Hit description =Putative uncharacterized protein
MQRRSSAGVLIPIDLEINATCKKRNTERNRKILQDIEAAAIQEEPLSSEASSSFPKQRESHTVLIEDNIMADEPRRLTLEDYSSTYVPQFFTSIAWLEVQAQNITYPHSLIQLIQNNLFNGLPNEDPYAHLATYIEICNTVSIVGVPED

SEQ ID NO: 131056 - protein, 95 aa, Glycine max
  Coding DNA Sequence Number=SeqID_39371
MGDQATNMKKSLHQLLNKNPQLRVLAFHGKEAPFTLKKRNQEKLLAYKGVGMYPPPLGISQSLKNSLISLKDENLAPCSTLRYLKFTLFKPLSSE

SEQ ID NO: 131057 - protein, 51 aa, Glycine max
  Coding DNA Sequence Number=SeqID_39372
MDKSLKVGEDEWRERERRSTKFWASNESRCPKIQGLKNPTFLGYPTYIMEP

SEQ ID NO: 131058 - protein, 37 aa, Glycine max
  Coding DNA Sequence Number=SeqID_39373
MRYAPTSLCFEVIGSVLSVGSGAKPKSLTKVLSVAAA

SEQ ID NO: 131059 - protein, 131 aa, Glycine max
  Coding DNA Sequence Number=SeqID_39374
MSILHELVMYDYHEKDRAPDLESNLVDFMTYQASSKGYCYSVQQQGTQFERNQSSVGYQWESYQQSDYHNEAERGSNLDKLLMQFKETTKSTQQALQSVEIQVGVLAEEVTQFMTRREKYFVKVEAQRKTL

SEQ ID NO: 131060 - protein, 47 aa, Glycine max
  Coding DNA Sequence Number=SeqID_39375
MDNTFDDEVESAVTIDEYLEEVEERELGSVTVQSPSGPKQPNPIAPF

SEQ ID NO: 131061 - protein, 71 aa, Glycine max
  Coding DNA Sequence Number=SeqID_39376
  Homolog annotation: Hit_ID=A5AV98; Match level="QueryCoverage=100%, HitCoverage=12%, E-value=1e-08, Identity=36%"; Hit description =Putative uncharacterized protein
MDVVDNIKTTFPKIESAKEFIGLFDGSHVIHEHIIEMINIATRLKILGMVVSGNFLVQFILNSLLSEYDPF

SEQ ID NO: 131062 - protein, 74 aa, Glycine max
  Coding DNA Sequence Number=SeqID_39377
MTKRKMQGSCISERTMEMEYMQLAEQKHGLSATMHHQKRKNLDEASLSSSESETQHNHKLTSIPYGSDRPGYRA

SEQ ID NO: 131063 - protein, 84 aa, Glycine max
  Coding DNA Sequence Number=SeqID_39378
GTSFVVQVEGTSTWVVVTKNKRGYISCGSVQVEGTSTWLFKENKGGYIPCGSLLVKVFTRLKRNLKDHRSLADRMQTQVVSKPV

SEQ ID NO: 131064 - protein, 197 aa, Glycine max
  Coding DNA Sequence Number=SeqID_39379
MKRWWAMHLQSFADLVFASERIDVGPKRGKFSHPAWTNEKTGANEEGEDEGETHAVTAILIWPSFPPTQQCHYSANNNPSPYPPPNYPQRSSLNQPQSLSTTQPMLNTTFSTNRNTNQKGILQQKACRIHPKFRCHMLNLLSYLLDNSMVAITPTRFPQPPFFRGYDLNATCVYHGGSLGHSIEHCMTLKHKVQSLN

SEQ ID NO: 131065 - protein, 109 aa, Glycine max
  Coding DNA Sequence Number=SeqID_39380
  Subcellular localization annotation: CTP_CleavageSite=40; ConfidenceScore=5.11e-01
MSQNPSECASIGVKQLNWGGKNSNVSQPTLLRVSEERLTGASSKEGKCTESPPTFICGKRRKNRRKPVIKNIPDSGVVFTFEEGISTSHVNKSGALAPTYPPSKRKSDL

SEQ ID NO: 131066 - protein, 85 aa, Glycine max
  Coding DNA Sequence Number=SeqID_39381
MNSTSFQGLQNQKTSESFWYKEEEDEVQRDSRLVKDCNEMIGKFENFFKLILLLVIDYNNMELLWRLASMSSFNGDFPPWRCSRG

SEQ ID NO: 131067 - protein, 69 aa, Glycine max
  Coding DNA Sequence Number=SeqID_39382
  Homolog annotation: Hit_ID=A5CBU4; Match level="QueryCoverage=98%, HitCoverage=30%, E-value=4e-09, Identity=48%"; Hit description =Putative uncharacterized protein
MHDGIVRTLIDVCQVPKLKKNLVFVDVMDSKGFSCKVKGGVMNIKRKGKFVVMQRTKQGNLYIIQRFTR

SEQ ID NO: 131068 - protein, 48 aa, Glycine max
  Coding DNA Sequence Number=SeqID_39383
MAAEWRMRKDNDKGDDKKLKDQSKNNSSESKINQRTTQVNQEQFKSSR

SEQ ID NO: 131069 - protein, 48 aa, Glycine max
  Coding DNA Sequence Number=SeqID_39384
MANPDNVATYPSAGGRRVTRECVFQERNTRGVATNVYLRKTSEKPEKT

SEQ ID NO: 131070 - protein, 150 aa, Glycine max
  Coding DNA Sequence Number=SeqID_39385
  Gene Ontology: Mol. function=oxidoreductase activity
  Homolog annotation: Hit_ID=A7PLF4; Match level="QueryCoverage=70%, HitCoverage=33%, E-value=3e-29, Identity=55%"; Hit description =Chromosome chr7 scaffold_20, whole genome shotgun sequence
MGEDPGVLEVVRQLDKACSEAGFLYVKGHGVPEALLKEVRDVTRRYFELPYEEKAKIKMTPATGFRLILVQFKIDYFISLEVCYREVSKGMYGDLGKVMEGSNQWNYSFQNRDKITTIRIRIFTQTSQDFKSLVLSLPRSKPHFFRITRI

SEQ ID NO: 131071 - protein, 238 aa, Glycine max
  Coding DNA Sequence Number=SeqID_39386
MAFGTMAAPPGELMLHLEIQYPINTKPLILQFTAIFHNDMDMIEVSSFYHRQWAPEYPEFVNFKYDGTTYQIRLRQHRAKVYFAEGLNKFRKDLSIFESMIIKFLACNNKSMFDLYFIPSLECKTCGRPQLMSRQHIWTLEITQSMLGAPGPLRLPYCAITHANACSQQMTILRRFGPPLQWNVVVVDNGVARRYVVQPWYQFLADNDFSHGDEVSFYYRSIDKIWEIVIRRKKNWDY

SEQ ID NO: 131072 - protein, 89 aa, Glycine max
  Coding DNA Sequence Number=SeqID_39387
MENHRFISKSDSAKVRSNRKRIRQQKVHLNAQDSVHASVNPASSHTEDHYNQPKTPPHSVHATVNRASHDAENHFVWLFIFFPGIDFFS

SEQ ID NO: 131073 - protein, 91 aa, Glycine max
  Coding DNA Sequence Number=SeqID_39388
MGLRIKVENGGEAKSARQSIRGAHQAYRYRRPRGGARCINEIGQRAGRGGFAYWALAECILAYYVGTDEGVSEVLSCGRRKKAAPVRQQNM

SEQ ID NO: 131074 - protein, 81 aa, Glycine max
  Coding DNA Sequence Number=SeqID_39389
MSFPQFMVLFVVNVLLSETYTLGEQHPLSKILSCLASEENLEENLPRMHALSAPSTRPVSSLSLQALSASDALSHNSLTRA

SEQ ID NO: 131075 - protein, 81 aa, Glycine max
  Coding DNA Sequence Number=SeqID_39390
MGGASRNLELGLPECFLKQDCFWRKQPSSPGRAGRQPPPFFPIKRQKGTVLRVPDSPWLCISAILGEKMISVKKIQAEVLP

SEQ ID NO: 131076 - protein, 17 aa, Glycine max
  Coding DNA Sequence Number=SeqID_39391
MEEEKKKEKMVEDDKQL

SEQ ID NO: 131077 - protein, 326 aa, Glycine max
  Coding DNA Sequence Number=SeqID_39392
  Homolog annotation: Hit_ID=Q6WAY6; Match level="QueryCoverage=74%, HitCoverage=44%, E-value=6e-13, Identity=25%"; Hit description =Putative uncharacterized protein
ARDMANQEKWVPFMDVLALLIFGVVLFPNVDGLVDLAAIDAFLAYHHSKESLVEGKEGVLFSCGDYPNIPLIGTRGCINYNPALAIRQLGYPMRGAPAEESLSPFLVRDFGAQSFKGIQRVHKAWESPLRKDKELRSIRNGIIGGYHEWLKDEEVRALKIELGKARLAKEKFKLVATDVRKECAGLREENVATTKALEQETKRARKEEHGRDKFRGALWGSNNELKLRREERDRSRAHSMILKEELAICSRSKRNLSQRLCETETNMLVIITKYQEELNLATAHEHRVADEYAQVYTEMEARGRVIDSLHQEATMWMERFAPTLNG

SEQ ID NO: 131078 - protein, 44 aa, Glycine max
  Coding DNA Sequence Number=SeqID_39393
ALETVGDFLTALCRGSVPDTREGLIPSCAFRYMPKRERIVSIGE

SEQ ID NO: 131079 - protein, 75 aa, Glycine max
  Coding DNA Sequence Number=SeqID_39394
  Subcellular localization annotation: CTP_CleavageSite=46; ConfidenceScore=5.35e-01
MIGPLDESISYKGGPLGTSTYRLQRTTRPRLQRVACPCLQRNTRPYLQRVTGPRLQRTIRPPLQRTTRPRLQRTT

SEQ ID NO: 131080 - protein, 58 aa, Glycine max
  Coding DNA Sequence Number=SeqID_39395
MEVRAFDGTRREGVVPSTLHQKLKFVVEGHLVIVSGEEDILVSCPSSMPYVGSRRGIH

SEQ ID NO: 131081 - protein, 91 aa, Glycine max
  Coding DNA Sequence Number=SeqID_39396
  Subcellular localization annotation: CTP_CleavageSite=63; ConfidenceScore=5.35e-01
MVAAQLAQASSARPGELGCFLQKQPSGGPKWAWVLFAPPFLLSTPPSAFFCMSWNFTNCLMMDASTSQGPKKSRMSSSKGPRTKLGYDNGE

SEQ ID NO: 131082 - protein, 147 aa, Glycine max
  Coding DNA Sequence Number=SeqID_39397
MYGWSPTFFVMKVDLSVPYKVIACVPRKGKQIGRNFWQRVQKAWNAVERKDKELRGSNNGVISDYHKWLKLKISSGEEAEVPAEREEVQALKAKLERTRVVKEKFKMAATRVRKEYDELRDVNMAMTEALERETKRARKEEWGRNKF

SEQ ID NO: 131083 - protein, 156 aa, Glycine max
  Coding DNA Sequence Number=SeqID_39398
  Homolog annotation: Hit_ID=A7Q8B9; Match level="QueryCoverage=39%, HitCoverage=15%, E-value=1e-25, Identity=90%"; Hit description =Chromosome chr14 scaffold_63, whole genome shotgun sequence
MAPAASKGKRNRKTGLDSFHACSHSARGDIAQLVELRSCNWVVAITGWMSNCPRRNGKEDRNMPLKDSTETKTGCQERRGGRMGSWSDLGFLIWDPGEEDQAGPCEQLDALSPFNPLSEMWQKEKESMDRPHRLHPVGTTRSPQGRLRHPGVADRP

SEQ ID NO: 131084 - protein, 131 aa, Glycine max
  Coding DNA Sequence Number=SeqID_39399
MWVFLTGRQIDWAHLPFVKVKRSFSIGANVVSSFGYRKERDGSWVKKDAPVQAAEDCSPSPHSQRDDSSSLLHIILERFDGLQTYDGERFDALERQVDTRFDEMDSRITKVEEDVTIIRDCLDLPPPPPLV

SEQ ID NO: 131085 - protein, 98 aa, Glycine max
  Coding DNA Sequence Number=SeqID_39400
MVQKKDKELRGSNNGPIGGYRRWLKAHMQGLDWLPSLRTTKGVEVEAPEEDEELPPRPWNKRPKGLVGKNMAGTNSEGLYGAVTASLSFGERKGTNHE

SEQ ID NO: 131086 - protein, 150 aa, Glycine max
  Coding DNA Sequence Number=SeqID_39401
MANQEEWVPFADILALLIFGVVLFPNVDGLVDLASIDAFLAYHHSKESLMEAAQSTDFLDGRKERVFAWESPLRKDKELRGIRNGIIGGYHEWLRVHTRGLDWLSKLKIINEENFEALEEDKEVQALKSELGKARLAKEKFKSVAIDIRK

SEQ ID NO: 131087 - protein, 217 aa, Glycine max
  Coding DNA Sequence Number=SeqID_39402
  Homolog annotation: Hit_ID=Q10FP6; Match level="QueryCoverage=76%, HitCoverage=16%, E-value=3e-07, Identity=27%"; Hit description =Transposon protein, putative, CACTA, En/Spm sub-class
  Subcellular localization annotation: CTP_CleavageSite=37; ConfidenceScore=5.09e-01
MAKFDIAEATKVKTKVMSTVATRWRQFKSTLTSKFVFAKTEGQQTQDVVTKYGLDPEAWKQFEETRLTPNWEKLLDQKRKRIQEEALLSENPASVDEPPSPIKRHVKWKVARTRAVGNMTSDSAQEIADKIVTQGSFVPHGRQDILNTAIGRPDHGGRVRAAGSGVTITQYYGRASRTCSSSSTSISQQQLDEVVARLREDMTGQIREELRTQIKEE

SEQ ID NO: 131088 - protein, 133 aa, Glycine max
  Coding DNA Sequence Number=SeqID_39403
MDNEEGVQEQMKADLSALKDQMASISEDKATATASSTVREAEPVLQPALNPGRDRNTAVFGRRYSPQAYPYGLPPDFTPRATPEDLSQAPTFEGQLPPYDDYPGQDDEEGDTHLGPLLHLKDPSPHELPQPNI

SEQ ID NO: 131089 - protein, 124 aa, Glycine max
  Coding DNA Sequence Number=SeqID_39404
  Subcellular localization annotation: CTP_CleavageSite=53; ConfidenceScore=5.23e-01
MTMQNMQFQQETRASIQSLTNQMGQLATQLNQQQSQNSDKLPSQAVQNPKNVSAISLRSGKQCQGPQPVAPSSSANEPAKLHSIPEKGNSDLQKQHIPPLPFPPRAPQFPQKNGRGRERDLGNI

SEQ ID NO: 131090 - protein, 299 aa, Glycine max
  Coding DNA Sequence Number=SeqID_39405
  Homolog annotation: Hit_ID=Q84VH5; Match level="QueryCoverage=93%, HitCoverage=47%, E-value=1e-118, Identity=71%"; Hit description =Envelope-like protein
MAQKKSTPITPTTSRRSKVAIPSKKRKEISSSDSDDDVELDVSTSKRAKKSGKKVPENVPDAPLDNISFHSIGNAERWKFVYRRRLALERELGRAALDCKEIMDLIKAAGLLKSVTKLGDCYESLVREFIVNIPSDITNRKSDEYQKVFVRGKPTDGVIDIAVSEHQIAKEITAKQVQHWPKKGKLSAGKLSVKYAILHRIGAANWVPTNHTSTIATESFAVKLPIAFPTVLCGIMLSQHPNMLNYTDSVMKRESPLSLHYKLFEGTHVPDIVSTSGKAAASGAVSKDALIAELKDTCK

SEQ ID NO: 131091 - protein, 149 aa, Glycine max
  Coding DNA Sequence Number=SeqID_39406
MTLLLSNILPSDRNANLPLQKYQLVCVVPTWGSHPQRHPVDPEKSNRALGFPALVTGLYQSYRVPVPPQQGHIIIGIAPARHPVDLKKSNRVLELSSSITGLCQFYGVSVAPAKSSDPLPIELSSRSTAPPGRRRAKHHSSIGMAGSGQ

SEQ ID NO: 131092 - protein, 179 aa, Glycine max
  Coding DNA Sequence Number=SeqID_39407
DYTSSTVRGLHALTSEDYMSRLERSCTPSPWVLVTFTFRGLHVLAFKRVMYLQLQRTTRPRRQRVMTTRPRHQRTTCSPIFKGGHALTFRGLHVLAIIGLHSLAFERRHVLNFRGLHALAFRGLRVLTFRTSSFLLTVPGPPPDIGGGPTVRAQPEREAITQLLCILGQDFTRAAAKRR

SEQ ID NO: 131093 - protein, 130 aa, Glycine max
  Coding DNA Sequence Number=SeqID_39408
  Subcellular localization annotation: CTP_CleavageSite=70; ConfidenceScore=5.33e-01
MSRWYDLARGDGHPVGLTEARNPSWNPRALLGSFGSTGCLTNRYFRRGRSTLRSLGRMLLSSNVIYINVRVVMLVRMIRTRLFAVARVKSCLGMHSSYAIASSSGCARIVGRPLISGGGPGTDKRKLLAP

SEQ ID NO: 131094 - protein, 151 aa, Glycine max
  Coding DNA Sequence Number=SeqID_39409
VVPFMVRLMKQANVFPLKKTLKKFIIWEINSDKDQSGPSNRPIQEGPNIFQRTTKLEETLTQFMQVTMSNHKSSESALKNLEVQARQLAKQIVDKSSNNFVANIEQNPKEECKAVMTMSKRFVEAEDEDSVVHKKKTADKKGTDGKKNEVR

SEQ ID NO: 131095 - protein, 147 aa, Glycine max
  Coding DNA Sequence Number=SeqID_39410
MESNFSHNFRIRNSVKRKPNSKKCLRIVASILDGGKGYNSAVECHLDVVEVISSSLIIPKPNARGITRGVGGLYFWERTPVEYEAPGYKLCLGMEENSESALSTNKEAISNATRNLMESSILAQDERWRHALHMQVGREVVFPVADG

SEQ ID NO: 131096 - protein, 114 aa, Glycine max
  Coding DNA Sequence Number=SeqID_39411
MTKSTYDMVWGKTSEQQQDGVFKESWKIKLPPKITMFAWRSSILSLWQDNSSMVGVLVLGGYVGCLPKTPNATLSPTYTWSERGNEDKAIKEVSGENYIEQAAMRDVQKAYVYE

SEQ ID NO: 131097 - protein, 18 aa, Glycine max
  Coding DNA Sequence Number=SeqID_39412
FLMIVSIVNLNFGDSIAG

SEQ ID NO: 131098 - protein, 179 aa, Glycine max
  Coding DNA Sequence Number=SeqID_39413
  Subcellular localization annotation: CTP_CleavageSite=28; ConfidenceScore=5.58e-01
YLALDGIYRPIGAAFPNNPTRRQRLVVRQGPGTTGLSPSLAPPSRGLGPGPPLRTLLQTTIRTPRATDFHGRRALGPNGFGRNLRQRLDGHGFCNSHKYRISLRSSSMQSRDIRCRESLYVNVCRDDSRGTPSPGPRESHLTDLSSLAHEAPGFVFVARTRRPGARGAVVIPSLPTVDE

SEQ ID NO: 131099 - protein, 125 aa, Glycine max; identical to SEQ ID NO: 103443
  Coding DNA Sequence Number=SeqID_39414

SEQ ID NO: 131100 - protein, 163 aa, Glycine max
  Coding DNA Sequence Number=SeqID_39415
  Homolog annotation: Hit_ID=Q6WAY6; Match level="QueryCoverage=92%, HitCoverage=26%, E-value=4e-12, Identity=31%"; Hit description =Putative uncharacterized protein
EGKEGVLFSCGNYPNVPLIGTRGCINYNPALAIRQLGYPMRGAPTEESHSPFLLRDLGAQSLKVIQRVHKAWRSPLRKDKELRGIRNGVIGGYHGWLRVHTRGLDWLSKLKVIDEENFKALEEDEEGSNNELKLRREESIGQYKEELNQSVTYEQKLVEDFAQ

SEQ ID NO: 131101 - protein, 123 aa, Glycine max
  Coding DNA Sequence Number=SeqID_39416
  Gene Ontology: Mol. function=monosaccharide-transporting ATPase activity; Cellular component=plasma membrane; Biological process =carbohydrate transport
  Homolog annotation: Hit_ID=Q5PJX5; Match level="QueryCoverage=100%, HitCoverage=30%, E-value=1e-52, Identity=76%"; Hit description =Ribose import ATP-binding protein rbsA
  Pfam annotation: Domain name=ABC_tran; Domain location=1-93; Score= -2.5; E_value=1.2e-06; Accession=PF00005.18; Description=ABC transporter
MSLTALRYFSHSGGHRPVSGGNQQKVAIARGLMTRPKVLILDEPTRGVDVGAKKEIYQLINQFKADGLSIILVSSEMPEVLGMSDRIIVMHEGHLGGEFTREQATQEVLMAAAVGKLNRVNQE

SEQ ID NO: 131102 - protein, 124 aa, Glycine max
  Coding DNA Sequence Number=SeqID_39417
  Homolog annotation: Hit_ID=A5BSR3; Match level="QueryCoverage=61%, HitCoverage=24%, E-value=4e-10, Identity=43%"; Hit description =Putative uncharacterized protein
MAEKTKKKLEEAAQSGSTKGVIDPPSPIKRHMKWKMACTKKTGQMTSEVAKEIAEKIDSLEEQASRGSFVPHGRQDLLAAAIGRPEHPGHVRAVGADVAIKKYFGSASRTSRVLPPWLLKNSSS

SEQ ID NO: 131103 - protein, 82 aa, Glycine max
  Coding DNA Sequence Number=SeqID_39418
  Gene Ontology: Cellular component=mitochondrion
  Homolog annotation: Hit_ID=Q5M9X3; Match level="QueryCoverage=97%, HitCoverage=65%, E-value=2e-18, Identity=62%"; Hit description =Putative uncharacterized protein orf138c
MPYTWLYSYGLVLDGRTNGERGKGEAGLEERAVQERGDIASKQQVLPSRPYSTSYNKLATLIEERDVGERFCNLRLVTLFAH

SEQ ID NO: 131104 - protein, 48 aa, Glycine max
  Coding DNA Sequence Number=SeqID_39419
MGRKQRSNLFVDELRRTPEVMAVRLLPAAGHPQAGVVFRPAPAWGRST

SEQ ID NO: 131105 - protein, 238 aa, Glycine max
  Coding DNA Sequence Number=SeqID_39420
MKADREAMKEQMATMMEAMMSMKKIMEANAVALAATSAVDKVNPTPPSGLNQMNHPISDIVGKDLGSTGGPHYVQIQNKHAFPLYGLPANYTPPNVAYTPNENVNNSTPILIESQQPQSDHAHVSQPMGETHEIPHHNLADFEPCLGYATEGQAVGGIPLQNTLEGPQFRPQPQHFYGKMVGYTPSSFVDLVFVGERIKVGLERGKSDHPALMNAKTGANEEDENEGETLAMTTIPTR

SEQ ID NO: 131106 - protein, 40 aa, Glycine max
  Coding DNA Sequence Number=SeqID_39421
MVEALQHQHKKVYALSGGVGGCWAKGLEGQRVWNKRCIKQ

SEQ ID NO: 131107 - protein, 68 aa, Glycine max
  Coding DNA Sequence Number=SeqID_39422
FFAYRCGRMIEEVWGCLPQRQPSWVTSFERDRVMQSYPPRALDRRLQEDWLKDSREGPRVLMSLRVDF

SEQ ID NO: 131108 - protein, 61 aa, Glycine max
  Coding DNA Sequence Number=SeqID_39423
MGVQIAPRPTWALQNIPPEGENLSRGASETFPYVFREESRKGFTVLRRSSFVLHRSSIFNG

SEQ ID NO: 131109 - protein, 74 aa, Glycine max
  Coding DNA Sequence Number=SeqID_39424
MHTRARFRPGCCMETRIAPTRHPADPNQSNRVLGFPTLITGDENPETSQIQAKGPSGEGRRPKWRRIKPPSGEG

SEQ ID NO: 131110 - protein, 76 aa, Glycine max
  Coding DNA Sequence Number=SeqID_39425
MAMLHCFSRFSEQNPSRPTLDGVQFPSLGQGKKESLVARFSEVEMKSAVWTMSPLLASWWFAFFMEQFSFSCGKEN

SEQ ID NO: 131111 - protein, 64 aa, Glycine max
  Coding DNA Sequence Number=SeqID_39426
MGDILGVDLRHEFSAEAEQEGRRQRARRNPDRQARRLNLWYLILLVMELLFQSPFVIESPSWTP

SEQ ID NO: 131112 - protein, 132 aa, Glycine max
  Coding DNA Sequence Number=SeqID_39427
  Homolog annotation: Hit_ID=A5AK77; Match level="QueryCoverage=47%, HitCoverage=7%, E-value=2e-07, Identity=42%"; Hit description =Putative uncharacterized protein
MTRGNPSNLQPFDPEIDRSFHRLFRHHLVPFEHPEHSVIGDFEHYRFEHSDLEHSKNMAQPPPCERTLREMAAPDFTYESLCIQYPDEDVPYVLKTGLIHLLPKFHGLAGEDPHKHLKEFHIVCSTMKPPDV

SEQ ID NO: 131113 - protein, 435 aa, Glycine max
  Coding DNA Sequence Number=SeqID_39428
  Gene Ontology: Mol. function=transporter activity; Cellular component= integral to membrane; Biological process=transport
  Homolog annotation: Hit_ID=A4W5X2; Match level="QueryCoverage=41%, HitCoverage=70%, E-value=6e-34, Identity=44%"; Hit description=Inner- membrane translocator precursor
  Pfam annotation: Domain name=BPD_transp_2; Domain location=1-200; Score=37.8; E_value=4e-08; Accession=PF02653.7; Description=Branched- chain amino acid transport system  permease component
PIDILNRAAPVALLAIGMTLVIATGGIDLSVGAVMAIAGATAATLTVAGHSLSFIILATLGTGLLCGLWNGVLVALLKIQPFVATLILMRFAVAAAGTGVDYPAGGRGGVAADAQNRAWPVHRSVAGLIVAADIRGADANNAGLWLELDAILAVVIGGASLMGGRFNLVLSLVGALIIQAEPGGESSGGDVRSAAAVAALYRHAEGETQFPGFASTRVICNILTDNAFLGIIAVGMTFVILSGGIDLSVGAVIAFTGVFLARIIGDYHVDPLLAFALILAAGALFGAMMGWLIDALKIPAFIITLCRDVFPARLQLSGVGELDSYRSSAVYHAVEPGVENSRRRTSQPAGGDYAGGGSGGHSAGAPYALRHRIFHLHLGRLRAGRAGRRAGCHRLGGDWRYAAVGRRRYGAGHAVRGVDSGRLLTVKWDRQQNAP

SEQ ID NO: 131114 - protein, 104 aa, Glycine max
  Coding DNA Sequence Number=SeqID_39429
MENNDGLWWLMVTVGDGETTRKQRQKCLNKRCSREWKLLAHSRHLLKDPNGQIMYKCHVKLQTKCREDPAVNKGWEAFLPRKLHVAFSRSFIKRLLPEASSWLL

SEQ ID NO: 131115 - protein, 76 aa, Glycine max
  Coding DNA Sequence Number=SeqID_39430
  Subcellular localization annotation: CTP_CleavageSite=49; ConfidenceScore=5.42e-01
MGVQIAPRPTWALQNIPPEGCCFWSKQPGSPGKSKPRRFRNISVTFSVKNFAKGSTVLRHSSFVLHRSSISTGPTA

SEQ ID NO: 131116 - protein, 105 aa, Glycine max
  Coding DNA Sequence Number=SeqID_39431
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQFGDCALQGSYS

SEQ ID NO: 131117 - protein, 51 aa, Glycine max
  Coding DNA Sequence Number=SeqID_39432
MAEINQGTDASGARVTTDRSLPLPGAKQAENVAARQPNILCVRSFFYYCLF

SEQ ID NO: 131118 - protein, 136 aa, Glycine max
  Coding DNA Sequence Number=SeqID_39433
FLNIRDGLSMCGSEVVKDFTKITENSSGLLEYWTGEGYHYWKTRMQIFKEAIDLKIWEAIEFDSFIPTMNEKSDKRNFKENEEKKGYITWEDNAINSSSDLENKIISLGIMMKEYENGEEQSRYIDSNFSINTWHA

SEQ ID NO: 131119 - protein, 61 aa, Glycine max
  Coding DNA Sequence Number=SeqID_39434
MPPQTHEMAPKKLSTKRSRKDATREGSSAALEFYSHLFRSAEHQQCFEAIKGWSFHTERRV

SEQ ID NO: 131120 - protein, 70 aa, Glycine max
  Coding DNA Sequence Number=SeqID_39435
MARSVSAPCPYSTDLYGRELTRLLVIIPKVVISLLMVSRGIIPFEEHIAAVGTTSNNTFSKRKTLDEGSL

SEQ ID NO: 131121 - protein, 65 aa, Glycine max
  Coding DNA Sequence Number=SeqID_39436
MVWQSPNQKSIFSKLEFDSLVTIYIKISRAHRRPAYKPQVFINKETEAAAEPHRIGEGRREKDEK

SEQ ID NO: 131122 - protein, 34 aa, Glycine max
  Coding DNA Sequence Number=SeqID_39437
VEGRSPEFQEHLNLRSNPFQEGGDDAILPPKGIG

SEQ ID NO: 131123 - protein, 99 aa, Glycine max
  Coding DNA Sequence Number=SeqID_39438
MRHQIPMIGGMMNVLSGETLFCKITHAPNIFMICVHRDSLGRNNQHENKEKGMFYSITFLDFLNSDQGLPMDPKRIKVIPEWPTPPCVGYPRNVGFFSP

SEQ ID NO: 131124 - protein, 261 aa, Glycine max
  Coding DNA Sequence Number=SeqID_39439
GGVEGGGFEGGCVCGFGFGVGGVRDEEEDTAFAAMGRIPLLIAIVAKPLFTAEGNFVGAWGAEEMWEGEGARTSRRISGDNPEMKQLSKKGGGRPITRLARRSNSVSKTGLQSLQEPGPGSDESVAEHPLVPAKGGAVEVEGGDSDALLFRSVLIVKELGYLEYPAKRVAAIEAWDVQLDGTAVRGLGTSAGRGRVGGVVGIKLVELGEDGVDLAGKVHVFIGEVSVLVEKRRMVDGKARDGVLKPIRGGLASTMVGHGTA

SEQ ID NO: 131125 - protein, 37 aa, Glycine max
  Coding DNA Sequence Number=SeqID_39440
MACEERVACGADRQGNDERFIFVGDGQKGCSGSYWNI

SEQ ID NO: 131126 - protein, 158 aa, Glycine max
  Coding DNA Sequence Number=SeqID_39441
  Subcellular localization annotation: CTP_CleavageSite=83; ConfidenceScore=5.38e-01
MPPKVSSSSGRGGRSSTKGKEVLLALPEPITKKATTTSSGSPTQTGSSTHKGKLEGSLTQTTTIKSESSTQESPKPTTSKQTVADYAWSIQTLLALEDIGLTKIPKLAKKTWAEMASESDDNSETDLQKQIQKAKQTKIVCNQKPSQSLTKQESTPQP

SEQ ID NO: 131127 - protein, 71 aa, Glycine max
  Coding DNA Sequence Number=SeqID_39442
MTLRLAPPSRLVRVSGFKLSANRHILLGRPWQFDKKAIHNGLTNEITLTHGSKKFKLVPLNLHKWLGIKYK

SEQ ID NO: 131128 - protein, 114 aa, Glycine max
  Coding DNA Sequence Number=SeqID_39443
VEECMVCLGQQHFGWKEQAAIVVVEGISFKLLNCSRLTKASSLPSSFLVSADEDEFVATSCTPQMTIASFLALNCWELDAIFSIKFLASTGVMSPRAPPQAASIMLLSMLLSPS

SEQ ID NO: 131129 - protein, 324 aa, Glycine max
  Coding DNA Sequence Number=SeqID_39444
  Gene Ontology: Mol. function=motor activity; Cellular component=cell projection
  Homolog annotation: Hit_ID=UPI00016621D1; Match level="QueryCoverage =56%, HitCoverage=39%, E-value=1e-22, Identity=38%"; Hit description =UPI00016621D1 related cluster
GGPLGTSTLTFRGLHVLTFRGLHVLTFRGLHALAFRGLHALAFRGLHVLDFRGLHSLTFRGLHALTFRGLHILTFRGLHVLTFRRLHVLTFRGLHILIVRGQHVLAFRGLHVLTFRGLHTLAFRGLHTLTFRGLHILTFRGLHVLAIRGLHALTFRGLHVLTFRGLHTLTFSGLHVLAIRGLHALTFRGTTRPRLQRTRRPHLPGPPSDPGGATNCASTTREGGYRVTTMHIGARFHPCHCKETSADRIVPTRHPVDPKEPNKALGFPTLVMGLCQSYRVPVPPARDRAHKTPSRPGGAQQGPGVSGSGYGPLSVLQGARPLSK

SEQ ID NO: 131130 - protein, 191 aa, Glycine max
  Coding DNA Sequence Number=SeqID_39445
  Gene Ontology: Mol. function=endonuclease activity
  Homolog annotation: Hit_ID=A5BKB8; Match level="QueryCoverage=42%, HitCoverage=23%, E-value=2e-37, Identity=93%"; Hit description =Putative uncharacterized protein
MPTRDQRMLLLGLRWHPYEKSKSLGSGGSMVARLKLKGIDGRAPPGLFLDSMGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 131131 - protein, 65 aa, Glycine max
  Coding DNA Sequence Number=SeqID_39446
MDYNQWTYDHTMSQEVDMDYENKQECGVNQPPHVDCSEAFNTSQVFGTRDDVLLWAGSIAHENGF

SEQ ID NO: 131132 - protein, 250 aa, Glycine max
  Coding DNA Sequence Number=SeqID_39447
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGIRSFVKRQLLVSSVSVSLSLYAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131133 - protein, 114 aa, Glycine max
  Coding DNA Sequence Number=SeqID_39448
MEAPGKLKYSLLFTRMSDSGTSDIETLEIEQRKLSRNSNGHTFSYGCPIQAHHMSRLSKFNNVHNISRRWLLNNGCTREFQMVIKFHSDVRFKRVIYRDARNRTTEALEKLKWS

SEQ ID NO: 131134 - protein, 191 aa, Glycine max
  Coding DNA Sequence Number=SeqID_39449
PPVGRQPGVERQVDQIAAVVAHRRAQHVPGHAVVENIDTAAAPQVLQPEQPHGQGQAVLFIRLLAQAGGGADLGIDRRAGVDPDIDAVFIAVQGVGAGVAGGYFDRRFDECAAIEQILPPSRLYAGQQRRGSHTLRVDVQVGGQMVGLVGSQVLGDHVDEGAVLMDPGIVQADAARGVLFRKTAFPLRGAS

SEQ ID NO: 131135 - protein, 220 aa, Glycine max
  Coding DNA Sequence Number=SeqID_39450
DPDWLSKLKVIDEENFEAPEEDEEVRALKLELGKARLAKEKFKSAVTHIRKECTELQKENAATARALEQETKRAHKEEHGREKFRGALWGSNNELKLRREERDRSRVHGMILKEELAACARSKRSLAQHLEATEQSMLAIIGQYKGDLNQSVTHEQKLVEDFAQVYAEKEARGRVIDALHQEATMWMDRFALTLNGSQDLLCLLAKAKAMAEVCTAPEEI

SEQ ID NO: 131136 - protein, 163 aa, Glycine max
  Coding DNA Sequence Number=SeqID_39451
MASRKRKSIGTRPIAQYDTRRFHSLRLGPDTQIMFLEDIYYLRGSSEGPSPKQVRVRGHLVRIDADNLNTFLETPVVLAEEGHPGKILRKDLTTLAQVWTVLSYSNLAPTSHTLDLIVDRARLIFGLVSQMDMNVGTLIFGQITSMDQSNSSRLGFPTFIIAL

SEQ ID NO: 131137 - protein, 206 aa, Glycine max
  Coding DNA Sequence Number=SeqID_39452
MASMMSHVRYETAHEKNAATAAAVSSAAEADPTLLATTHHPPSNIVGRGRGTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMNCPRAKEEREARDSMTEDLCLVPMLAIIAKFKVPDFDKYKGTTCPTNNHLKMYCPSIDGRS

SEQ ID NO: 131138 - protein, 310 aa, Glycine max
  Coding DNA Sequence Number=SeqID_39453
  Homolog annotation: Hit_ID=Q84VH5; Match level="QueryCoverage=100%, HitCoverage=52%, E-value=1e-131, Identity=71%"; Hit description =Envelope-like protein
MDKKIRSLVNSILKNASVPDADKDVPTSSTPNAEVLSSSSKEKSTEEEDQATEETPAPRAPEPAPGDLIDLEEVESDEEPIVKKLALGIAERLQSRKGKTPITRKEISSSDSDDDVELDVPDIKRAKKSGKKVPGNVPDAPLDNISFHSIGNVERWKFVYQRRLAVERELGRDALDCKEIMDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVLTNHTSTVAT

SEQ ID NO: 131139 - protein, 521 aa, Glycine max
  Coding DNA Sequence Number=SeqID_39454
  Gene Ontology: Mol. function=nucleotide binding; Cellular component =integral to membrane; Biological process=protein insertion into membrane
  Homolog annotation: Hit_ID=Q6CYR0; Match level="QueryCoverage=61%, HitCoverage=59%, E-value=1e-133, Identity=71%"; Hit description =Inner membrane protein oxaA
  Pfam annotation: Domain name=60KD_IMP; Domain location=393-506; Score= -93.2; E_value=0.00076; Accession=PF02096.11; Description=60Kd inner membrane protein
  Pfam annotation: Domain name=DUF37; Domain location=8-75; Score =160.8; E_value=3.8e-45; Accession=PF01809.9; Description=Domain of unknown function DUF37
  Pfam module annotation: Pfam domain module=60KD_IMP::DUF37; Domain location=393-506::8-75
MASSLSPGARLLIALIRVYQRAISPLLGPHCRFHPTCSQYGVEAVRRFGMLKGSWLTIKRVLKCHPLNPGGDDPTDHAPQPQQTQTTQNTSSAAGDAASSGVPASGQGKTITVKTDVLSLNINTRGGDIEQAQLLTYPDKLGSDAPFQLLETTPAFVYQAQSGLTGRNGPDNPNNGARPLYTASQDHFEMADGQTELRVPLSWTGENGVVYTKTFVFKRGEFAVNVDYNINNASQQPLEVAMFGQLKQTIDLPKHRDTGSNNFALHTFRGAAYSTSDAKYEKYKFDTIADNENLNTTTSNGWVAMLQQYFATAWVPRTQGNNTLYTSNLGNGVAAIGYKSAPVTIAAGAQQDLGATLWVGPEIQDKMAAIAPHLDLTVDTAGCAAEVPAQLIGNWGFSIIVITFIVRGIMYPLTKAQYTSMAKMPKQAGVGGACIRLEKVEPGQAVADLVIDASLRARPLSTLLSSLLDLRIYVEAAIDFPDEEIDFLSDGKIEAQLNAVIGDLNGVRAEARQAGDSQPAA

SEQ ID NO: 131140 - protein, 522 aa, Glycine max
  Coding DNA Sequence Number=SeqID_39455
  Gene Ontology: Mol. function=phosphoglycolate phosphatase activity; Biological process=metabolic process
  Homolog annotation: Hit_ID=A8G7P0; Match level="QueryCoverage=38%, HitCoverage=91%, E-value=3e-71, Identity=62%"; Hit description=HAD -superfamily hydrolase, subfamily IA, variant 3
  Pfam annotation: Domain name=Hydrolase; Domain location=3-187; Score =91.9; E_value=2.1e-24; Accession=PF00702.17; Description=haloacid dehalogenase-like hydrolase
MSVECIFFDCDGTLVDSEVICTQSYVNTFARYGIELSLQQMFEQYKGVKLYDIIRDVTAQHQVTLPLAEVESAYRAEVARLFDLDLQPIAGARALVERVKVPMCVVSNGTVKKMEHSLGLTGMLPYLSGRLYSGYDINHWKPDPELMYHAAEQMQVPIEKCILVDDSEAGARAGIAAGIPVFYYCADAHNPVIDHPLVTRFDDMAQLPALLLPPAGEGADRAGLNPKFARTNQQNAEAGLCWGAIGKQQFNARGKGELRGFFHMAGESFRLAHAAANHKRHQRRQQANQEHTAPANHAQQRRRDKGRQQYAELPADTDPRRGAVALLLRPGFGNQRHADAKLTAQPHAGQRTIRQQIPVALRHGAQPGKQREHQDRHGQNADAAVAIAQMTKHNAADHRADQRPGHQRTGLRRIQRQRHADRRQHKAQNQQIKSIHGIAADGSHHRFRRRNGGFVVICRGHKTAPGRKMCAKYKESGRLRTGRNQAHCLSASALTGSHHVNQEGLLLPSSPDSSSSSLSPPT

SEQ ID NO: 131141 - protein, 322 aa, Glycine max
  Coding DNA Sequence Number=SeqID_39456
  Gene Ontology: Mol. function=glucosamine-1-phosphate N-acetyltransfera se activity; Cellular component=cytoplasm; Biological process =lipopolysaccharide biosynthetic process
  Homolog annotation: Hit_ID=Q5PKV8; Match level="QueryCoverage=90%, HitCoverage=63%, E-value=1e-133, Identity=83%"; Hit description =Bifunctional protein glmU [Includes: UDP-N-acetylglucosamine pyrophosphorylase (EC ...
  Homolog annotation: Hit description=2.7.7.23) (N-acetylglucosamine-1 -phosphate uridyltransferase); Glucosamine-1-phosphate N -acetyltransferase (EC 2.3.1.157)]
  Pfam annotation: Domain name=NTP_transferase; Domain location=7-227; Score=-26.8; E_value=9e-06; Accession=PF00483.14; Description =Nucleotidyl transferase
MSTSAMSVVILAAGKGTRMYSDLPKVLHSLAGKPMVQHVIDAATGLGAQQVHLVYGHGGELLQEKLAHNPLNWVLQAEQLGTGHAMQQAAPFFADDEDILMLYGDVPLIAQETLQRLRDAKPAGGIGLLTVVLDNPTGYGRIVRENGTITGIVEQKDASAEQLKIQEINTGILIANGADLKRWLAQLNNHNAQGEFYITDIIAMAHQEGRVINAVHPARISETDGVNNRLQLSTLERTYQREQAEKLLLAGVMLRDPARFDLRGTLQHGRDVDIDTNVIIEGNVTLGHRMPRWPPPAPSGRLRACVRAANWPNRRTSATSSR

SEQ ID NO: 131142 - protein, 465 aa, Glycine max
  Coding DNA Sequence Number=SeqID_39457
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=A7ZTU4; Match level="QueryCoverage=100%, HitCoverage=100%, E-value=0.0, Identity=88%"; Hit description=ATP synthase subunit beta
  Pfam annotation: Domain name=ATP-synt_ab; Domain location=134-347; Score=314.3; E_value=2.2e-91; Accession=PF00006.16; Description=ATP synthase alphabeta family, nucleotide-binding domain
  Pfam annotation: Domain name=ATP-synt_ab_C; Domain location=360-465; Score=169.8; E_value=7.4e-48; Accession=PF00306.18; Description=ATP synthase alphabeta chain, C terminal domain
  Pfam annotation: Domain name=ATP-synt_ab_N; Domain location=6-73; Score=95.7; E_value=1.5e-25; Accession=PF02874.14; Description=ATP synthase alphabeta family, beta-barrel domain
  Pfam module annotation: Pfam domain module=ATP-synt_ab::ATP-synt_ab _C::ATP-synt_ab_N; Domain location=134-347::360-465::6-73
MAAGKIVQIIGAVVDVEFPQDAVPQVYSALEVKNGDARLVLEVQQQLGGGVVRTIAMGSSDGLKRGLEVTDLKKPIQVPVGKATLGRIMNVLGEPIDMKGDLKEEDGSAVEVSSIHRAAPSYEEQSNSQELLETGIKVIDLMCPFAKGGKVGLFGGAGVGKTVNMMELIRNIAAEHSGYSVFAGVGERTREGNDFYHEMTDSNVIDKVALVYGQMNEPPGNRLRVALTGLTMAEKFRDEGRDVLLFIDNIYRYTLAGTEVSALLGRMPSAVGYQPTLAEEMGVLQERITSTKTGSITSVQAVYVPADDLTDPSPATTFAHLDSTVTLSRQIASLGIYPAVDPLDSTSRQLDPLIVGQEHYDVARGVQSLLQRYQELKDIIAILGMDELSEEDKLLVARARKIQRFLSQPFFVAEVFTGSPGKYVTLKDTIRGFKGIMEGEFDHLPEQAFYMVGAIEEAVEKAKKL

SEQ ID NO: 131143 - protein, 114 aa, Glycine max
  Coding DNA Sequence Number=SeqID_39458
MINGEDEYNNRGDPYGYIDYIQLLEKTNRPLHEGHRTRERGRRETPKEFRRLVLGEFFLAKGEENEKMNSTSFQGLENQKTSESFWFKEEEEVQRDSRLVKDCKRLIGKVFKIE

SEQ ID NO: 131144 - protein, 125 aa, Glycine max
  Coding DNA Sequence Number=SeqID_39459
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=32%, E-value=2e-11, Identity=90%"; Hit description=LacZ protein
  Pfam annotation: Domain name=ATP-synt_C; Domain location=13-56; Score= 20.7; E_value=0.00017; Accession=PF00137.12; Description=ATP synthase subunit C
YEEIIMNPIISAASVIAAGLAVGLASIGPGVGQGTAAGQAVEGIARQPEAEGKIRAHPPFASWRNSEEARTDRPSQQLRSLNGEWDAPCSGALSAAGVVVTRSVTATLASADVRRCFCRYAPPRQ

SEQ ID NO: 131145 - protein, 272 aa, Glycine max
  Coding DNA Sequence Number=SeqID_39460
IVLEFYANAWPTEEGVRDMRSWVRGQWIPFDADAIGQLLGYPLVLEEGQECEYGQRRNRSDGFDEEAIAQQLCIPGQDFARTAAGRRVRIMRTNMTTLTQIWMTLLLSNILPSDHNSDLPLPKCQLVYAILTRMSVHVAQLIADAIYIFAVPVAPTKVIRPPITRAFIEKYCTQRQAQGDAPQAAGAPPPPHQAGQAGAFDMEQYLRHFGFASRGANHRAHTSSGQRLRGPGDWPEALAGKAPPEAPGDGEEAHEDEEMADLLDFLGGSGDT

SEQ ID NO: 131146 - protein, 109 aa, Glycine max
  Coding DNA Sequence Number=SeqID_39461
  Homolog annotation: Hit_ID=A0PAV3; Match level="QueryCoverage=34%, HitCoverage=17%, E-value=5e-07, Identity=76%"; Hit description =Restriction endonuclease
  Pfam annotation: Domain name=Ins_element1; Domain location=43-102; Score=-14.0; E_value=0.0028; Accession=PF03811.4; Description =Insertion element protein
MVKVGTSYVPINVSFSPKVGPGLPGINRDTRIYLFCEVIFRHSCPSCSATDGVVRNGKSTAGHQRWQAAQLLGRAIGAGLFAITPAGERGMCCKAIKLGNARVFPVTTL

SEQ ID NO: 131147 - protein, 170 aa, Glycine max
  Coding DNA Sequence Number=SeqID_39462
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=95%, HitCoverage=32%, E-value=2e-77, Identity=71%"; Hit description=DNA -directed RNA polymerase subunit beta'
  Pfam annotation: Domain name=RNA_pol_Rpb1_2; Domain location=59-137; Score=49.5; E_value=1.1e-11; Accession=PF00623.11; Description=RNA polymerase Rpb1, domain 2
STPGELVMCQEKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRLDFDGDQMAVHVPLSLEAQAEARLLMFSHTNLLSPAIGDPISVPTQDMLIGLYHINERESS

SEQ ID NO: 131148 - protein, 83 aa, Glycine max
  Coding DNA Sequence Number=SeqID_39463
MPPTRHPLDPDKSNRALGFPALIMGLCQSFGVPVTRSKVIRPPITRAFIEKYCTPRQAQGDAPQAADVASLNNDWFNKGKLSL

SEQ ID NO: 131149 - protein, 165 aa, Glycine max
  Coding DNA Sequence Number=SeqID_39464
  Homolog annotation: Hit_ID=A5BSR3; Match level="QueryCoverage=46%, HitCoverage=24%, E-value=7e-08, Identity=40%"; Hit description =Putative uncharacterized protein
MGPCSRSDGVEDTVYEKYGISKEKWAQFCQTRRDLSWEDVRKKAQAIQKQNTAPHVVSRGGYDYLEQKLLAEKMKKKLEEAAQSGSVDGVIDPPSPVRRHVKWKMVRTKKTREMTTEAAKEITVKIDSFEEQATQGSFVPHGRQDVLAASIGRPEHPRRVRAAGT

SEQ ID NO: 131150 - protein, 29 aa, Glycine max
  Coding DNA Sequence Number=SeqID_39465
TLGHGNKKWGGRQKQGFCSYICDEELRPT

SEQ ID NO: 131151 - protein, 80 aa, Glycine max
  Coding DNA Sequence Number=SeqID_39466
PLIELVRNHVPSWEDAQEMGVEGRSPKFQEPRHLRLQEDWARDAREGPRVLFDGKWSMCWSSYWATDATKDVFLPNNIPL

SEQ ID NO: 131152 - protein, 91 aa, Glycine max
  Coding DNA Sequence Number=SeqID_39467
MDWCEQNFAQVQKNACVWLAVESLVQNEFWMFASRSPTLGRIDGDPVLRETRIWATWEYVSSVGGGQQGMVGLCAHCGCGKLVVHHRPTAT

SEQ ID NO: 131153 - protein, 98 aa, Glycine max
  Coding DNA Sequence Number=SeqID_39468
MGGTERILVIIPKVVISLFMVSRGIIPFEKHITAVGTTSNNMLSKRKTLDEGSLLSSKSETQHDHKFTSTPYVPMDPGIGPLFNSPCVQKGVGVACIK

SEQ ID NO: 131154 - protein, 251 aa, Glycine max
  Coding DNA Sequence Number=SeqID_39469
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEWLLFLSAVPPVQLLTGWVRNGKKHRRTSALASVAVTAARRVPFAIQAAQLLGRAIGAGLFAITPAGERGMCCKAIKLGIRSIEVTVLNIPFHRAVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131155 - protein, 150 aa, Glycine max
  Coding DNA Sequence Number=SeqID_39470
MAKFDPDIVLEFYANAWPTEEGVRDMQSWVRGQWIPFDADALSQFLGDPLVLEEGQECEFSQRRNRADGFDEEAIAQLLCIPGQDFARTAAGRRVRIMRTSMTTLTQMWMTLLLGNVLPSDHNSDLPLPKCQLVCHPPGSLYTRISLTGP

SEQ ID NO: 131156 - protein, 95 aa, Glycine max
  Coding DNA Sequence Number=SeqID_39471
YYGTFSRQDKSFNGSKETLKLSVRISDLWFISTPKKSEQDEMVFVDSDCVLGDIPFRKYRFVGFADVVADQFEPGLLVDVIGVVEEVVFRQVSGK

SEQ ID NO: 131157 - protein, 108 aa, Glycine max
  Coding DNA Sequence Number=SeqID_39472
MAKYDPEIVMEFYANAWPTEEGVRDKSSWVWGQWVPYDEDAINQFLGHPLVLEEGQRYEFSEMRSQASGFYKEAIDQLLCIPGQDFARSVTGRWVRIMRTSMNTLTQI

SEQ ID NO: 131158 - protein, 84 aa, Glycine max
  Coding DNA Sequence Number=SeqID_39473
MGKVVKVQEQMKADMEVMKEQMDTMMEAMMSMKKIMEANAVTVAATSTVAKVNSTSPSGINQMNHPTSNMLSSSFSSQGGELSY

SEQ ID NO: 131159 - protein, 96 aa, Glycine max
  Coding DNA Sequence Number=SeqID_39474
  Homolog annotation: Hit_ID=A5BTJ9; Match level="QueryCoverage=70%, HitCoverage=6%, E-value=9e-11, Identity=50%"; Hit description =Putative uncharacterized protein
MEQEGGLCDGKEVDQFHQPSGSNEVAIANEDGISYGSELIEVDKVKINQDGALWDIFWRQDVPKLQEYLKKNFREFRYVHCCRLKQDWVKDQAANK

SEQ ID NO: 131160 - protein, 149 aa, Glycine max
  Coding DNA Sequence Number=SeqID_39475
MAPRKLASKRSRKDKAAEGTSSAPEYDSHRFRSAEHQQRFEAIKGWSFLRERRVQLRDDEYTDFQEEIVRRWWASLVTPMAKFDPDIVLEFYANAWPTEEGVRHMRSWIRGQWIPFDARCYRPAPGISFSAGRGSECEYGQRRTGPMVR

SEQ ID NO: 131161 - protein, 211 aa, Glycine max
  Coding DNA Sequence Number=SeqID_39476
  Gene Ontology: Mol. function=oxidoreductase activity; Biological process=metabolic process
  Homolog annotation: Hit_ID=A8ADQ4; Match level="QueryCoverage=67%, HitCoverage=20%, E-value=3e-62, Identity=83%"; Hit description =Putative uncharacterized protein
  Pfam annotation: Domain name=DUF752; Domain location=80-210; Score =53.4; E_value=8.1e-14; Accession=PF05430.2; Description=Protein of unknown function (DUF752)
MFGSSSSTGAKRPSRRDARTSCWLLPMLETMPKPVITARFIQYLSILCINLRLLAHIVKIALRLVIRVTYVKQNAIQPANLEFNAEGTPVSRDFDDVYFSNDNGLEETRYVFLDGNQLSTRFPEHPRSLFVVAESGFGTGLNFLTLWQAFDQFHAAHPEATLQRLHFISFEKFPLTEHDLRQAHQRWPELRPPGLNSFRRSGRLTLGAATV

SEQ ID NO: 131162 - protein, 36 aa, Glycine max
  Coding DNA Sequence Number=SeqID_39477
MKNIPDLGVIFMFEEGRQKRGSCSYVPSIEEEIRPT

SEQ ID NO: 131163 - protein, 125 aa, Glycine max
  Coding DNA Sequence Number=SeqID_39478
  Homolog annotation: Hit_ID=Q84VH5; Match level="QueryCoverage=61%, HitCoverage=11%, E-value=1e-33, Identity=96%"; Hit description =Envelope-like protein
MKRESPLSLHYKLFEGTHVPDIVSTSGKAAALGAVSKDALIAELKDTCKVLEATIKATTEKKMELERLIERLTDSGIDDGEAAEEEEDPAEEEEAAEQEEEAAEEEEDAAEDTDSDDDDDSEATP

SEQ ID NO: 131164 - protein, 157 aa, Glycine max
  Coding DNA Sequence Number=SeqID_39479
TDGVVRNGKSTARTSALAKCSGHAARNHHHPPRLMRRYRARPIRHSGCATVGKGDRHDVVKRRPVNCNTTHYRANWSSTAVAAALEIVDPPGCRNSIPPGGSLVRSPVPAFRFTGVIPLLWPRLSHSTPDTQFRVGSSLQAGLYARTPRSVRPLRLI

SEQ ID NO: 131165 - protein, 69 aa, Glycine max
  Coding DNA Sequence Number=SeqID_39480
MGVQIAPRPTWALQNIPPEGCCFWRKQPGSPAEALPKRFRNVFREEFRKGFNRSSTFFIRSSSFFVLHR

SEQ ID NO: 131166 - protein, 215 aa, Glycine max
  Coding DNA Sequence Number=SeqID_39481
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=90%, HitCoverage=21%, E-value=4e-98, Identity=82%"; Hit description=DNA -directed RNA polymerase subunit beta
  Pfam annotation: Domain name=RNA_pol_Rpb2_6; Domain location=1-112; Score=-143.0; E_value=1.1e-05; Accession=PF00562.19; Description=RNA polymerase Rpb2, domain 6
  Pfam annotation: Domain name=RNA_pol_Rpb2_7; Domain location=114-191; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-112::114-191
TGYALFADGRPVDMVFNPLGVPSRMNVGQIFECSLGLAGASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKGSLNWTESEFLFYD

SEQ ID NO: 131167 - protein, 103 aa, Glycine max
  Coding DNA Sequence Number=SeqID_39482
MGIAPTRHPVDPEKSNRALGFPALVTGLYQSYRVPVPPRQGHVLIGIALARHPVDPKKSNRFYGVPVTSSKGIRPPTNRAFIKKFCVSRQAQGETTQQPGDGR

SEQ ID NO: 131168 - protein, 49 aa, Glycine max
  Coding DNA Sequence Number=SeqID_39483
MVPHMSSGPPALDDKGADDHNCLCVPSDMTVFEWRKGERNDHNLSPHVT

SEQ ID NO: 131169 - protein, 35 aa, Glycine max
  Coding DNA Sequence Number=SeqID_39484
VFCLCPVFLAVIVSYPNFVQGPLLDDMRPFFGPCE

SEQ ID NO: 131170 - protein, 131 aa, Glycine max
  Coding DNA Sequence Number=SeqID_39485
MGQLQRQAFRKAYGKIWDLARVEVSTESIASLAQYYDNPLRKCLEAKARILAGRNEWAPFIAVLALLIFGGVLFSNVDGLVDLAAIDAFLAYHNHKESPVVAMLADLYDTFDRGCEKSSARIVCCALALYV

SEQ ID NO: 131171 - protein, 44 aa, Glycine max
  Coding DNA Sequence Number=SeqID_39486
VEGRSPEFQEPMDLRSNPIQGGRNDAILPPSVGSSGLRIIKKGG

SEQ ID NO: 131172 - protein, 114 aa, Glycine max
  Coding DNA Sequence Number=SeqID_39487
  Homolog annotation: Hit_ID=A4DID9; Match level="QueryCoverage=50%, HitCoverage=83%, E-value=4e-15, Identity=51%"; Hit description =Putative uncharacterized protein
RPTEAPVNGARNYNGPKLRWRAKKASFWGGPEPSVRYHSGRASILTLCQDLRAEGQPQAEGSLTARPTRRAGTKVGLSDPTVPSGRAVAQRIKGWAVRPLKRYVSWVQNVVRQF

SEQ ID NO: 131173 - protein, 106 aa, Glycine max
  Coding DNA Sequence Number=SeqID_39488
MMEVNMATVVPASTATEVDPTHLSGLNQVNHLVSDMVGQGGDALGSTGGPHFVQVQSKQSFPSYGLPPNYTPPNVAHSPDENVDTLLPYPLRANIPNLVMHRSLNP

SEQ ID NO: 131174 - protein, 25 aa, Glycine max
  Coding DNA Sequence Number=SeqID_39489
MVGYEPSSFADLVFTDERIEVGLKR

SEQ ID NO: 131175 - protein, 334 aa, Glycine max
  Coding DNA Sequence Number=SeqID_39490
  Homolog annotation: Hit_ID=Q6WAY4; Match level="QueryCoverage=31%, HitCoverage=19%, E-value=9e-09, Identity=35%"; Hit description =Putative uncharacterized protein
IKELGRLMGPLQMQAFRKGYGKILDLTIAEISTEAVVSLTQYYDQPLRCFTFGDFQLVSTVEEFEEILGCPLGGRKPYLFSGFLPSLSKIAVAVRDSARGLDREWVPFMDVLVLLIFGVVLFPNVDGLVDLAAINAFLAYHRSKESPMVAILADLFDTFDRRASMSAPKPSLVCPKKRRVDLDPTFGWDMRQNNQPGFLDGRKKRRESSSHVGTTPNIPGAPAEESLSPFLVRDFGTQSFKIIQRVHKAWENPLRKDKELRGICNGIIGSYHEWLKVRTRGLDWLSKLKIINEENFEAPEEDEEVRAPKTELGKARLAKEKFKLVATDVRKECA

SEQ ID NO: 131176 - protein, 113 aa, Glycine max
  Coding DNA Sequence Number=SeqID_39491
MYPLLFSVKPKEWEESKEFSDCVVLNSLTREKGDTKELTRLVLRSFGKRRRETQKELRKFVLGEFFLAKGEENEKMNNTSFQGLENQKIQKAFGTKKKKKFKEIQEIQRLVKD

SEQ ID NO: 131177 - protein, 76 aa, Glycine max
  Coding DNA Sequence Number=SeqID_39492
  Subcellular localization annotation: CTP_CleavageSite=9; ConfidenceScore=5.42e-01
MLATHYGYRATARKPASNCFFTSSFIFKDVSGFILLSFCFTGEHSGFRGPISWSSRATILSNSGGSPTSSFPSSSV

SEQ ID NO: 131178 - protein, 71 aa, Glycine max
  Coding DNA Sequence Number=SeqID_39493
MGKAVASGGSNLARLGELGGKHLLYFAINRGGSEEEKAEALPKRFRNVFYEEFRKGFNRSSFVLHRSSIFN

SEQ ID NO: 131179 - protein, 123 aa, Glycine max
  Coding DNA Sequence Number=SeqID_39494
MIRGDTLRLSAPFSHPEAAGPMTSRDQVWSFCTLVSSRGGGPDDTRKYPSDITLDSMQSVIPNFVRDLADDIVFCTFFLVRCLAPIIRQYVKFLREQQVIYMRKFYGHPRLSSTERNEISVIH

SEQ ID NO: 131180 - protein, 293 aa, Glycine max
  Coding DNA Sequence Number=SeqID_39495
  Pfam annotation: Domain name=Transposase_23; Domain location=142-212; Score=-12.8; E_value=0.03; Accession=PF03017.5; Description=TNP1ENSPM transposase
MAEKTKKKLEEAAQSGSTEGVINPPSPIRRHVKWKMARTKKTGQMTSKAAKEITEKIASQDSFVPHGRHDVLTVAIGRPEHPGCVHAAGAGAPSSNTLALLHKAPMQSQGLALPLEPEVGPSAARVSTNGSCVDPSPTDPETGDSDKYGLYIEENPSRLVALGRVYEGSAAVHNIPLLHGQVEVGVEEVKHVEAPVPVPTNEVQLVGQTLNTFLAWPTHLVKRVSEQATVSPAKPPDRSDPEVDDPLYLMTLTIPQLFLKPLQVMWDATVFGVFNPDFPLYIKHEDLSEIIHG

SEQ ID NO: 131181 - protein, 172 aa, Glycine max
  Coding DNA Sequence Number=SeqID_39496
  Homolog annotation: Hit_ID=A5BSR3; Match level="QueryCoverage=46%, HitCoverage=25%, E-value=5e-12, Identity=47%"; Hit description =Putative uncharacterized protein
MAEKAKKRLEEAAQSGSTEGIIDPPSPIRRHVKWKMARTKKTGQMTSEAAKEIADMIDSLDEQASQGSFVPHGRQDILTAAIGRPEHPGRVRAVGAGVTIKQYFGSASRTSRSSSSMPLEDLEQLTQQIRDQLEESITEKVTRKMMESFSQMQSQFQSRMQSQGIALPPEPE

SEQ ID NO: 131182 - protein, 163 aa, Glycine max
  Coding DNA Sequence Number=SeqID_39497
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=71%, E-value=1e-24, Identity=69%"; Hit description=LacZ protein
MLMCVYKYNNEYFAPKTVNFETKIDYIHCFGASKLDIKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131183 - protein, 83 aa, Glycine max
  Coding DNA Sequence Number=SeqID_39498
MATRMVAMMSMKKIMEANTVVVAATSVVAKIWWAKIWEVWAVCANSKQAHLPAICLAPNYTPPNVVYTPNKNVNNSTSILIES

SEQ ID NO: 131184 - protein, 66 aa, Glycine max
  Coding DNA Sequence Number=SeqID_39499
MASSIINNRDMGEITLEILSTKFKVDHPQGHGNKGQVSMIEHQSWKRLLISSCKSLCQIKRAQSLP

SEQ ID NO: 131185 - protein, 31 aa, Glycine max
  Coding DNA Sequence Number=SeqID_39500
MNPKRIKVIPEWPTPASVLRKKAQSFKNLKI

SEQ ID NO: 131186 - protein, 264 aa, Glycine max
  Coding DNA Sequence Number=SeqID_39501
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVTKRTRWMPWQYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131187 - protein, 185 aa, Glycine max
  Coding DNA Sequence Number=SeqID_39502
  Gene Ontology: Mol. function=monooxygenase activity; Cellular component=intracellular
  Homolog annotation: Hit_ID=Q1H125; Match level="QueryCoverage=100%, HitCoverage=48%, E-value=9e-65, Identity=54%"; Hit description =Luciferase-like protein
MASTPRQLILNVFFQRFGHHPAGWRHPSSKDDGRPNFDWWLRAAKLAEDAKFHTFFLADFIGRSAEVTPQTGRSGLSYQFEPLTLLSAIAASTQHIGLVATWCDGRQILAWNKTRAHDERYARAAEFVGLTKALWDSWEDDAFDHPNQDTGVYFDAASAHPVNFKGKYYQSEGLLDFPRPLQGYP

SEQ ID NO: 131188 - protein, 164 aa, Glycine max
  Coding DNA Sequence Number=SeqID_39503
EGIGHILDLTPIGEKMKESLKRLTLNSHTSMGRDNVEANLDWEIRVEQQLKRKSTSKSYGSHSYPKKDQGQGILGEDTLLVNAPTKKTMIMRGQDIYSSQDEATTSPSSSKSEEAKGEESSEEIYLQEEGQPLMVKEECKETLVSIATSLRLEFIPQVKELLDE

SEQ ID NO: 131189 - protein, 79 aa, Glycine max
  Coding DNA Sequence Number=SeqID_39504
MAYTHIPVKVENPGFTHDSPQISASPYQLDFTLYASGSYNAQWNAPGLLHDKHTLRSSRILRKMEVEEPWLGLWLPLNY

SEQ ID NO: 131190 - protein, 66 aa, Glycine max
  Coding DNA Sequence Number=SeqID_39505
MSLHVLYLYAFFWISPRDFPSAGQDHLELPSGVGTKHGQQKPIKVLRNGCKWGWGHDRLIVALSLR

SEQ ID NO: 131191 - protein, 148 aa, Glycine max
  Coding DNA Sequence Number=SeqID_39506
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
GKEVAGKRCFGKHKCTFYDDKHCGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131192 - protein, 143 aa, Glycine max
  Coding DNA Sequence Number=SeqID_39507
MDNEEGVQEQMKADLSSLKDQMASISEPALNPGLDRNTVVFGRRCSPQAYPYGLPPDFTPRATPEDLSQAPTFEGQLPPYEDYPGQDDGEGDTHLSPLLHLKDPSPHELPQPNIARHIPASPTPVKESVPFAEDKGKIEALEE

SEQ ID NO: 131193 - protein, 142 aa, Glycine max
  Coding DNA Sequence Number=SeqID_39508
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=3e-24, Identity=69%"; Hit description=LacZ protein
MKHFTDTLISANIVSFYLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131194 - protein, 108 aa, Glycine max
  Coding DNA Sequence Number=SeqID_39509
KRFFAIGVVTSFGYHKDIDGQWLKKDAQPQQDERTPSPPPQRDDSSALMNEVISELRGLRTYVGEHFDSLDGRIDAIDARFEGMDTCITQLEEDVSYLRRCFDLPPPS

SEQ ID NO: 131195 - protein, 263 aa, Glycine max
  Coding DNA Sequence Number=SeqID_39510
  Gene Ontology: Mol. function=protein binding; Cellular component =cytoplasm
  Homolog annotation: Hit_ID=A6TB03; Match level="QueryCoverage=61%, HitCoverage=97%, E-value=8e-76, Identity=89%"; Hit description =Putative uncharacterized protein yebR
  Pfam annotation: Domain name=GAF; Domain location=111-249; Score =26.5; E_value=9.8e-05; Accession=PF01590.17; Description=GAF domain
HVAKPKVGDGDHQQDGRNHRAEEHHRGGNGIALVGERHQQHHCKRHTGEPGKGPIAAVAYLRVAPRTPGALISFHNRYAEQHVALRTALIVRMRRWRTDRMNEFYADLNRDFQALMAGETSFLAMISNTSALLFERLEEVNWAGFYLLEGDTLVLGPFQGKLACVRIPVGRGVCGSAVAQNRVQRVEDVHAFDGHIACDAASNSEIVFPLQVNNQIIGVLDIDSTAYSRFTAEDEQGLAELVSRLETLIAATDYQKIFAHVAG

SEQ ID NO: 131196 - protein, 190 aa, Glycine max
  Coding DNA Sequence Number=SeqID_39511
GCEHATATGHTAQPHDIGYLVRQRANVGGFFLPFAWRRIPPQNCVAILVWKRNRSNYRGVSGRLGSCVSGEICHQRLRLSKTFLICGLHAYVLLFTPFITNFQSTLVYHLLQQGLVDKPFGGRHVLQRLGPAQPTQLDGINRSPSMIGKWARHCSVEWPGVFPWYAQVASGYTTLGKEADRSFREISQPS

SEQ ID NO: 131197 - protein, 104 aa, Glycine max
  Coding DNA Sequence Number=SeqID_39512
  Subcellular localization annotation: CTP_CleavageSite=87; ConfidenceScore=5.05e-01
MLVRMIRTRLFAAARVKSCPGMHSSCVIASLSGCACTVGPPPISGGTLNPLKVWIWSTLKMRARSPLKARMCNPLEVRACSPLLARMCSPLQGEGMQPFVGEDV

SEQ ID NO: 131198 - protein, 133 aa, Glycine max
  Coding DNA Sequence Number=SeqID_39513
GGHDSGCCIPTEDTTHEVNYMGNQPRPNFNAGGPQQQGTSLYDRMTKLEETLAQFMQVSMSNQKSTESTIKNLEVQVEQWAKQLADRSSRSFGANTEKNPKEECKAVMTRSKVGIALSEQERAKRATVQWKLR

SEQ ID NO: 131199 - protein, 67 aa, Glycine max
  Coding DNA Sequence Number=SeqID_39514
MKIQKKGCSIALLFLNFLNCDQGVPMNPKRIKGVEEKSPEFQEPRDLRSNPFQGVGNDAILPRKGIG

SEQ ID NO: 131200 - protein, 130 aa, Glycine max
  Coding DNA Sequence Number=SeqID_39515
  Subcellular localization annotation: CTP_CleavageSite=33; ConfidenceScore=5.66e-01
MGHFKVQGLKSTTFQFPLLFPTFSTNKRWWRLRAFSSFGRRTREPRLTCPQKASKQRKGNIGSKGLSKELIQGRLIWLEAYKNKMPKSSPNMHVKQEVSTRVKPRLLCKQSMGQNTPNKIDDDGSNSHQG

SEQ ID NO: 131201 - protein, 49 aa, Glycine max
  Coding DNA Sequence Number=SeqID_39516
MTRGDTLRLSRTLVSSRGGGPDDTRKYPSGYPYKLSFAICAWHPSLGNL

SEQ ID NO: 131202 - protein, 66 aa, Glycine max
  Coding DNA Sequence Number=SeqID_39517
MSRDFHLLCNKRIPSISKRLTKGCMSTSNNPRTKLGYDTCELGSINKNQAKAIVQAINGAKHTKRL

SEQ ID NO: 131203 - protein, 91 aa, Glycine max
  Coding DNA Sequence Number=SeqID_39518
VKKRLSHEVLKRASTAKRSFNAVSMTEESGRASISRPHAKREIELGQTIALQQNFSNIPEHTTMPIWGKELWRQQEEQLFQRYLGFVISLL

SEQ ID NO: 131204 - protein, 44 aa, Glycine max
  Coding DNA Sequence Number=SeqID_39519
ILVTPSKVIRLPITWAFIEKYCTPRQAQGNAPQAADARDQCWKP

SEQ ID NO: 131205 - protein, 101 aa, Glycine max
  Coding DNA Sequence Number=SeqID_39520
  Homolog annotation: Hit_ID=Q2HW90; Match level="QueryCoverage=76%, HitCoverage=16%, E-value=5e-09, Identity=37%"; Hit description =Putative uncharacterized protein
MGQLQRQAFRNAYGKIWDLARVEVSMESIASLSQYYDQPLRCFTFEDFQLVPTVKEFEEILGCPLGGRKPYLFSGFYPSTTRVAKRCPLSKYGRVSGPSSD

SEQ ID NO: 131206 - protein, 63 aa, Glycine max
  Coding DNA Sequence Number=SeqID_39521
  Subcellular localization annotation: CTP_CleavageSite=29; ConfidenceScore=5.29e-01
MSKSFEFGMIDPLNESISCFLRATRPRLRRATRPHLPRTTCPHLQSTTRARLQRTTCPRPSPS

SEQ ID NO: 131207 - protein, 58 aa, Glycine max
  Coding DNA Sequence Number=SeqID_39522
MSAIEFSIQSLNEICMMSIRKCLIGVIRLKAQVEKDEGLSGEGQSPRVEKDEGPSGER

SEQ ID NO: 131208 - protein, 115 aa, Glycine max
  Coding DNA Sequence Number=SeqID_39523
MFGVFNPDFPLYIKHEDHSEIAHGGQCLSISVLQLHLTETSMQAGNSDKYGFLEPQSIQRSGQSQFETESYIKSWMQSSKCDVYLGAYLNGGHWPMVVIVPKEHLVVWFCSLGIL

SEQ ID NO: 131209 - protein, 134 aa, Glycine max
  Coding DNA Sequence Number=SeqID_39524
  Homolog annotation: Hit_ID=A5BMH4; Match level="QueryCoverage=82%, HitCoverage=11%, E-value=4e-12, Identity=36%"; Hit description =Putative uncharacterized protein
  Pfam annotation: Domain name=zf-C2HC_plant; Domain location=8-63; Score=58.5; E_value=2.3e-14; Accession=PF07567.3; Description =Protein of unknown function, DUF1544
VTRKNKTDPGWKYCHPLVEGETNIIVCNFYGKITKGGITRAKQHLIGKSGNIATCKKTPPNLVEELKEYMTTKKSGTTYSTYGSGNMANIRDFEFGEPIGCDGSEDDEFADSCNAIASAKTKYETKKRTNGQIL

SEQ ID NO: 131210 - protein, 177 aa, Glycine max
  Coding DNA Sequence Number=SeqID_39525
  Homolog annotation: Hit_ID=A5AZG1; Match level="QueryCoverage=23%, HitCoverage=12%, E-value=9e-07, Identity=54%"; Hit description =Putative uncharacterized protein
MSLHSSSSVNGEGSTPKDPLYKISDELRSLKLWKEKGKKRVEEISQDEREKIREEERRKIMKEMKREKHASYSSHYSCKSLSEELSDYYRGRHSSHTKHHSQRREKDRRPQEVNISLPYFHGKDNVEAYLDWEMKVEQLFACHHIREERKVPLATLSFQGCHTLISSGDYYLMIYNL

SEQ ID NO: 131211 - protein, 135 aa, Glycine max
  Coding DNA Sequence Number=SeqID_39526
  Homolog annotation: Hit_ID=Q2QSX4; Match level="QueryCoverage=54%, HitCoverage=6%, E-value=2e-07, Identity=42%"; Hit description =Retrotransposon protein, putative, Ty3-gypsy subclass
MREKREQEKENSEAPQRNRIKKTDTLEGKSDTHKRKSDTHERKFNCFAEEFKDVFPKEISHGLPPSRGIEHQVDLLMRILKLTKYRLKARWRRAKAQVEKDKAPEWRMMKAQVEKDEGPEAETLSRLLIVAEGPD

SEQ ID NO: 131212 - protein, 66 aa, Glycine max
  Coding DNA Sequence Number=SeqID_39527
MVRSRDELTAEINQGKIMTRSRLAAHCLLPTCRYLGTDANGGQGHDQPIVVPSQRWASGERRCKAA

SEQ ID NO: 131213 - protein, 33 aa, Glycine max
  Coding DNA Sequence Number=SeqID_39528
KYNLHVLKRDVVTSGTTSVPSIRISSGLLEYWT

SEQ ID NO: 131214 - protein, 45 aa, Glycine max
  Coding DNA Sequence Number=SeqID_39529
MDSRNQSRYLGTDASGDGVTTDRSLPLLCVKQAENVAARQPIIDA

SEQ ID NO: 131215 - protein, 132 aa, Glycine max
  Coding DNA Sequence Number=SeqID_39530
ARKEEYGRNKFRGALWGSNSEGKRGTSREHIAWSLSQRLCETETNMLAIIAKYQEELSLATAHEHRVADEYAQVYTEKEARGRVIDSLHQEATMWMDRFALTLNESQELPRLLAKAKAMKPLGNLYGLSDLD

SEQ ID NO: 131216 - protein, 123 aa, Glycine max
  Coding DNA Sequence Number=SeqID_39531
MAHFSDSAQSVKAICQNFGIELDSEWRLLSLAEIAYFGWSFASLTLLRKVEEEPWLLVVFVVAALEEEHMACLDQQHFGREGQAAVVVEDLSISDLDDSSNLDCICCLKDHNYYAVVGFAAEE

SEQ ID NO: 131217 - protein, 281 aa, Glycine max
  Coding DNA Sequence Number=SeqID_39532
MGKKKLEMSLESQQISFDLFNEGKELLDHNVCLKVKELDEKATASIPHARYDRSKLSSQEVWDRYTDNILGRKILPERNVKLYVTEFVEFKRELERRNWHKELTNFVDGSIDVAIVKEFYANLYDPEDKSPKQEGESLPAYSRLAQLRPDSQELAAHLCIPGRGFELNADGHPLKILRKNLTTLAQTRSLLSFPNLAPTSHTSDITLHKARLIYGIIQKMDMNLGYLILSQISLIVQHDSSRLGFHVLITALCKARGVASYSLTFESLSPAITLAYVKKNC

SEQ ID NO: 131218 - protein, 110 aa, Glycine max
  Coding DNA Sequence Number=SeqID_39533
MGNKQSDLIPIDLEINATCRRRNQERIRNFLQDLEATAIPEEEPQSSEASSSFPIAEHSHLDASEDYIMVEEPRRVTLEDYSSSNLPQIFTSIAQPEVQAQTITYPPSLI

SEQ ID NO: 131219 - protein, 80 aa, Glycine max
  Coding DNA Sequence Number=SeqID_39534
MGEVEEVQEQMKADMEAMKEKVAIMMEAMMSMKKIMEANAVTVAATSAVVRASSWWYTPAKHFGRPLVSPTTTPLAFHNE

SEQ ID NO: 131220 - protein, 181 aa, Glycine max
  Coding DNA Sequence Number=SeqID_39535
  Pfam annotation: Domain name=Transposase_23; Domain location=51-121; Score=4.6; E_value=0.00038; Accession=PF03017.5; Description =TNP1ENSPM transposase
MASFNQMQSQFQSQMQSQGLALPLEPLVGPSDPQVSTKKSCVDPSGNDPETGDSDRCGLYIEANPACLVALGRVYEGSTVVHNTPLFPGQVKVGVEEVKDPDALVPVPTNEVSLVGQAIHTFLAWPTHLVKPLSQQAVVSLAKPPQKLDLEVTWDATVFGVFNPDFPLYIKHENLSEIAHS

SEQ ID NO: 131221 - protein, 315 aa, Glycine max
  Coding DNA Sequence Number=SeqID_39536
  Subcellular localization annotation: CTP_CleavageSite=41; ConfidenceScore=5.44e-01
MAEPSKKRKGSSSTATAAAHRRHGPSEASTTPIHPSLSSPRSSTLFSSDDQCLRYLSQFSSRIILDPKYLDEEFFNDETFDCYQVFQNSGLVDFMSLKLPHYPELVKVFYCNLKIQDGIISSEKFDYSSHNACRMVCNDQAEMTAQASEEDLILMWAFLTSRQIDWAHLVRYRMHKALRTNAPLPYPQMITLFLRHFQIPLDDEPFVQVKCSFAIGAGAVSSFGYRKDRNGQWLKKDALPPQDERTPSPPPQREDSALLNEVLPELRGLRSYVGERFDSLDTRFAGMDIRLTQVEEDVSFIRTCFDPPPPPPSSF

SEQ ID NO: 131222 - protein, 191 aa, Glycine max
  Coding DNA Sequence Number=SeqID_39537
  Pfam annotation: Domain name=MAP7; Domain location=5-167; Score= -82.7; E_value=0.081; Accession=PF05672.2; Description=MAP7 (E-MAP -115) family
MSHHSSSVNGEGTSHKDPLSRILDELSSLKLWKEKQERKEKGKKRVEEISQDERKKVREEERRKIMKEMKREKHASYSSHNSCKSLSEELRDYYEGRHRSHLRPHSHRREKERKPQEANINLSYFHRKDNVEANLDWEIRVEQQLKKKSTSKSYGSHSYPKKDQGQGILGVTPSKPKDDKGNTIEKQAPKA

SEQ ID NO: 131223 - protein, 39 aa, Glycine max
  Coding DNA Sequence Number=SeqID_39538
MAKINQGKTMTTHDRSHIVRLLLAGSRPTDHCPFPALNK

SEQ ID NO: 131224 - protein, 140 aa, Glycine max
  Coding DNA Sequence Number=SeqID_39539
NPAHLVALGRVYEGSTVVHNTPLLPGQVKVGVEEVKDTDALVPVPTNQVSLVGQTIHTFLAWSTHLVKSLSQQVDVSPAKPLQKPDPEVDDPLYLMTLIIPELFLRPYQVTWDATMFEVFNPDFPFYIKHEDLSEITHGG

SEQ ID NO: 131225 - protein, 288 aa, Glycine max
  Coding DNA Sequence Number=SeqID_39540
IPRYPMRGAPTEESLSPFLVRDLGAQGLKVIQRVHKEWRSPLRKDKELRGIRNGVIGGYHGWLRIHTRGLDWLSKLKVIDEENFEAPEEDEEVRALKLELGKARLAKEKFKSAATHIRKECTELQEENAATAKALEHPPQQGPQGRIWPREIPRSIVGSKRSLAQHLEATEQSMLAIIGQYKEELNQSMAHEQKLVEDFAQVYAEKEARGRVIDALHQEATMWMDRFALTLNGSQDLPRLLAKAKAMAEVNFIITKKTPRHPYNTLSYPNFVRGPLLDDVRPFFGPRE

SEQ ID NO: 131226 - protein, 247 aa, Glycine max
  Coding DNA Sequence Number=SeqID_39541
  Homolog annotation: Hit_ID=A5C4I3; Match level="QueryCoverage=23%, HitCoverage=22%, E-value=7e-15, Identity=71%"; Hit description =Putative uncharacterized protein
MVAQARAVDMLVETSSSRLWMAARALGVPRHLRAPGVGLWAPHSARLETRTKESDMCASQRASKPVRRKEADWWDPPVAGRSQRKLWWRPAAILTIAGAAGEFYRVKPMIRGIGGATPSTYSQTLNRYGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 131227 - protein, 91 aa, Glycine max
  Coding DNA Sequence Number=SeqID_39542
MSQGSGDLGDVRWGAIGQNQAWPISTQPGHKQPARTLQQPVEWILPTPTPYRLVEPVQLIKVSSSEEDLEEDPEELSPEPAMDAPDLSEDD

SEQ ID NO: 131228 - protein, 150 aa, Glycine max
  Coding DNA Sequence Number=SeqID_39543
  Subcellular localization annotation: CTP_CleavageSite=57; ConfidenceScore=5.83e-01
MQRNSPASSCDTSFLPQPSLFSGRPFIGISSFGVRVILSFCSSTIFAFPLTFAGCVGRSTGANTRPLRVTPLNLVILFTLANNELMSVASSFHLLGDAYLHGTMWLFRYENGTGLTTEGYRGVWGVASLVKYTTVATYPSAGGRATRDSR

SEQ ID NO: 131229 - protein, 214 aa, Glycine max
  Coding DNA Sequence Number=SeqID_39544
MGTNQNGKRFYQVKVKSLDFTSLKELGRLMGPLQRHAFRKVYRKILDLTAAGVFTEAVVFLAQYYDQPLRCFTFGDFQMQDCSCGRRFGERIGLYKANSKRHSGHTAEILGRQGKGYDKSIKPQLMLSLHITIARRAQWWLSWWTYLIHSTEGAGRTAHGSSAAYPLFVCVDWDQHLAGIGGSTINWFPRWKEGKEGVLFSCGDYPNVPLMGTR

SEQ ID NO: 131230 - protein, 128 aa, Glycine max
  Coding DNA Sequence Number=SeqID_39545
KYCTQRQVQGDAPQAADAPPPHQAGPAGLFDTEQYLRHLVRQQAANHRAHVQTHDCLYQMSLSLQSQSFTSFPCPTPEQFRAEVAWPGDWPKAQAGEAPAEAPGEADEAREDEEMTDLLDFLGGSGAT

SEQ ID NO: 131231 - protein, 219 aa, Glycine max
  Coding DNA Sequence Number=SeqID_39546
  Homolog annotation: Hit_ID=Q84VH5; Match level="QueryCoverage=100%, HitCoverage=29%, E-value=5e-88, Identity=80%"; Hit description =Envelope-like protein
MIPGQAPVPEKLVPKRQQGVKISENPSLATSPREVDPEMDKKIRSIVSSILKDASVPDAEKDVPTSSTPDVAVPEADEDVPTSSTPNVSVPDVEKDVPTSSGPNAEVLSSPSKERSTEEDDQATEETPAPRAPEPAPGDLIDLEEVESDEEPIANKLAPGIAERLQSRKGKTPIKRSGRIKTMAQKKSTPITPTTSRWSKVAIPSKKRKEISSSDSDDD

SEQ ID NO: 131232 - protein, 220 aa, Glycine max
  Coding DNA Sequence Number=SeqID_39547
MTTLTQIWMTLLLSNILSSDHNSDLPLPKCQLVYAILTRMSIHVAQLIADAIYIFAGMAPTRHPLDPDKSNRALGFPALITGLCQSFGVPVSPSKVIRPPITQAFIEKYCTQRQVQGDAPQAADAPPPHQAGPAGSFDTEQYLWHLVRQQAANHRAHSQGFTSFPCPTPDQFRAEIVWPGNWPEARAGEAPAEAPDEADEVREDEEMTDLLDFLGGSEAT

SEQ ID NO: 131233 - protein, 150 aa, Glycine max
  Coding DNA Sequence Number=SeqID_39548
MTKPGLCVPSDTTVSEWQRGADNRKVSPRIIMTKLGLCVPSDTTVSEWQRGADNRKVSPRIIMTKLGLCVPSDTTVSEWQRGADNRKVSPRIIMTKLGLCVPSDTTVSERQRGADNRKGQYDKDYGAADKSKALAPTYPPMRNSDLRSSG

SEQ ID NO: 131234 - protein, 95 aa, Glycine max
  Coding DNA Sequence Number=SeqID_39549
  Homolog annotation: Hit_ID=A5ATL8; Match level="QueryCoverage=86%, HitCoverage=68%, E-value=6e-18, Identity=60%"; Hit description =Putative uncharacterized protein
MGLDTPVVPSRKRWILGAVRIDPRRTLPGLDMPRILLKERGAFGNADTGGAWLSSARAVSRRKVRMTSSHHAPYALGDTRATMDGTKDRDPARVS

SEQ ID NO: 131235 - protein, 144 aa, Glycine max
  Coding DNA Sequence Number=SeqID_39550
  Gene Ontology: Mol. function=transcription factor activity; Cellular component=intracellular; Biological process=regulation of transcription, DNA-dependent
  Homolog annotation: Hit_ID=A6TD07; Match level="QueryCoverage=61%, HitCoverage=27%, E-value=6e-27, Identity=70%"; Hit description =Repressor of galETK operon
MVEGYRNVLQNYSFPFNRQLVLTANESVERALLTLINSLSKFSSIVVKRDAYAAEAMRLFREFNIAVPQERIKSIVEGRPLRETELPPIIGKLTPRQSEPGLPLKEQVNTDEGTICVYERGEHREKIVIPVGQACPKTSANNNE

SEQ ID NO: 131236 - protein, 135 aa, Glycine max
  Coding DNA Sequence Number=SeqID_39551
GYMPSPWVLVTLTVERTTRPRLERTTCPHHQRVARPHLQRTTCPRLERATRPHLGGLHALTSRGLHVLALRGLHALTLEGYTPSPWVLVTLTVERTTRPRLERTTRPHHQRAACPHLQRTTCPRLERATRPHLGY

SEQ ID NO: 131237 - protein, 101 aa, Glycine max
  Coding DNA Sequence Number=SeqID_39552
MSGFTRDSPQILASPHQLDLAPYASEPYNAQWNAPGLLRDKHTLRSSHMGARGVAGGDTEGLPKCFQGVYHQLLALQWHIRAKAQSRLDCGGEFHVSLPPV

SEQ ID NO: 131238 - protein, 35 aa, Glycine max
  Coding DNA Sequence Number=SeqID_39553
MTTCQNSPLVSAMGAVPSDMRAFNSGCGVVLVGQW

SEQ ID NO: 131239 - protein, 117 aa, Glycine max
  Coding DNA Sequence Number=SeqID_39554
MALTFFGILDSLRRQLVRILGLLLIQLGSQLSYLIGLSSEWRLWNVWSAWASSILEGRSRLLLLLLRAGPFEVRVIPPSRVVSVAGKAAQLLQVAAWKGKGLYGGQQRSTNHKLLRQ

SEQ ID NO: 131240 - protein, 100 aa, Glycine max
  Coding DNA Sequence Number=SeqID_39555
  Subcellular localization annotation: CTP_CleavageSite=63; ConfidenceScore=5.54e-01
MHTQSFTIPQFPKIGLTHKNSPQWSRQLLQPTLLRASEARLSGASSKGGIRVESPPMFICGKRQKNRRKPVMKNIPDSGVVFTFEEGISTSHVCPKGQQP

SEQ ID NO: 131241 - protein, 210 aa, Glycine max
  Coding DNA Sequence Number=SeqID_39556
  Homolog annotation: Hit_ID=Q8LI60; Match level="QueryCoverage=53%, HitCoverage=19%, E-value=5e-07, Identity=26%"; Hit description =Putative uncharacterized protein OJ1634_H04.130
  Subcellular localization annotation: CTP_CleavageSite=5; ConfidenceScore=5.13e-01
MGSPPASTPPPPPPPTSDASALPSTVKPPGAERPVVHVDPATEKADGPHRKKLRIYLVIVARDKVDITYENWKEIPTAQKDLIWEDIQAEFDIPEASDTDQDGVEDTICDKYDISKEKWAQFCQTRRDPSWEDVRIKAQAIQKQNTAPHVLSRGAEKTKKKLQEAAQSGSIDGVIDPPSPVRRHVKWKMARTKKTGEMTTEATKEIAEKI

SEQ ID NO: 131242 - protein, 165 aa, Glycine max
  Coding DNA Sequence Number=SeqID_39557
MEAIKEQMATMMKAMMSMKKIMEANAVIVAAISAVAKVNPMLPSGLKQMNHPTSNMTHISQTMGETHEIPHHNLADFEPWLGYATEGQAVGGIPCKTLWRALNIIHNHNPHVPQWLKTLMTMAGMGKLDHLEERLRAIEGGEDYAFANLKELFLVPNIITPPKFK

SEQ ID NO: 131243 - protein, 87 aa, Glycine max
  Coding DNA Sequence Number=SeqID_39558
MGWPYKLSAITDAASACKKQLTYLMETIKAKQGYCTTTPPHPLSLDLYFSPCTCANQNMPPTFFATIPPLQLGALPQPGIMAMDLLV

SEQ ID NO: 131244 - protein, 391 aa, Glycine max
  Coding DNA Sequence Number=SeqID_39559
  Gene Ontology: Mol. function=protein kinase activity; Cellular component=integral to membrane; Biological process=recognition or rejection of self pollen
  Homolog annotation: Hit_ID=A7PW14; Match level="QueryCoverage=98%, HitCoverage=92%, E-value=1e-156, Identity=68%"; Hit description =Chromosome chr8 scaffold_34, whole genome shotgun sequence
  Pfam annotation: Domain name=Peptidase_C12; Domain location=24-350; Score=170.4; E_value=4.6e-48; Accession=PF01088.12; Description =Ubiquitin carboxyl-terminal hydrolase, family 1
MNKNGVIPSWMKQQWRGIVKVRLKWVKNRSLDHVIDKETDLKAACLLKDAVNRSSTGFLTAQSVADWQKLLGLTVPVLRFLRRYPTLFHEFPHPRWPSLPCFRLTDTALFLHSQELSLHQTHQNGAVEKLSKLLMMSNSRALPLHSLHALKWDLGLPDTFHKTLVPQFPNHFQFVKSPNGVVSLKLSRWPDELAVSALQKHNEGGTHYREFKRGQSALAFPMRFPRGYGAQTKVRTWMEEFQKLPYVSPYVDSTKIDPNSDLMEKRVVGVLHEILSLTLHKKTKRNYLRGLREEFNLPHKFTRIFTRYPGIFYLSLKCKTTTVTLKEGYQSGKLVDPHPLARHRDKFYHVMQTGLLYRGDGSLKPRENKIENDELRSEDEVEMSDQLCESE

SEQ ID NO: 131245 - protein, 234 aa, Glycine max
  Coding DNA Sequence Number=SeqID_39560
  Gene Ontology: Cellular component=integral to membrane
  Homolog annotation: Hit_ID=A7Q023; Match level="QueryCoverage=52%, HitCoverage=29%, E-value=7e-27, Identity=56%"; Hit description =Chromosome chr8 scaffold_41, whole genome shotgun sequence
  Pfam annotation: Domain name=UBA; Domain location=166-202; Score =39.9; E_value=9.1e-09; Accession=PF00627.22; Description=UBATS-N domain
MCETSKIYCLHWWKSFGLYSYTYKPKFNNQWITFWKCLEEPIIIYASKGSVCSGASVKSVLACSHLKVSDSSIHPSSIGLWHQQLSTEDSRFPGRGRTLGAVQGQTASHLHSDSNLQARLLEDSSPNSPLDSSTPSNPQRLSEGRHSVDNVATAAAGVPQNQGAAVSEEGIRKLVSMGFDRTQVEVALAAADGDLNVAVEILMSQQCTFWSLFSLKNELSVMLSGRAVGQDGRR

SEQ ID NO: 131246 - protein, 476 aa, Glycine max
  Coding DNA Sequence Number=SeqID_39561
  Gene Ontology: Mol. function=catalytic activity; Cellular component =membrane
  Homolog annotation: Hit_ID=A7PW18; Match level="QueryCoverage=99%, HitCoverage=99%, E-value=9e-89, Identity=64%"; Hit description =Chromosome chr8 scaffold_34, whole genome shotgun sequence
  Pfam annotation: Domain name=PAP2; Domain location=94-227; Score =62.1; E_value=1.8e-15; Accession=PF01569.12; Description=PAP2 superfamily
MEGEGAAVWQGAVLGGIIFWLVSASYLNATRKLRSFLQPWVTHHVDTQTPIILKIQSYGFGFLDALFSGLSCVVSVPFYTAFLPLLFWSGHGKLARQMTLLMAFCDYIGNCTKDVVSAPRPASPPVKRVTATKDEEDNALEYGLPSSHTLNTVCLSGYLLRYVLTHTQIQGAYVTYLGVSLACMLVFLIGLGRIYLGMHSVVDVLAGLLIGLVVLAFWLMVDEYIDSFVISGQNVTSFWAALSFLLLFAYPTPELPTPSFEYHTAFDGVALGIGVKGDQNGEGENCGVSLGRELSLRASALGLLYAAVVIELFGDVRIKYSPRICFGSPPILTEHARKGQRRAVSGVQQTYHQFHHANVPRLFSSELTIPVFLGRMLLGIPTILIVKFCSKALAKWTIPVVANTLGIPIKSTGYIPTLNGSVTGKKSDKLKQGYLQKLLSQHKAFDVDTGIRFVQYAGLAWSVVDLVPSLFSYMSL

SEQ ID NO: 131247 - protein, 303 aa, Glycine max
  Coding DNA Sequence Number=SeqID_39562
  Gene Ontology: Mol. function=metal ion binding
  Homolog annotation: Hit_ID=Q2HV40; Match level="QueryCoverage=69%, HitCoverage=59%, E-value=1e-69, Identity=63%"; Hit description=Zinc finger, RING-type
MGNISSGGNPRRRHSGASRRSHPPPPPPVTPQPEIAANPFVYHGAAAPYPNPPLHYPQYHYPGYYPPVPPMPYHPHQHQHHHRHMDPAWIQGHFPSGPMMPNPAPFVEHQKAVTIKNDVNIRKETLKLEPDVENSGHFLVSFSFDATVSGSITIYFFAKEGEGCILTPMKENQLAPVSVHFEQGLGQKFRQAAGTGIDFSVFEESELLKVGEKDVYPLAVKADASPGNHDESDRSPTSSNTNSQITQTMFEKEKGEFRVKVVKQILWVNGMSVCVADVQRILGSRQIDAQFADNQLRGCWRYR

SEQ ID NO: 131248 - protein, 100 aa, Glycine max
  Coding DNA Sequence Number=SeqID_39563
MWFGQNRSCRIESGRLARNKGNRMNNKAATLFVRGEVADDEKVGALPEGEGIPHARPTTTHHYRRDWASIESTQKPTRPPCSSTPNPHRTKNHSRGLQTQ

SEQ ID NO: 131249 - protein, 52 aa, Glycine max
  Coding DNA Sequence Number=SeqID_39564
MERDQGGTGSRDERLKENELADQNKIEYEECVEQSPRTSRGHCSSESPHGDY

SEQ ID NO: 131250 - protein, 217 aa, Glycine max
  Coding DNA Sequence Number=SeqID_39565
  Gene Ontology: Mol. function=molecular_function; Cellular component =cellular_component; Biological process=meiosis
  Homolog annotation: Hit_ID=A2Q1R1; Match level="QueryCoverage=71%, HitCoverage=49%, E-value=1e-85, Identity=92%"; Hit description=WD40 -like
  Pfam annotation: Domain name=WD40; Domain location=30-68; Score=28.9; E_value=1.8e-05; Accession=PF00400.23; Description=WD domain, G-beta repeat
  Pfam annotation: Domain name=WD40; Domain location=72-110; Score =24.1; E_value=0.00053; Accession=PF00400.23; Description=WD domain, G-beta repeat
  Pfam module annotation: Pfam domain module=WD40::WD40; Domain location=30-68::72-110
MNKDGAGDSSFPVVKDQTQFSVAHARYSKSNPIARWHICQGSINSISFSMDGAYLATVGRDGYLRVFDYSKEQLICGGKSYYGALLCCAWSMDGKYILTGGEDDLVQVWSMEDRKVVAWGEGHNSWVSGVAFDSYWTSPNSNDNGETVTYRFGSVGQLFILSKTHCTDTDTDTGHGHVNTCNVQNIEPSTGVVSVSDTDTDACRIPDTARGWSVRAS

SEQ ID NO: 131251 - protein, 88 aa, Glycine max
  Coding DNA Sequence Number=SeqID_39566
MAIFLSNGSGGENSRRMMRNSEKPQNIPNQNTVLNRGKGKMEEALYVQMGEETRMEDVFISNEKYLADDMVLIAGILRFNNFISGRVW

SEQ ID NO: 131252 - protein, 109 aa, Glycine max
  Coding DNA Sequence Number=SeqID_39567
  Homolog annotation: Hit_ID=A6FJQ2; Match level="QueryCoverage=34%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSVNTNPGWPNQKNSSLGQNKWGPIGHIIDIFHFKSHLVDNDFKFSSHNQNQL

SEQ ID NO: 131253 - protein, 71 aa, Glycine max
  Coding DNA Sequence Number=SeqID_39568
  Homolog annotation: Hit_ID=A6FJQ2; Match level="QueryCoverage=53%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGSSRGLSAGVVVVKSKRSREASEGK

SEQ ID NO: 131254 - protein, 57 aa, Glycine max
  Coding DNA Sequence Number=SeqID_39569
MDQLLVIFKGGGGGNSDKMSQSPIEFANVSLKTELRKEVVRRKQKRPSSNDCYFLAV

SEQ ID NO: 131255 - protein, 186 aa, Glycine max
  Coding DNA Sequence Number=SeqID_39570
MVGARRNGSEGEVPGSRSLCPVLAGSDLHLVSTVGRDDADSVSVSTSSTFSGSVSEAIFSLRKPNSGSVWGSSEVCCCSVVFGIGNSVSWSLTGELQNLLAKEEDLYGADLQRVKSKAFLGGVLELEAKSLSLSTFTLSWNVMFERGGLSTEEAGPVGPEGFAAAGVVVGASDPTAVAAAAAARGS

SEQ ID NO: 131256 - protein, 560 aa, Glycine max
  Coding DNA Sequence Number=SeqID_39571
  Gene Ontology: Mol. function=ATP-dependent helicase activity; Cellular component=nucleus; Biological process=ribosome biogenesis and assembly
  Homolog annotation: Hit_ID=A7PSZ9; Match level="QueryCoverage=99%, HitCoverage=99%, E-value=0.0, Identity=63%"; Hit description =Chromosome chr8 scaffold_29, whole genome shotgun sequence
  Pfam annotation: Domain name=DEAD; Domain location=168-350; Score =153.1; E_value=7.6e-43; Accession=PF00270.20; Description=DEADDEAH box helicase
  Pfam annotation: Domain name=Helicase_C; Domain location=418-501; Score=101.9; E_value=1.9e-27; Accession=PF00271.22; Description =Helicase conserved C-terminal domain
  Pfam annotation: Domain name=ResIII; Domain location=164-345; Score= -20.0; E_value=0.0023; Accession=PF04851.6; Description=Type III restriction enzyme, res subunit
  Pfam module annotation: Pfam domain module=DEAD::Helicase_C::ResIII; Domain location=168-350::418-501::164-345
MANDSSFLFAGIRFDRKKFGADIARFQKKDSDTDSAMILSAAEDEGEKTIEPLEEEKVAASTTKKRKRKGTSSETVEGFNVFRSSTSVAQSNDEVRVIEESVELYNNNKKEQNKQLERDAIFRKQHNIHVSGYNVPSPLQSFDELKSRYNCPSYLLRNLKELGFREPTPIQRQAIPVLLQGRECFACAPTGSGKTLAFVWPMLMKLKFPTSVSLVQIINCVLQDPEKGSIRAVILCHTRELSVQTYRECKKLAKRKKFRIKLMTKNLLRNADFSKFPCDVLISTPLRLRLAIKRKKIDLSRVEYLVLDESDKLFEPELFKQIDSVIKACSNPSIIRSLFSATLPDFVEDRARELMHDAVRVIVGRKNMASETIKQKLVFTGSEEGKLLAIRQSFAESLNPPVLVFLQSKERAKELCSELAFDSIRVDVIHSDLSQAERENAVDNFRAGKTWVLIATDVVARGMDFKGVNCVINYDFPDSAAAYVHRIENVDFSLGRSGRAGRTGEAITFYTEDDIPFLRNVANLMAASGCEVPSYLMKLRKKKWKKHRPKRDSISTKPDL

SEQ ID NO: 131257 - protein, 138 aa, Glycine max
  Coding DNA Sequence Number=SeqID_39572
MEIECIKRFSVMPLLAHQVDVAEPPHGLGHGGVLQVLKNGVVLAEQGLGIGSERARSGGRVTLSRGTSRICKLLPEASLGPFSCPTASASGDTVFSGLASDDVGEPGCSAGSPEVITTPRAATSAPASRGEGGGGVSH

SEQ ID NO: 131258 - protein, 111 aa, Glycine max
  Coding DNA Sequence Number=SeqID_39573
  Gene Ontology: Mol. function=nucleoside-triphosphatase activity; Cellular component=nucleus; Biological process=DNA replication initiation
  Homolog annotation: Hit_ID=Q9SF37; Match level="QueryCoverage=63%, HitCoverage=7%, E-value=5e-18, Identity=69%"; Hit description =Putative minichromosome maintenance (MCM) protein
MCCTRVQELLKPEDHEEGRVPRTVECELTQDLVDAFIPPGTNHDPKSVRHCIPGDVVTVTGIIRGINTYMDIGGGMPELACLCYPPYMVPCFNTCLDVEGKANPSLLVKDT

SEQ ID NO: 131259 - protein, 621 aa, Glycine max
  Coding DNA Sequence Number=SeqID_39574
  Gene Ontology: Mol. function=phosphoprotein binding; Cellular component=membrane; Biological process=signal transduction
  Homolog annotation: Hit_ID=Q8VXD2; Match level="QueryCoverage=99%, HitCoverage=99%, E-value=1e-171, Identity=53%"; Hit description=P70 protein
  Pfam annotation: Domain name=DUF827; Domain location=59-336; Score= -116.5; E_value=0.097; Accession=PF05701.2; Description=Plant protein of unknown function (DUF827)
  Pfam annotation: Domain name=Filament; Domain location=73-282; Score=- 195.3; E_value=0.085; Accession=PF00038.12; Description=Intermediate filament protein
  Pfam annotation: Domain name=Pox_A_type_inc; Domain location=107-129; Score=5.0; E_value=16; Accession=PF04508.3; Description=Viral A-type inclusion protein repeat
  Pfam annotation: Domain name=Pox_A_type_inc; Domain location=213-235; Score=4.7; E_value=18; Accession=PF04508.3; Description=Viral A-type inclusion protein repeat
  Pfam annotation: Domain name=Pox_A_type_inc; Domain location=387-409; Score=5.4; E_value=14; Accession=PF04508.3; Description=Viral A-type inclusion protein repeat
  Pfam annotation: Domain name=Pox_A_type_inc; Domain location=525-547; Score=1.2; E_value=56; Accession=PF04508.3; Description=Viral A-type inclusion protein repeat
  Pfam annotation: Domain name=Pox_A_type_inc; Domain location=75-94; Score=1.7; E_value=49; Accession=PF04508.3; Description=Viral A-type inclusion protein repeat
  Pfam module annotation: Pfam domain module=DUF827::Filament::Pox_A _type_inc::Pox_A_type_inc::Pox_A_type_inc::Pox_A_type_inc::Pox_A_type_ inc; Domain location=59-336::73-282::107-129::213-235::387-409::525 -547::75-94
  Subcellular localization annotation: CTP_CleavageSite=42; ConfidenceScore=5.50e-01
MQTPKARVGASEVPQKKSPATPRTARQLKTPNSDAYSVSSPNAAKKTPKDRSPKVIECRSPHSPISEKKRPSKVQELESQIARLQEDLKNAKDQLNSSESWKRKAQQEAEEAKKQLVDLTKELQESHQQLLDFSASEEVRLQELRKISQDRDREWQSELEAVQKQQAMDSAALASAMNEIQKLKIQLERVCGSEATQINSSESAHAEIQELKMELDKTLSLVEKLKNEVGDCKESESRALEVVGKMQMQLETANQTVETLRSDGMKAAEAYKSLAFELEQSRTQAKSLEELVSKLQADLLSNANKSMLGPTPTNENEPSQENEEINQLKAELISAKAEVGQLKSVLDISEVRYQEEYIQSTLQIRCAFEQLERAKSESSQREVELYEELRRAKADTEELRANLMDKESQLLSLSGENMELNSKINENQSTRRQSELVIELKKLDADVEELKENLLDRETELQNIAAENSMLKMDIKEELEKNKITNEALASAEAARAAEQEALTKLGSITEEADKSNKRVVRVTEQLDAAQAANSELEAELRRLKVQSDQWRKAAEAAASMLSAGNNGKFVDRNCSRENSFNSVTGKMNSPYLLDTDGESPKKKNTNMMKKIGVLWRRNHH

SEQ ID NO: 131260 - protein, 373 aa, Glycine max
  Coding DNA Sequence Number=SeqID_39575
  Gene Ontology: Mol. function=transferase activity, transferring glycosyl groups; Cellular component=chloroplast; Biological process =histidine biosynthetic process
  Homolog annotation: Hit_ID=A7QCI8; Match level="QueryCoverage=90%, HitCoverage=86%, E-value=1e-170, Identity=87%"; Hit description =Chromosome chr12 scaffold_78, whole genome shotgun sequence
  Pfam annotation: Domain name=HisG; Domain location=88-268; Score =268.6; E_value=1.3e-77; Accession=PF01634.9; Description=ATP phosphoribosyltransferase
  Pfam annotation: Domain name=HisG_C; Domain location=269-356; Score =62.8; E_value=1.1e-15; Accession=PF08029.2; Description=HisG, C -terminal domain
  Pfam module annotation: Pfam domain module=HisG::HisG_C; Domain location=88-268::269-356
MAAIMLTTMNIPLHTSVWVNSRRKSWCCYASLSQPDRKEIRLGLPSKGRMSADTLELLKNCQLSVKQVNPRQYVAEIPQLSNLEVWFQRPKDITRKLLSGDLDLGIVGLDTFSEHGQGSEDLIIVHEALEYGDCRLSLAIPQYGIFENVNSVDELAKMPQWTEEKPLRVATGFTYLGPKFMKENGLKHVTFSTADGALEAAPAMGIADAILDLVSSGTTLRENNLKEIKGGVVLESQAVFIASRKSMIQRKGVLETTHEMLERLEAHLRAIGQFTVTANMRGSSAEEVAERILSQPSLMGLQGPTVSPVFCKHDGKVTPDYYAIVICVPQKALYKSIQQLRAIGGSGVLISPLTYIFDEETPRWRQLLSKLGL

SEQ ID NO: 131261 - protein, 226 aa, Glycine max
  Coding DNA Sequence Number=SeqID_39576
  Homolog annotation: Hit_ID=A5C3T5; Match level="QueryCoverage=65%, HitCoverage=18%, E-value=9e-10, Identity=30%"; Hit description =Putative uncharacterized protein
MKVGAYEGERMKVYGVVCWDHYEGWRGLEKEEISKSFSIWWRDLCKTCGGLNESKWFDDMVVRKVGKGDKTQFWKDIWVGNQSLASEYPRLFLNSLQKDEYGANSIWGSEMRESGGGIVLGGESGLWEGDMVENSYGGGGVVLVEGAEDSWLWPHEQSGLSLHIRLCAKGSRIQILMHTLVDMWKVKLAPKHESGSLLVGAMNHDNGRMVDKQGKMQAPCADSGFV

SEQ ID NO: 131262 - protein, 356 aa, Glycine max
  Coding DNA Sequence Number=SeqID_39577
  Gene Ontology: Mol. function=nucleic acid binding; Cellular component= cytoplasm; Biological process=ribosome biogenesis and assembly
  Homolog annotation: Hit_ID=Q9SK74; Match level="QueryCoverage=88%, HitCoverage=85%, E-value=1e-128, Identity=73%"; Hit description =Putative uncharacterized protein At2g20280
  Pfam annotation: Domain name=zf-CCCH; Domain location=89-114; Score =23.1; E_value=0.001; Accession=PF00642.15; Description=Zinc finger C- x8-C-x5-C-x3-H type (and similar)
MPPKQQSKADLAKKQKIVEDKTFGLKNKNKSKNVQKYVQNLKQSVQPNPDSSKLAAKKKKEEEKAKDKELNDLFKIAVSQPKVPVGVDPKSILCEFFKVGQCTKGFKCKFSHDLNVQRKGEKIDIYSDKRDEETMEDWDQETLEKVVESKKTEYNQNKPTDIVCKYFLDAVEKKQYGWFWVCPNGGKNCHYRHALPPGYVLKSQMKALLEEESEKITIEEEIENQRAKVTTTTPMTPELFMQWKKKKIEERDANLAAQQAERAKNDRMSGRELFLSDASLFVDDDEAYDKYQREPESESGDTEQNANGNATEDGPSTLIASADVDDDDELDMDELDELEASLSKTSIQIKELGAET

SEQ ID NO: 131263 - protein, 237 aa, Glycine max
  Coding DNA Sequence Number=SeqID_39578
  Homolog annotation: Hit_ID=A7PSW1; Match level="QueryCoverage=79%, HitCoverage=79%, E-value=2e-23, Identity=35%"; Hit description =Chromosome chr8 scaffold_29, whole genome shotgun sequence
MERSPQQHEMAKKKVSLVDVDKNYIDTPSQNKEFEFQTKKVSLRTRYPADELFFKGKLLPLNLLPRVQMVEKLIENADATTPLQAWTISPSESRKTKRFRLAQRLKASKTYVKTLFNKYGCYDNSCANDAATSHKKNVKDDARKNKNPFEFFGHNKHQRQRSCVVKNNDDMLEDGFINSNKRSCELQLLNKSTRAEQENSINSAISNCKKSQQQGSSNKVCSQSLVCGNKEITGLIH

SEQ ID NO: 131264 - protein, 635 aa, Glycine max
  Coding DNA Sequence Number=SeqID_39579
  Gene Ontology: Mol. function=RNA-directed DNA polymerase activity; Cellular component=exocyst; Biological process=exocytosis
  Homolog annotation: Hit_ID=A7PSW5; Match level="QueryCoverage=88%, HitCoverage=80%, E-value=1e-160, Identity=52%"; Hit description =Chromosome chr8 scaffold_29, whole genome shotgun sequence
  Pfam annotation: Domain name=Exo70; Domain location=37-613; Score =681.4; E_value=7.1e-202; Accession=PF03081.6; Description=Exo70 exocyst complex subunit
  Subcellular localization annotation: CTP_CleavageSite=17; ConfidenceScore=5.35e-01
MRKLCFNPKTESFALARSSPSSPLSLTSSPTLPRLSFSEPSSFHEDIFIEEAEALILKWNPDSSAYAKVTSLFYQDRNEAKQYISCVNQLQKTMHSLLSQNLSSDKLILAHNLMQIAMKRLTKEFYQILSMNRAHLDPESVSARSSRTSANSSASDYDDDFAAEDDDIRAAGDSISEVEQVSSGAMADLKLIADCMISSGYAKECVSVYILIRKSIIDEGIYRLGVEKLSSSRANKMDWEVLDLKIKSWLEATRISVRTLFNGERILCDHVFSYSDSVRESCFAEISRDGAALLFGFPELVAKTKKSSPEKLFRVLDMHAVASELLPEIESIFSSDYNSGVRSQFLVSLQRLTESAQILLAEFESTIQKGTSKPAVNGGGVHSLTIQTMNYLSVLADYLNVLSDIFPRDWLPPQKSSSLPESYLYSPESDYSASTPALTARFAWLILVLLCKLDGKAKHCKDVSLSYLFLANNLWYVVARVRSSNLQYVLGDDWILKHEAKAKRFVSNYEKVAWGEVVSSLAENPAAAEARAVFENFNRKFEEAYRKQNSFVVADRELRDEIKGSIARSIVPRYREWYNVLLAKVGSVRDLTATEYVTFTPEDIENYLVNLFFFGTSSSAVSSSSVSSSPLRRWS

SEQ ID NO: 131265 - protein, 35 aa, Glycine max
  Coding DNA Sequence Number=SeqID_39580
MVADILTGCGADKVFQKFTRYTSRVYSECEDLKFE

SEQ ID NO: 131266 - protein, 98 aa, Glycine max
  Coding DNA Sequence Number=SeqID_39581
  Subcellular localization annotation: CTP_CleavageSite=51; ConfidenceScore=5.35e-01
MALSQWPSATLPYLCGSQKVILKAAFFGGPKLSPVQNKSTRLGLIGLTAIRASSPSNYEALLPLAGFGHSRSKNIKELLCPFRGINTNHRASSSSHCH

SEQ ID NO: 131267 - protein, 427 aa, Glycine max
  Coding DNA Sequence Number=SeqID_39582
  Gene Ontology: Mol. function=molecular_function; Cellular component =membrane; Biological process=auxin mediated signaling pathway
  Homolog annotation: Hit_ID=A7PSY6; Match level="QueryCoverage=78%, HitCoverage=93%, E-value=1e-121, Identity=60%"; Hit description =Chromosome chr8 scaffold_29, whole genome shotgun sequence
  Pfam annotation: Domain name=DUF6; Domain location=176-306; Score =34.4; E_value=4.1e-07; Accession=PF00892.11; Description=Integral membrane protein DUF6
  Pfam annotation: Domain name=DUF6; Domain location=23-135; Score =25.5; E_value=0.0002; Accession=PF00892.11; Description=Integral membrane protein DUF6
  Pfam module annotation: Pfam domain module=DUF6::DUF6; Domain location=176-306::23-135
MAGDKQKLFNRLKPFIGVVFLQFGYAGMDILSKAALNKGMSNYVFVVYRHVFAFVVMAPFALILEKPVIDQNLYFLGMKYTTATFAVSMYNVLPAITFVMAWILRLEKVKLKSIRSQAKVVGTLATVVGAMVMTLIKGPILDLFGTHASSTHNQQNGGVNLQHAIKGSVMITIGCFSCACFMILQAITIEAYPAELSLTAWICLLGTVEGGVVALVMERKNLSAWSLQWDTKLLAAVYSGIVCSGMAYYIQGAVMKDRGPVFVTTFNPLCMVIVAIMGSFFLAEIMYLGRVVGAIVIILGLYLVVWGKSNDYESSNSITKKHTLPSKQTVEEEHSNHDVITLSNLGAGNIVRDEQVHRCLNNYDVVVEVFNVALWYVECITKTVNGSAGIYNTTKQGWMKNIFYLMTKACPQKTMQIEDRPISFIFQ

SEQ ID NO: 131268 - protein, 326 aa, Glycine max
  Coding DNA Sequence Number=SeqID_39583
  Gene Ontology: Mol. function=diaminopimelate epimerase activity; Cellular component=chloroplast; Biological process=lysine biosynthetic process via diaminopimelate
  Homolog annotation: Hit_ID=A7PSY2; Match level="QueryCoverage=93%, HitCoverage=97%, E-value=1e-101, Identity=54%"; Hit description =Chromosome chr8 scaffold_29, whole genome shotgun sequence
  Pfam annotation: Domain name=DAP_epimerase; Domain location=230-307; Score=27.6; E_value=2e-07; Accession=PF01678.10; Description =Diaminopimelate epimerase
  Pfam annotation: Domain name=DAP_epimerase; Domain location=77-199; Score=161.5; E_value=2.3e-45; Accession=PF01678.10; Description =Diaminopimelate epimerase
  Pfam module annotation: Pfam domain module=DAP_epimerase::DAP _epimerase; Domain location=230-307::77-199
  Subcellular localization annotation: CTP_CleavageSite=50; ConfidenceScore=5.96e-01
MAITATISVPFTSPSRRTLASVNSLSPRSTRSTLPTPQRTFKYPNSRLVVSSMSTETAVKTSSASFLNRKESGFLHFAKYHGLGNDFVLIDNRDSSEPKISAEKAVQLCDRNFGVGADGVIFVLPGISGTDYTMRIFNSDGSEPEMCGNGVRCFAKFVSQLENLHGRHSFTIHTGAGLIIPEVLEDGNVRVDMGEPILKASDVPTKLHANKDNAVVKSELVVDGVIWHVTCVSMGNPHCVTFSREGSQRGAGATLACGTGACATVVAAVLEGRAGRNCTVDLPGGPLQIEWREEDNHVYMTGSADDLEKIQVVWTALASNSNYYGE

SEQ ID NO: 131269 - protein, 981 aa, Glycine max
  Coding DNA Sequence Number=SeqID_39584
  Gene Ontology: Mol. function=translation initiation factor activity; Cellular component=eukaryotic translation initiation factor 3 complex; Biological process=translation
  Homolog annotation: Hit_ID=Q6ZNE1; Match level="QueryCoverage=96%, HitCoverage=96%, E-value=0.0, Identity=77%"; Hit description=cDNA FLJ16186 fis, clone BRTHA2007060, moderately similar to EUKARYOTIC TRANSLATION ...
  Homolog annotation: Hit description=INITIATION FACTOR 3 SUBUNIT 10
  Pfam annotation: Domain name=PCI; Domain location=395-533; Score =20.4; E_value=0.0012; Accession=PF01399.18; Description=PCI domain
MTSFLKPENALKRAEELINVGQKQDALQTLHDLITSKRYRAWQKTLERIMFKYVELCVDMRKGRFAKDGLIQYRIICQQVNVSSLEEVIKHFMQLSTEKAEQARSQAQALEEALDVDDLEADKRPEDLMLSYVSGEKGKDRSDRETVTPWFKFLWETYRTVLEILRNNSKLEALYAVIFLLMFLYNFLMLYMIHMYLLNMTAHRAFQFCKQYKRTTEFRRLCEIIRNHLANLNKYRDQRDRPDLSAPESLQLYLDTRFEQLKIATELGLWQEAFRSVEDIHGLMCLVKKTPKPSLMVVYYVKLTEIFWISSSHLYHAYAWFKLFLLQKSFNKNLSQKDLQLIASSVVLAALSVPPHDHTHGASHLELEHEKERNLRMANLIGFNLETKPESREMLSRSSLLAELASKGVMSCVTQEVKDIYHLLEHEFYPSDLALKALPLITKISKLGGKLSTASSVPEVQLAQYVPALERLATMRLLQQVSNVYQSMKIETLSGMIPFFDFSQVEKVSVDAVKQKFVSMRVDHMKNAVIFCKKSLESDGLRDHLANFAEQLNKARQMIYPPDRRSSKLGALLPSLTEVVAKEHKRLLARKSIIEKRKEEQERQLLEMEREEESKRLRLLKITEEAEQRRLATEFEQRKNQRILREIEERENEEAQALLQEAEKRIKKKGKKPIIEGDKITKQTLMELTLTEQLRERQEMEKKLQKLAKTMDHLERAKREEAAPLIEAAYQQRLVEERLLHDREQQQEVELSKQRHEGDLKEKERLVRMMGNKEIYQARVVSHRQAEFNRLRREREERISRILQSRRQEREKMRKLKYYLKLEEERQQKLHEEEEARKREDAERKKKEEEERLRKLEEIAEKQRQRERELEEKEKQRREALLGRAAAEPAPPARPLESGSAAPAAAAAAAAAPTPGKYVPKFRRQRTESTGAAPPPETDRWNSSSRPDGGDRWRGDDRKSAFGSGGGSRSSSTWTSSRNAR

SEQ ID NO: 131270 - protein, 442 aa, Glycine max
  Coding DNA Sequence Number=SeqID_39585
  Gene Ontology: Mol. function=solute:hydrogen antiporter activity; Cellular component=integral to membrane; Biological process =regulation of pH
  Homolog annotation: Hit_ID=A2Q190; Match level="QueryCoverage=97%, HitCoverage=97%, E-value=1e-141, Identity=64%"; Hit description =Na+/H+ antiporter-like protein, putative
MVAKQVLNDEMFTILVLMALFTTFITTPIVLAIYKPSRIVNSGSQKPSRLTDLQEKLRILACIHGPGNIPSLINFVESIRATNMSRLKLYVMQLTELTDSSSSILMVQRSRKNGFPFINRMKSGPMHEQIATAFQAYGEVGKVTVHHLTSISLLSTMHEDICHVAEKKGVAMIILPFHKRWGGEDEEVTEDLGQGLREVNQRVLQNAACSVAVLVNRGVARRYEQEPETSVAARKRVCIFFIGGPHDRKVLELGSRMAEHPAIRLLLVRFTSYTEVGDEGPKYNSPTSTTNWEKEKPITRSNLRMDILSRASHSHKFNSHDQELDEEAVNEFKVKWQETVEYIEKNATNITEEVLSIGKAKDHDLVIVGKQQLETTMLTNIDFRHGNEELGPIGDLFVSSGNGITSSLLVIQDRYLINSNESNLVKTSRAESTVIKDAIEEL

SEQ ID NO: 131271 - protein, 324 aa, Glycine max
  Coding DNA Sequence Number=SeqID_39586
  Gene Ontology: Mol. function=carboxylesterase activity; Cellular component=nucleus; Biological process=metabolic process
  Homolog annotation: Hit_ID=A7Q038; Match level="QueryCoverage=98%, HitCoverage=98%, E-value=1e-113, Identity=62%"; Hit description =Chromosome chr8 scaffold_41, whole genome shotgun sequence
  Pfam annotation: Domain name=Abhydrolase_3; Domain location=76-300; Score=292.0; E_value=1.2e-84; Accession=PF07859.4; Description =alphabeta hydrolase fold
MGSLPHVVEDCMGFLQLYSDGSIFRSNDIEFKVSPIQDNSITYKDYLFDKRFNLSLRFYKPQHVAPIDNNKKLPIVMFLHGGGFCFGSRTWPHIHNCCMRLASGLQAVVVSPDYRLAPEHRLPAAVDDAVEAVRWLQRQGLSLKEDAWLSGGVDFDCVFVVGDSSGGNIAHHLAVRLGSGSREMDPVRVRGYVLFAPFFGGEVRTKSEEGPPEHMLNLELLDRFWRLSMPVGESRDHPLANPFGPGSPNLEQVKLDPILVIVGGNELLKDRAKNYATRLKKLDKDIKYVEFEGCEHGFFTHDSFSSEVTEEVIQILKGFMLANF

SEQ ID NO: 131272 - protein, 444 aa, Glycine max
  Coding DNA Sequence Number=SeqID_39587
  Homolog annotation: Hit_ID=A7QFV0; Match level="QueryCoverage=95%, HitCoverage=96%, E-value=3e-52, Identity=47%"; Hit description =Chromosome undetermined scaffold_89, whole genome shotgun sequence
  Subcellular localization annotation: CTP_CleavageSite=25; ConfidenceScore=5.48e-01
MAKVAKPSSVPSSSHQLGSGPLKTGSMARKKTPSELRGELLKRASVVDFTDESQPPLADPTKTTEVDNGFKKSKLWKPPRYTDTRVDEVFAAKKSRFKIASGKENAKENPSLGQTSNLKNLSVFSTFEAKGHQGNTCLENSVTSSEVSKASVLQSCQTFEKWSQGKFRSVAELSSAVDTSCGTATIDLGKALRGLAALEPSNPNDTAADLSEGQDLTAVKGNFLSEFHLPGKKVLLDLTLKTSMRIVSSSSVNWFLLTSLSSVDVPVLCSPVPFQNSALSSPDIKCVETRRAEDIAASYNGSIWKDGESAQGSSDSLCTIEIKDALLPPWIICGICALMASEGRSFEASCPNNWGYGQGSLSDLVEMQATCWSFVTEPSSIGLNVALKSTCEKPESKAAGSESLQDHGSTFGIPEAVVTSGLCSCSLKGVRYSDESYTASLSPV

SEQ ID NO: 131273 - protein, 166 aa, Glycine max
  Coding DNA Sequence Number=SeqID_39588
  Subcellular localization annotation: CTP_CleavageSite=62; ConfidenceScore=5.75e-01
MSRNQARQAYALLHCSVSSFAFCVLTSSNSTNKSTTSSISIASKVWKTPVMGKCNKDATSLRVMVNSSIGRWKLLVSLCHIFAKASKFPLSLFSNEHVIRELNFVEATMPLISGRGGLKAQVEKDEGSSGEGQSPEWRRMKAQLEKDEGPEAETLSRLLIVAEGPN

SEQ ID NO: 131274 - protein, 104 aa, Glycine max
  Coding DNA Sequence Number=SeqID_39589
MAPLCVAGSHQGGPSMWQLLHHPPLVRQQHHHHLQTILSRKEATNSNLGENLTQGRRKRKSMVEASLVSGESLLVVGDVVSEGSGGRKTKVGDDNGDENGKEGE

SEQ ID NO: 131275 - protein, 366 aa, Glycine max
  Coding DNA Sequence Number=SeqID_39590
  Pfam annotation: Domain name=TPX2; Domain location=246-278; Score =19.2; E_value=0.0068; Accession=PF06886.2; Description=Targeting protein for Xklp2 (TPX2)
MESENRVAVEVEKRIIGVTTKVENIKKEVENDCNGAEIQTKNEVSKPTVDAKGPISAGDKVVIEASKTSANKNSKGAKETGGRASVASRSNKYAKDKPILKGPISISQKLRPSLSQSLSFPAKSAGEDAMQKSIDGYLVKPKVRHIQGNGIRGEGHIRHLNKSTNSEVNSLAKTNTGMPALKRSAFGRSTTVTAFTKSQTSEASLPVDQVSSTAKTAKANKEDDDSHSTTSSATPCLRSNGSGFSFRLEERAEKRKEENQEAEIKLLRKSMAFKATPMPSFYKEPPPKVELKKEKISLIFGLDNKDVVSKKPIRKTQAKLNSKENVTTENKEECQDPHDVNNSECKNEMELQSETVHAPNSALLLN

SEQ ID NO: 131276 - protein, 63 aa, Glycine max
  Coding DNA Sequence Number=SeqID_39591
MGCEDKVGLKVWGTERRGSEGLAQKDIVWCTVVSVDAATLACVCDVSADDDMDSDLKCSNVFY

SEQ ID NO: 131277 - protein, 294 aa, Glycine max
  Coding DNA Sequence Number=SeqID_39592
  Gene Ontology: Mol. function=SNAP receptor activity; Cellular component=membrane; Biological process=intracellular protein transport
  Homolog annotation: Hit_ID=Q9ZSD5; Match level="QueryCoverage=93%, HitCoverage=93%, E-value=2e-88, Identity=58%"; Hit description =Syntaxin-related protein Nt-syr1
  Pfam annotation: Domain name=SNARE; Domain location=205-267; Score =77.4; E_value=4.6e-20; Accession=PF05739.10; Description=SNARE domain
  Pfam annotation: Domain name=Syntaxin; Domain location=29-136; Score =41.2; E_value=3.6e-09; Accession=PF00804.16; Description=Syntaxin
  Pfam module annotation: Pfam domain module=SNARE::Syntaxin; Domain location=205-267::29-136
MNDLLSGLFSKGKQEEHVIEITEGGGIMELEKFLEEVESVKEDLKELERLHLSLDATNQNGKALHSPKGVRELRSRMDLDVALSLTKAKHVKGRLAALHRANQATLSLPDCGPGSYSDRTRTALVGALTKNLRQSMASFNKLREQISYEYRDTVQRRYYAVTGENPDQETIDLLISTGESETFLQKAIQQQGRASVMDTIQEIRERHGTMKEIERSLHELHQVFMDMAVLIQHQGEHLDDIESHVELANSFVSKGVQHLQVVRNHQKNTRNFTCFAVLLFIIVLVIILPIVFRN

SEQ ID NO: 131278 - protein, 742 aa, Glycine max
  Coding DNA Sequence Number=SeqID_39593
  Gene Ontology: Mol. function=protein binding; Cellular component=cis -Golgi network; Biological process=ER to Golgi vesicle-mediated transport
  Homolog annotation: Hit_ID=Q6F3B5; Match level="QueryCoverage=82%, HitCoverage=49%, E-value=1e-143, Identity=43%"; Hit description =Expressed protein
MAFVVDFLDIRSTFGASDCSLLCINSSLDAPIKHQDNPWASYITDASPTHSQDFGCFLNIDDINEVSATRKGFKNQIKNLWWRKGKEDGADSLNGPTYDFNSIESQIRVLGDYAFMLRDYELALSNYRLISTDYKIDKAWKRYAGVQEMMGLTYFILDQSRKEAEYCMENAFNTYLDILHSAVMLEQASYCYLLSKPSMLHKYGFHLVLSGEQYKKCDQIKHAIRTYRSALSVFRGTTWSYINDHVHFHIGQWYASLGMYDVAVKHMMEILACSHQSKTTQELFLGDFLQIVEKTGRTFEVTKLQLPVINISSLKIIFEDYRTFGTSSAANTREGLWHSLEEEMLPSFSSAKTNWLELQSKLISKKHSQSNVCVAGEAVNVNIEFKNPLQISIPISGVTLVCKYSASTGDIRSDENESSVEKDNEVDHFRNMSSDNSSFMVSEVDFLLGGGETTMLKTNTTPNSSAGKEHLCPFLANSQLQAIIPHSHSTIVVLGLGCSMPLSGIYNYATNLLSAVSQMLESHLNCSLKEIQLSVTPRAEGTLEILGVRWKLSAFPLLKSQSIPKLQGSIHPLPGKAYAGDLRQLVLELRNPSDFPVKRELWLGYQNIGLKNEHEKLEVALREPSAYKEVKLHVLGAGMQNWIVSKKYGVSAQIVTIDLRCGVLHYKFGQQCLHPRDFSSGMSQALIFNLSAGSGNDSLLFGPPGYEVRVKKHTGPRGRMSVIWVRCPISITEDSEGQRNTH

SEQ ID NO: 131279 - protein, 483 aa, Glycine max
  Coding DNA Sequence Number=SeqID_39594
  Gene Ontology: Mol. function=protein binding
  Homolog annotation: Hit_ID=A7QHS4; Match level="QueryCoverage=88%, HitCoverage=94%, E-value=1e-179, Identity=72%"; Hit description =Chromosome chr8 scaffold_99, whole genome shotgun sequence
  Pfam annotation: Domain name=BTB; Domain location=56-177; Score=-0.8; E_value=0.0042; Accession=PF00651.22; Description=BTBPOZ domain
MASWASWQVGRENATMIRSKQIGVEISFLSHLNLNGIYLITFSSFIQGKEEKIACVIGDRSTSDVVVRLRTQEGRDDWLYCHSEILVKNCKYFADRLSENWPTCQILDSRNCVDVYCQELNFDYHVNLIRLLYIVIDGSVDDLWHGVRNALGILQVAVELGCPQIINACVNYLEAVTWEEAEEDEILKIVPRMGLQAEPILARLQPVNQSAIVNIFVSALRFATSSPPPQLNDLKSSAQEQLEYMLTEDDDAPLLTADDNIKLEVKECVNRLLSRFNDSLTALFCGSTESLSEAGNIQLFKSYLTDLSWACQILSKLEIMREFVEYWFDASDKIVKVLEQGSSTTEVIEIKLRAIEVTSKVLEAIGYGTVILPTAKRLQVLKVWLPFVRVTKPLIDSVTMNCENAMLLKLDGEMWQSLESTFVSIILALPSGDQAEVLTEWLDNEYMQYPDLTEAFEVWCYRSKVSKRRLSLLEDEHAMTNSF

SEQ ID NO: 131280 - protein, 679 aa, Glycine max
  Coding DNA Sequence Number=SeqID_39595
  Gene Ontology: Mol. function=sequence-specific DNA binding; Cellular component=nucleus; Biological process=regulation of transcription, DNA-dependent
  Homolog annotation: Hit_ID=Q2PF41; Match level="QueryCoverage=99%, HitCoverage=99%, E-value=0.0, Identity=63%"; Hit description=BEL1 -like homeodomain transcription factor
  Pfam annotation: Domain name=Homeobox; Domain location=364-422; Score= 4.5; E_value=0.0039; Accession=PF00046.20; Description=Homeobox domain
  Pfam annotation: Domain name=POX; Domain location=177-315; Score =237.8; E_value=2.4e-68; Accession=PF07526.2; Description=Associated with HOX
  Pfam module annotation: Pfam domain module=Homeobox::POX; Domain location=364-422::177-315
MATYFHHGNSEIQSGGADGLQTLVLMNPGYIHYSDAPPPQQQTSQTAGNLVFLNPAAVAGGNNNSFNPHAPPSHTQQFVGIPLPNSQDLNHHSMHAHHDVSALHGFLPRMQYNPWNALDPALAARENPRAQQGLSLGLGSFREGQAPAMSGDDLRISGGSPSSASGVTNNGASGIQSVLLSSKYLKAAHELLEEVVNVNNGIGTELGKKRGGQNKVVGESSAAGSGDGSVGGEGNGKRSSELSTAERQEIQMKKAKLIGMLDEVEQRYRQYHQQMEIVGSSFEQAAGIGSARTYTALALQTISKQFRCLKDAIAGQVRTANKSLGEEDCFGGKMEGSRLKYVDHHLRQQRALQQLGMIQHNAWRPQRGLPERSVSVLRAWLFEHFLHPYPKDSDKHMLAKQTGLTRSQVSNWFINARVRLWKPMVEEMYTEEMKDHEQNRSEDKSSKSNEDSASKMSAPQDKGPSNETEAKSFNSKHEVSKSQNTAMVSVSRPSTSPLGVNVRSQSGFSFMGSSELDGITQGSPKKPRNHEMMHSPNSVPSMSMDVKPNDENNEQLSMKFGVERQGRNESSFMGNQTNFNGGFGQYPIGDIGRFDTEQFTPRLSGNGVSLTLGLDSLPGTHQTFLPNQNIQLGRSLDIGEPNEFGAISTSSPHSTAAYESISMQNPKRFAAQLLPDFVT

SEQ ID NO: 131281 - protein, 85 aa, Glycine max
  Coding DNA Sequence Number=SeqID_39596
MEVAAVWHLTGKRGILSRHYEDSYSNADSLTLSSVSYRFYTYVYFVVSESVIRCKKVKRLRKGAKITNVSPNLERFPARKGQISI

SEQ ID NO: 131282 - protein, 184 aa, Glycine max
  Coding DNA Sequence Number=SeqID_39597
MGEGCGLGHLQIPLHLQWTTLSGPQDQIRVHVYNPLDARFEKVSEVLSSVVEGLFEGLSDGGGDQVANDLWIEVIDLDVQLWEGGFDEGFEMFSGHWECWRIEWTATMEPRRYSTSRVMAMWTREGSQTEVKTKEAHLPLAALRNGAVGQREAEEAVEMVGGADVGAMGTKPERREKTTERNPC

SEQ ID NO: 131283 - protein, 164 aa, Glycine max
  Coding DNA Sequence Number=SeqID_39598
MLRAVIFCGAKWILAKTSPWLFGGLGLFNLKDWNLALLSRILWDFHCKKDSLWVRWVHHYYFRGSDVWNYNTSSSDSVLIKKIIQIRNFIISKELSTKEAKKRIQSWSTNEQLLVGKVYEYIRGVKPTVSWCSVIWNPATPLRCLSFCDLLKGIGCLLLTKLFF

SEQ ID NO: 131284 - protein, 133 aa, Glycine max
  Coding DNA Sequence Number=SeqID_39599
  Gene Ontology: Mol. function=oxidoreductase activity; Cellular component=chloroplast; Biological process=response to oxidative stress
  Homolog annotation: Hit_ID=A9PEL1; Match level="QueryCoverage=75%, HitCoverage=37%, E-value=4e-49, Identity=93%"; Hit description =Putative uncharacterized protein
  Pfam annotation: Domain name=AhpC-TSA; Domain location=16-76; Score= -23.5; E_value=0.093; Accession=PF00578.12; Description=AhpCTSA family
MCTGVFVFLSSKLPLVGNTAPDFEAEAVFDLEFIKYPLVSDITKSTSKSYGVLIPDQGIALRGLFIIDKEGVIQHSTINNLAIGRSVDETKITLQALQYVQENPDEVCPAGWKPGEKSMKPDPKLSKDYFAAV

SEQ ID NO: 131285 - protein, 206 aa, Glycine max
  Coding DNA Sequence Number=SeqID_39600
  Gene Ontology: Mol. function=transcription repressor activity; Cellular component=cytoskeleton
  Homolog annotation: Hit_ID=A7PP66; Match level="QueryCoverage=87%, HitCoverage=69%, E-value=9e-38, Identity=51%"; Hit description =Chromosome chr8 scaffold_23, whole genome shotgun sequence
  Pfam annotation: Domain name=DUF623; Domain location=118-177; Score =85.7; E_value=1.5e-22; Accession=PF04844.4; Description=Protein of unknown function, DUF623
  Subcellular localization annotation: CTP_CleavageSite=87; ConfidenceScore=5.45e-01
MSGSRKKLLLNTVSVKLGCGTCRRPSLRRIFHPKPKPKNLNNNTNYRKHKHSSSSSASSSFFASQWGGDSTSATPTNTNTTFSPYVDSSHFSDSDSYVKAVGGLGRAGKEGVAVEKDSDDPYLDFRHSMLQMILENEIYSKQDLRELLNCFLQLNSPHHHGVIVRAFTEIWNGVFSVRSSSHIHLKPLLVENRNHNGGPECTEYGP

SEQ ID NO: 131286 - protein, 279 aa, Glycine max
  Coding DNA Sequence Number=SeqID_39601
  Homolog annotation: Hit_ID=A5BKL9; Match level="QueryCoverage=67%, HitCoverage=74%, E-value=2e-42, Identity=51%"; Hit description =Putative uncharacterized protein
  Pfam annotation: Domain name=DUF623; Domain location=135-194; Score =93.8; E_value=5.4e-25; Accession=PF04844.4; Description=Protein of unknown function, DUF623
  Subcellular localization annotation: CTP_CleavageSite=38; ConfidenceScore=5.49e-01
MKLPSLLHNKPSSSSWPCHQPRTLSFRTQNDAAFKTINAAYLDTLESSETSFFTVSPDSGSFSTASEQDSRRPHSLDSVIRGLRSDRLFFEPDETSSILEAKPPPPPPPPPSPPPPPTTTTTLPFKDSVVMSVDSQDPYVDFRRSMEEMVEAQCVKDWEGLQELLCWYLKVNGKTNHGYIVGAFVDLLVASSSSSSSSSFSVSSSSNNNNNSQIVSPSSPLSFYSSSLSSSCSTRCVSCLEAEVVEVHNDIATSTPTSSFLLQQVREDQPSSSSSSYLN

SEQ ID NO: 131287 - protein, 597 aa, Glycine max
  Coding DNA Sequence Number=SeqID_39602
  Homolog annotation: Hit_ID=A7PP86; Match level="QueryCoverage=79%, HitCoverage=69%, E-value=1e-145, Identity=59%"; Hit description =Chromosome chr8 scaffold_23, whole genome shotgun sequence
  Pfam annotation: Domain name=XkdW; Domain location=88-186; Score= -13.6; E_value=0.026; Accession=PF09636.1; Description=XkdW protein
MSVSWRYSNLIPILIHGLYTLRTIFSIGMDKLHTIKIETRSRAQTPASSAVAVKARLKDVSNALMTSKELLRIINRMWGHEDRPSSSMSLISALHTELERARLQVNQLIQEQRSDQNEINYLMKCFAEEKAAWKKKEEEIVEAAIESVAGELDVERKLRRRLESLNKKLGRELADTKTSLLKVVKELESEKRAREIIEQVCDELARDADEDKSDIEKQKRVSTKVCEEVEKEKEIMQLTDRLREERAQKKLSEAKYQLEEKNAAVDKLRNQLEAFLGGKQVREKSRSSTHLSDEEIAAYLSRSRLGSHLIEDKEDDRGEVDNGVECEEESAESDLHSIELNMDNNNKSYKWTYPPESRFDTRRYPIEEEVKGSRRSTSGKASRKSTSLQRSISDGMEWGVQADKIQNSGDGIDWESFYELEKQAQGKGYADEMQGYKSVKGLRDQILAGSRLASSRGYASPTRQFSQPWPSRDLANNFQERPATAQGNGLKSRLGEARGEGQNVRKSKRSIPVCFCYHDGWYDRVRRVQNMCYISITSEFLFSPVAYAEARRVYKYRKLKIKPRRRKTQNPIRAKRNCEIQKSRDTSKIKHRARIIN

SEQ ID NO: 131288 - protein, 487 aa, Glycine max
  Coding DNA Sequence Number=SeqID_39603
  Gene Ontology: Mol. function=serine-type peptidase activity; Cellular component=lysosome; Biological process=proteolysis
  Homolog annotation: Hit_ID=A7PP87; Match level="QueryCoverage=98%, HitCoverage=95%, E-value=0.0, Identity=72%"; Hit description =Chromosome chr8 scaffold_23, whole genome shotgun sequence
  Pfam annotation: Domain name=Abhydrolase_1; Domain location=124-375; Score=-10.7; E_value=0.038; Accession=PF00561.11; Description =alphabeta hydrolase fold
  Pfam annotation: Domain name=Peptidase_S28; Domain location=60-487; Score=235.8; E_value=9.7e-68; Accession=PF05577.3; Description =Serine carboxypeptidase S28
  Pfam module annotation: Pfam domain module=Abhydrolase_1::Peptidase _S28; Domain location=124-375::60-487
  Subcellular localization annotation: CTP_CleavageSite=38; ConfidenceScore=5.62e-01
MAIGFQFIIITLFSLFSAPSLTFAFVPILPRFPSSAVSAELKQRSHSSQNGLYRTKFFTQILDHFNFNPQSNHTFQQRYLINDTFWGGAKNNAPIFVYTGNEGNIEWFTQNTGFMFENAPSFQALLVFIEHRFYGKSIPFGGNKTVAYANTSTLGYLSSTQALADYATLIIDLKKNLSATDSPVVVFGGSYGGMLAAWFRMKYPHVAIGALASSAPILHFMGLVSPDIFNNIITQDFRSESENCYKVIKGSWDLIDDTANKPGGMELLRKTFRICKSDDFGPGSLEGWLRAAWIYTAMTDYPTPSNFLNPLPAYPVKKAIDSSVTGNNRLAKLHAAASVYYNYTGKARCFDLDDNSDPHDLGGWQWQACTEMIMPVGGSNKESIFPEYEWSYEARASWCDFFYNVQPRPHWITTEFGGHAVERVLKRSASNIIFFNGLRDPWSGGGVLKTISKTLVAIVAKKGAHHVDLRFSSKEDPQWLKDVRKLE

SEQ ID NO: 131289 - protein, 318 aa, Glycine max
  Coding DNA Sequence Number=SeqID_39604
  Gene Ontology: Mol. function=oxidoreductase activity; Cellular component=cytoplasm; Biological process=metabolic process
  Homolog annotation: Hit_ID=A9PCT9; Match level="QueryCoverage=86%, HitCoverage=93%, E-value=1e-116, Identity=73%"; Hit description =Putative uncharacterized protein
  Pfam annotation: Domain name=Epimerase; Domain location=58-300; Score= -51.8; E_value=0.0026; Accession=PF01370.12; Description=NAD dependent epimerasedehydratase family
  Pfam annotation: Domain name=KR; Domain location=57-237; Score=-48.6; E_value=0.00016; Accession=PF08659.1; Description=KR domain
  Pfam annotation: Domain name=adh_short; Domain location=56-222; Score= 98.0; E_value=2.9e-26; Accession=PF00106.16; Description=short chain dehydrogenase
  Pfam module annotation: Pfam domain module=Epimerase::KR::adh_short; Domain location=58-300::57-237::56-222
MLGAWKSKPQFPPVCVSAFELLFWQKIMLRMGLRALFAESFHRFLSTQTGGKLQDKVALITGAASGIGKATATKFINNGAKVIIADIDQELGQETAKELGPNATFIACDVTQESDISNAVDLAVSKHKQLDIMYNNAGIACRSPLSIVDLDLELFDKVMDINVRGVVAGIKHAARVMIPRGSGSILCTASVTGVIGGVSQHTYSISKFAVVGIVKSLASELCRHGIRVNCISPFAIPTPLVMGEMSQIYPHVDAQRHEDIVHNAGVLKGANCEPNDIANAALFLVSDDAKYVSGHNLVVDGGFTSFKNLDLPAPNQVQ

SEQ ID NO: 131290 - protein, 244 aa, Glycine max
  Coding DNA Sequence Number=SeqID_39605
MVVEVPCDGEGLKKKNKKRFDGGISGCRSILVWSSGNHYDYQRVRLVWEGEVVRRIRWVRRVEGSGGSGGANVSGDRVGLAAAAGDEEALREGAVSVEQNDVASVEAFVFDVTAPSFGQNVTLATVPIRVTEAPTLPGLVLETQQQPLRRRRVEREVLLRVLFRNHEPVQLPDVARRQRLLEHGYLLLLLRQVISSLVRNDNVVFLLLLLVVQIETRATWRLVAVGRWSSIVLFPVNSGLSMTL

SEQ ID NO: 131291 - protein, 319 aa, Glycine max
  Coding DNA Sequence Number=SeqID_39606
MEASALSQRIMEGSQWKLALLLNFHPSHLRMTGIHLLHPVKKIEKWKLEEERRMEKARLAEETEQGQNGSGYIGGTRREAPPSLPKRTWTWQQRVQVPVKGADRCVHFGLPKLIQVTMVYHDGYGGVEIPPTKPLAPQIVTRAVTSGKNSCSDTGRDFIRASFAANFFARYNDNMVSAFWCSIVVVAEAIGDLRDAFVAFPRYRTSLAIGFGCSRDQSQGIELDAATERGGKQPWETAACPLHVILEVARSLGDPYESASGCRDIGVAIRGNYQWQSVGFCGGAMTMLERKLATEQRRCARLALHGEVINFNGIHGKAK

SEQ ID NO: 131292 - protein, 270 aa, Glycine max
  Coding DNA Sequence Number=SeqID_39607
  Homolog annotation: Hit_ID=Q9FFZ3; Match level="QueryCoverage=45%, HitCoverage=74%, E-value=2e-21, Identity=50%"; Hit description =Genomic DNA, chromosome 5, P1 clone:MBL20
MGNGYRRRVSPITLEMFRVLDLVIMDKGARYRDDVGVVQMVQDIWQGTQLLAIDATAAMGLLRSVLIGDELTEKEKKTLKRTLTDMASIVPIGVLMLLPLNLFIYCICVWGASTLPKKCYISVYQGKMDNVDFLQVTAVGHAAMLAAIKRYVPALRAARLYAASWVRDIGPDLRPDDYKKDDDMTDETNGEKKTTKGKESSTLEDLAVAARGGMETLRPALQRVYMTRASAYRDALKSFIEGYQEGVQQVMEKKEDSKTQEDADLPKKST

SEQ ID NO: 131293 - protein, 402 aa, Glycine max
  Coding DNA Sequence Number=SeqID_39608
  Homolog annotation: Hit_ID=A7QF78; Match level="QueryCoverage=97%, HitCoverage=96%, E-value=1e-144, Identity=62%"; Hit description =Chromosome undetermined scaffold_87, whole genome shotgun sequence
  Pfam annotation: Domain name=DUF1022; Domain location=15-386; Score =716.3; E_value=2.2e-212; Accession=PF06258.2; Description=Protein of unknown function (DUF1022)
MPEILDGAIRRAVVIGNGFAGAENQCIGLVRALGFSNRHSLYRVTRPRGGINRWLKWLPVSIHKRLDSVIRMICGKSRFQTPHKIGISNVLDADAHHIATMARETFHKDGPLLVIASGRDTISVASSIKRLAPENVFLVQIQHPRFQLNRFDLVITPRHDYFPLTPHAQRQIPWFLRRWVTPWEPPGHNVVLTVGALHQADSAALRVAASAWHNELATLPKPLLVVNVGGPTGNCPYDVDLVKKLVVMLQNVLWSCGSIRISFSRRTPEKISKILVKEFATNPKVQIWDGEGSNPHMGHLAWADAFVITADSVSMLSEACSTGKPVYVIGAERCTWKFADFQNSLQKQGVARPFTGNENMTAESWSYPPLNDTAEAASQVVAALAQRGWTIQCLLAEAVSFY

SEQ ID NO: 131294 - protein, 257 aa, Glycine max
  Coding DNA Sequence Number=SeqID_39609
  Gene Ontology: Mol. function=DNA binding; Cellular component=nucleus; Biological process=regulation of transcription
  Homolog annotation: Hit_ID=A7PPA1; Match level="QueryCoverage=98%, HitCoverage=100%, E-value=2e-68, Identity=55%"; Hit description =Chromosome chr8 scaffold_23, whole genome shotgun sequence
  Pfam annotation: Domain name=NAM; Domain location=4-136; Score=169.8; E_value=7.2e-48; Accession=PF02365.6; Description=No apical meristem (NAM) protein
MGNMPPGYRFYPTEEELILFYLHNKLEGEREDMNRVIPVVDIYDYNPSQLPQISGEASMGDTEQWFFFIPRQESEARGGRPKRLTTTGYWKATGSPNHVYSSDNHIIGIKRTMVFYSGRAPNGTKTDWKMNEYSAIKGEPSSSISNKAVPTLRKEFSLCRVYKKSKCLRAFDRRPPPRRDVVSYSGAQNVEEQQKGSTLYDYHHKIMVKRSTTCSPETSTSSGDHDQPPLHGEETTQMDVDPFLDWEKVDFFLGSEP

SEQ ID NO: 131295 - protein, 129 aa, Glycine max
  Coding DNA Sequence Number=SeqID_39610
MPLLPLLLHSSSRELMLTLQPSAFILSILGFQFHCSLSLPGPSNWMDSYPFVMALATCTQHYCWGTQQTVKWRNCPSAIILPEEGSSGKQFPEERHPECFRKKLLPEEFQCLPEEASSGSLPEEASSGS

SEQ ID NO: 131296 - protein, 286 aa, Glycine max
  Coding DNA Sequence Number=SeqID_39611
  Gene Ontology: Mol. function=hydrolase activity, hydrolyzing O -glycosyl compounds; Cellular component=extracellular region; Biological process=carbohydrate metabolic process
  Homolog annotation: Hit_ID=Q2HTE2; Match level="QueryCoverage=100%, HitCoverage=50%, E-value=1e-145, Identity=79%"; Hit description =Sialidase
  Pfam annotation: Domain name=Glyco_hydro_32N; Domain location=1-286; Score=469.3; E_value=5e-138; Accession=PF00251.11; Description =Glycosyl hydrolases family 32 N termi
MYYKGIYHLFYQYNPKGSVWGNIVWAHSVSKDLINWRSLEHALYPSKPFDKFGCWSGSATIVPGKGPVILYTGVVDDKQTQVQCYAIPEDLNDPLLQKWVKPDKFNPILVANKGVNGSAFRDPTTAWLSKDGHWKILVGSRKNLTGIAYLYRSKDFMNWVQAKHPIHSKGETGMWECPDFYPVLLRGNAGLETSEEGNHVKYVFKNSLDITRFDYYTVGTYFKDKDRYAPDNTSEDGWGGLRYDYGNFYASKSFFDPSKNRRILWGWANESDTKEDDVRKGWAGIQ

SEQ ID NO: 131297 - protein, 252 aa, Glycine max
  Coding DNA Sequence Number=SeqID_39612
  Gene Ontology: Mol. function=protein binding; Biological process =response to chitin
  Homolog annotation: Hit_ID=A7PPC0; Match level="QueryCoverage=38%, HitCoverage=76%, E-value=1e-36, Identity=75%"; Hit description =Chromosome chr8 scaffold_23, whole genome shotgun sequence
  Pfam annotation: Domain name=Auxin_inducible; Domain location=20-108; Score=87.2; E_value=5.3e-23; Accession=PF02519.5; Description=Auxin responsive protein
MLGKKSFKKLAKKVKKGVGGIDPDPVRHECLLKEYEEECATNTPPIGFFAVYVGEERQRYVVPTRYLSHPLFKMLLEKAYDEFGFSQRNGLVIPCSVSTFQEVVNAIECNNDKFDLGKEAYSSLRIETSQAIYLLSQRGLLKLEDRDFPSYLSSLSERLSTWIDSLYGGSLKLEDRDFPSNLSSLSERLSTWIESPYGGSLKLEERDFSSYLSSLSERLSTWIESPYGGSLKLEDRNFSSYLSSLSERLTQA

SEQ ID NO: 131298 - protein, 493 aa, Glycine max
  Coding DNA Sequence Number=SeqID_39613
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=P37107; Match level="QueryCoverage=88%, HitCoverage=73%, E-value=0.0, Identity=80%"; Hit description=Signal recognition particle 54 kDa protein, chloroplast precursor
  Pfam annotation: Domain name=APS_kinase; Domain location=176-304; Score=-95.9; E_value=0.013; Accession=PF01583.11; Description =Adenylylsulphate kinase
  Pfam annotation: Domain name=CbiA; Domain location=179-354; Score= -19.8; E_value=0.0022; Accession=PF01656.14; Description=Cobyrinic acid a,c-diamide synthase
  Pfam annotation: Domain name=MMR_HSR1; Domain location=178-327; Score= -18.5; E_value=0.053; Accession=PF01926.14; Description=GTPase of unknown function
  Pfam annotation: Domain name=MobB; Domain location=178-311; Score= -31.6; E_value=0.02; Accession=PF03205.5; Description=Molybdopterin guanine dinucleotide synthesis protein B
  Pfam annotation: Domain name=SRP54; Domain location=176-392; Score =379.4; E_value=5.9e-111; Accession=PF00448.13; Description=SRP54 -type protein, GTPase domain
  Pfam annotation: Domain name=SRP54_N; Domain location=79-164; Score =110.0; E_value=6.9e-30; Accession=PF02881.10; Description=SRP54-type protein, helical bundle domain
  Pfam annotation: Domain name=SRP_SPB; Domain location=423-492; Score =33.0; E_value=4.5e-09; Accession=PF02978.10; Description=Signal peptide binding domain
  Pfam annotation: Domain name=cobW; Domain location=178-354; Score= -73.4; E_value=0.03; Accession=PF02492.10; Description=Cobalamin synthesis proteinP47K
  Pfam module annotation: Pfam domain module=APS_kinase::CbiA::MMR _HSR1::MobB::SRP54::SRP54_N::SRP_SPB::cobW; Domain location=176 -304::179-354::178-327::178-311::176-392::79-164::423-492::178-354
  Subcellular localization annotation: CTP_CleavageSite=75; ConfidenceScore=5.81e-01
MEAVTGSHHFSTLSLSFSHNKTLRSSSAKSIRLSSPSTNASLSSRNWFAKEVWGWVNSNSKGVAVRRYTRGVVVRAEMFGQLTSGLETAWNKLKGEEVLSKENIVEPMRDIRRALLEADVSLPVVRRFVQSVSDQAVGVGVIRGVRPDQQLVKIVHEELVQLMGGEVSELVFAKSGPTVILLAGLQGVGKTTVCAKLANYLKKQGKSCMLVAGDVYRPAAIDQLAILGKQVDVPVYTAGTDVKPSEIAKQGLEEAKKKKIDVVIVDTAGRLQIDKTMMDELKEVKKALNPTEVLLVVDAMTGQEAAALVTTFNLEIGITGAILTKLDGDSRGGAALSVKEPDNGMLMNSSKILVCPQLWEVSGKPIKLVGRGERMEDLEPFYPDRMAGRILGMGDVLSFVEKAQQVMRQEDAEELQKKIMSAKFDFNDFLKQTRTVAKMGSVSRVIGMIPGMGKVTPAQIRDAEKNLLNMEAMIEAMTPGLFFLLINDVTSVE

SEQ ID NO: 131299 - protein, 102 aa, Glycine max
  Coding DNA Sequence Number=SeqID_39614
MDRVAAIAYEAHCALHFLHCIGLAYTVELQAELNQLREENAQLKQGCISNSIILTRILLLFFMPSPRGKESNSSYQGYTRYWCNIVLSRWWALLPDIQHRSN

SEQ ID NO: 131300 - protein, 123 aa, Glycine max
  Coding DNA Sequence Number=SeqID_39615
  Gene Ontology: Mol. function=protein binding; Cellular component =cytoplasm; Biological process=multicellular organismal development
  Homolog annotation: Hit_ID=Q6TDS5; Match level="QueryCoverage=100%, HitCoverage=60%, E-value=1e-49, Identity=79%"; Hit description =CEN/TFL1-like GTP-associated binding protein
  Pfam annotation: Domain name=PBP; Domain location=1-115; Score=40.7; E_value=5.2e-09; Accession=PF01161.11; Description=Phosphatidylethano lamine-binding protein
MTDPDVPGPSDPYLREHLHCLKFCKIYAPLSSHQTMDRIVTDIPGTTDATFGKELVSYEIPKPNIGIHRFVFVLFKQKRRQCVTPPTSRDHFNTRKFAAENDLALPVAAVYFNAQRETAARRR

SEQ ID NO: 131301 - protein, 115 aa, Glycine max
  Coding DNA Sequence Number=SeqID_39616
MCDLYPFLPSWDKPKETIFCVLSRQGTVNSFWEGIVLTIMERLNSELYYQNCHMIKENERLRKKAQLLNQENQQLLSELKKKLSKGNAKTNAAPNTILDLNLGSSSSHNPSGSSN

SEQ ID NO: 131302 - protein, 244 aa, Glycine max
  Coding DNA Sequence Number=SeqID_39617
  Gene Ontology: Mol. function=nucleic acid binding; Cellular component= ribonucleoprotein complex; Biological process=multicellular organismal development
  Homolog annotation: Hit_ID=A7PU04; Match level="QueryCoverage=79%, HitCoverage=39%, E-value=8e-77, Identity=78%"; Hit description =Chromosome chr7 scaffold_31, whole genome shotgun sequence
  Pfam annotation: Domain name=RRM_1; Domain location=124-194; Score =53.5; E_value=7.2e-13; Accession=PF00076.13; Description=RNA recognition motif. (a.k.a. RRM, RB
  Pfam annotation: Domain name=RRM_1; Domain location=17-89; Score =51.0; E_value=4.2e-12; Accession=PF00076.13; Description=RNA recognition motif. (a.k.a. RRM, RB
  Pfam module annotation: Pfam domain module=RRM_1::RRM_1; Domain location=124-194::17-89
MAEGKEESKSSEESVKLFVGQVPKHMTEPELLAMFKEFALVDEVNIIKDKATRASRGCCFVICPSREEADKAVNACHNKRTLPGLLSVLHCAVFSPLRGLFVFASSPLQVKYADGELERLEHKLFIGMLPKNVSEVEISALFSKYGTIKDLQILRGSQQTSKGCAFLKYETKEQALTALEAINGKHKMEYFGSSSGIQPRNPVGSGLTHYLYGRLELDPSLERGTQAIACDAHYMLAIKCAQAE

SEQ ID NO: 131303 - protein, 711 aa, Glycine max
  Coding DNA Sequence Number=SeqID_39618
  Gene Ontology: Mol. function=identical protein binding; Cellular component=extracellular region; Biological process=negative regulation of catalytic activity
  Homolog annotation: Hit_ID=A7PPH1; Match level="QueryCoverage=99%, HitCoverage=99%, E-value=0.0, Identity=58%"; Hit description =Chromosome chr8 scaffold_23, whole genome shotgun sequence
  Pfam annotation: Domain name=PA; Domain location=319-418; Score=35.1; E_value=2.6e-07; Accession=PF02225.13; Description=PA domain
  Pfam annotation: Domain name=Peptidase_S8; Domain location=80-545; Score=20.0; E_value=7.8e-08; Accession=PF00082.13; Description =Subtilase family
  Pfam annotation: Domain name=Subtilisin_N; Domain location=1-75; Score=50.5; E_value=5.8e-12; Accession=PF05922.7; Description =Subtilisin N-terminal Region
  Pfam module annotation: Pfam domain module=PA::Peptidase _S8::Subtilisin_N; Domain location=319-418::80-545::1-75
MGELPVARTYAVESHHHNLLEAAIGDKQLARESKIHSYGKSFNGFVARLLPHEAEKLQEEDSVVSVFPNTHRKLHTTRSWDFLGMPLNVKRNSKVESHIIVGVLDTGIWVDCPSFNAEGYGPPPRRWKGKCETGANFTGCNNKVIGAKYFNLAKSNSPSDNLSPADDIGHGTHTASTAAGAAVKGASLYGIGKGTARGGVPSARVAMYKVCWLDDCNDMDMLAAFDEAIADGVNIISISIGGPSHDFFTDPIAIGSFHAMGRGILTSCSAGNGGPRPMTVENVAPWLLTVAASAVNRQFTTLVAFGDGKNITGLSINTFAPKKKMYPLTSGLLASNLSGEGYGSASGCDYGTLSKEKVQGRIVYCVGGTGTQDLTIKELGGAGAIIGLDEEIDASYTTVIPGTFVEASTVGNTIDLYINSTKNARAVIHKTTTTEVPAPFLASFSSRGPQTITPNILKPDLVAPGVNILAAYSKLVTLTGYHEDNRYDVFNILSGTSMACPHATATAAYVKSFHPDWSPAAIKSALMTTATPIKISDNFTELGSGSGQIDPVKALHPGLVYDMRISSYIGFLCKAGFNNTNIGILIGKPNFNCTSIKPSPGTDGINYPSMHIQLLSASDRISAVFLRTVTNVGSRNSTYKAKVTTPKGLSVKVKPNILKFSRLHQKLSFKVVLKGPPMPEDTFVESASLEWKDSEHTVRSPILVFKPMTVY

SEQ ID NO: 131304 - protein, 95 aa, Glycine max
  Coding DNA Sequence Number=SeqID_39619
MEEIEVGVWRRSVVVVITIYILRHIAFNGADKGRNGPVMDTNADEDIFKEVATTVDFEDVGTECVGAFSHSDMGFNSFLDLGPLHRVPWLPLHHV

SEQ ID NO: 131305 - protein, 504 aa, Glycine max
  Coding DNA Sequence Number=SeqID_39620
  Gene Ontology: Mol. function=protein dimerization activity; Cellular component=nucleus; Biological process=regulation of transcription, DNA-dependent
  Homolog annotation: Hit_ID=Q0GPE0; Match level="QueryCoverage=37%, HitCoverage=99%, E-value=5e-98, Identity=92%"; Hit description=BZIP transcription factor bZIP39
  Pfam annotation: Domain name=bZIP_1; Domain location=152-215; Score =35.5; E_value=1.9e-07; Accession=PF00170.12; Description=bZIP transcription factor
MNNVSMMDAESEKRSASTISFSSSSSNSSSSCHRLDRLVDAEEIQAAETLAQLAMRDSHSADKWCTKQDTTRVTRESPTLLHSDLSLGPGGQAIAGQYPDEKISTTTVETEMFQQDDCSRHMKVEQDADVLPNTSYSLVRSRKSRRNLTEEEKEVRRIRRILANRESARQTIRRRQALCEELTRKAASLVVENENLKREKQLALNEYQSLETTNKHLKAQIAKSINTEVEKTPVEPGSSVAEVTPLSGNGPWFLYNHFPVPQIFWPSILQFSNPVHLQNTSLNSFSIPPNAYVPCSSESESRHKQNNLINDNRTQNPFYMFPCPWLFPLPQFGNQQSSPSSSLKDEQDNLSLGKPCSSSSSLNTMANVDYQAALPIKLKTAASGWTEAISINGPGWATPRSSLDGGEKKTGCYIIEKYHEPSLGCNGHASAVKQEHEFQLHSAPNNKVSSTAYIATSSLEKKQGQCICQGRNLVDAVAAAEARKRRKELTKQKSIHNRQSRMHC

SEQ ID NO: 131306 - protein, 448 aa, Glycine max
  Coding DNA Sequence Number=SeqID_39621
  Gene Ontology: Mol. function=nucleoside-triphosphatase activity; Cellular component=integral to membrane; Biological process=transport
  Homolog annotation: Hit_ID=A7PPH7; Match level="QueryCoverage=100%, HitCoverage=66%, E-value=1e-179, Identity=53%"; Hit description =Chromosome chr8 scaffold_23, whole genome shotgun sequence
  Pfam annotation: Domain name=ABC_tran; Domain location=192-382; Score= 91.5; E_value=2.7e-24; Accession=PF00005.18; Description=ABC transporter
  Pfam annotation: Domain name=PDR_assoc; Domain location=32-100; Score= 117.3; E_value=4.7e-32; Accession=PF08370.2; Description=Plant PDR ABC transporter associated
  Pfam module annotation: Pfam domain module=ABC_tran::PDR_assoc; Domain location=192-382::32-100
NIKPWMIWGYYISPMMYGQNAIVINEFLDERWSQPNTDPRIGATTVGKVLLKSKGFFTEEYWFWICIGALFGFALLFNLLFIVALTYLNPFSDSSKAFIMDDDDKKNKKSTNKHRIIEVGPCIDIAVKKSSELVGCPDQERRTRMILPFQPLSLSFSHVNYYVDMPSEMKNQGINEDRLQLLRDVSGAFRPGILTALMGVSGAGKTTLLDVLVGRKTGGYIEGSISISGHLKNQATYARVSGYCEQNDIHSPYVTVYESLLFSAWLRLPSHVNTQTRKMFVEEVMEWVELKPIKDALVGLPGIDGLSTEQRKRLTIAVELVANPSIILMDEPTSGLDARAAAIVMRTVRKTVDTGRTVVCTIHQPSIDIFEAFDELLLMKRGGQVIYAGPLGHHSQKLIEYFEAIAGIQKIKDGYNPATWMLDISTPSMEAQLDIDFAKIYVNSTLYQ

SEQ ID NO: 131307 - protein, 817 aa, Glycine max
  Coding DNA Sequence Number=SeqID_39622
  Gene Ontology: Mol. function=nucleoside-triphosphatase activity; Cellular component=integral to membrane; Biological process=transport
  Homolog annotation: Hit_ID=A7PPH7; Match level="QueryCoverage=94%, HitCoverage=96%, E-value=0.0, Identity=48%"; Hit description =Chromosome chr8 scaffold_23, whole genome shotgun sequence
  Pfam annotation: Domain name=AAA; Domain location=193-351; Score= -30.0; E_value=0.0085; Accession=PF00004.20; Description=ATPase family associated with various cellular activities (AAA)
  Pfam annotation: Domain name=ABC2_membrane; Domain location=516-729; Score=197.2; E_value=4.1e-56; Accession=PF01061.15; Description=ABC -2 type transporter
  Pfam annotation: Domain name=ABC_tran; Domain location=191-414; Score= 67.5; E_value=4.5e-17; Accession=PF00005.18; Description=ABC transporter
  Pfam annotation: Domain name=PDR_assoc; Domain location=734-801; Score=121.3; E_value=2.9e-33; Accession=PF08370.2; Description=Plant PDR ABC transporter associated
  Pfam module annotation: Pfam domain module=AAA::ABC2_membrane::ABC _tran::PDR_assoc; Domain location=193-351::516-729::191-414::734-801
  Subcellular localization annotation: CTP_CleavageSite=26; ConfidenceScore=5.45e-01
MASTSVRNDLVSGKRNQRSWPSSSFRAASWSASPFTKSAGRSSGEDNEEDLKWAAIERLPTLDRMRKGMMSVVLDNGKVVCCQVDVTHLKLQDKKQLLDTVLKYVDDDNDKFLRKLRDRTNRVGIKIPNIEVRYENLSVEGNVHVGTRALPTLLNVTLNTFERILELFRLAPSKKRKIHILKDVSGIVKPSRMTLLLGPPGAGKTTLLLALAGKLDPDLKVSGRITYCGHELKEFVAKKTCAYIGQHDLHYGEMTVRETLDFSGRCLGVGTRYQMLEELLRREKQAGIKPDPEIDAFMKATAIYGQKTNLQTDYVLKIIGLDICADTLVGDNMRRGISGGQRKRVTTGEMLVGPAKALFMDEISTGLDSSTTFQICKFMRQMVHIMDETMVISLLQPAPETYELFDDVILLSEGQIVYQGQREHVLEFFENMGFKCPPRKGVADFLQEVTSKKDQEQYWFRRDEPYRYISVPEFAECFQSFYIGEQLATEFKVPYDKSQTHRAALAKDKYGISNWELLKACFSREWLLMRREMFVYIYRIIQLVVLSILGFTLFLRTEMSVGTVEDGMKFFGAMFFSIMNIMFNGFSEQAMLVSRLPVFYKQRDFMFYPAWAFGLPIWVLRIPISLVESGIWVVFTYYTIGFAPSASRFFKQFLALFGVHQMAISLFRLVGAVGRTYVVANILSGLTFQIVLVLGGFIVSKNNIKPWLKWGYYVSPMMYGQNAIVINEFLDERWSKPNTDSRFDAPTVGKVLLKSRGFFTDDYWFWICIGALFGFVLLFNLLCIVALTYLNAMGDSKAFITDEDDRRMKIQPLDTCQ

SEQ ID NO: 131308 - protein, 444 aa, Glycine max
  Coding DNA Sequence Number=SeqID_39623
  Homolog annotation: Hit_ID=A7PPI4; Match level="QueryCoverage=99%, HitCoverage=92%, E-value=1e-150, Identity=56%"; Hit description =Chromosome chr8 scaffold_23, whole genome shotgun sequence
  Pfam annotation: Domain name=DUF247; Domain location=39-430; Score =583.0; E_value=2.9e-172; Accession=PF03140.6; Description=Plant protein of unknown function
MEEEANHHAIDISNIIDRERLASMELKISENPKFLCKAAGKRSCCIFRVPQSLVEVNGKAYQPRIVSIGPYHRNQPRLNMIEEHKWRYLGSLLSRTNTIGFVLEDLFKAIAPLESEARECYSETINLDSHDFIQMMILDGCFIIELFRKVARLVPFEREDPLLTMVWILPFFYRDFLKLENQIPFFILNQLYQVTKLPGEKSTPTLSTLALLFFNNSLQKPDESLQNDVQGKHLLDLVRSSFIPKNDEETEPRKRVMTPTHVILCVSKLRRAGIKINPSKESESFLNVKFRRGVIEMPSLTVDDFMSSFLLNCVALEQCYSGCSKHFTAYITLLDCLVNTYRDVEYLCDRNVVENHLGTEGEVASFINNAGKDVAVDLDLCYLSLLFNDVHKYYINSWHVQWASFKHTYFDTPWSFISLLAASILLLLTVAQTYFSASQYFHQT

SEQ ID NO: 131309 - protein, 631 aa, Glycine max
  Coding DNA Sequence Number=SeqID_39624
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS5; Match level="QueryCoverage=88%, HitCoverage=57%, E-value=0.0, Identity=84%"; Hit description=Starch branching enzyme
  Pfam annotation: Domain name=Alpha-amylase; Domain location=33-385; Score=-39.4; E_value=3e-07; Accession=PF00128.15; Description=Alpha amylase, catalytic domain
  Pfam annotation: Domain name=Alpha-amylase_C; Domain location=510 -605; Score=110.9; E_value=3.9e-30; Accession=PF02806.9; Description =Alpha amylase, C-terminal all-beta do
  Pfam module annotation: Pfam domain module=Alpha-amylase::Alpha -amylase_C; Domain location=33-385::510-605
MEALTVQRLISEQDHIYGVFHFSLLNRAIGKTRIEFQNFNPRDIVEFQHGAIEPKINTYVNFRDDVLPRIKRLGYNAVQIMAIQEHSYYASFGYHVTNFFAPSSRFGTPEELKSLIDRAHELGLLVLMDIVHSHASNNTLDGLNMFDGTDGHYFHPGSRGYHWMWDSRLFNYGSWEVSAGSKEFIGIVSDKIFRTFCSTVLRYLLSNSRWWLDEYKFDGFRFDGVTSMMYTHHGLEVAFTGNYNEYFGFATDVDAVIYLMLTNDVIHGLFPEAVTIGEDVSGMPTFCLPTQDGGVGFDYRLHMAIADKWIEILKKNDEDWKMGDIVHTLTNRRWLEKCVAYAESHDQALVGDKTIAFWLMDKDMYDFMALDRPSTPIIDRGIALHKMIRLITMGLGGEGYLNFMGNEFGHPEWIDFPRGDQHLPTGVIVPGNNNSFDKCRRRFDLYMYLLSEKRKRTIYKGNSSKLQNLSSVLLNQGDADYLRYRGMQEFDQAMQHLEEKFGFMTAEHQYISRKNEGDKIIVFERGNLIFVFNFHWNNSYSDYRVGCSTPGKYKIVLDSDDALFGGFSRLNHTAEYFTSEGWYDDRPRSFLIYAPSRTAVVYALADDVEPTLADEAEPALADEAEPEPVDP

SEQ ID NO: 131310 - protein, 522 aa, Glycine max
  Coding DNA Sequence Number=SeqID_39625
  Gene Ontology: Mol. function=protein serine/threonine kinase activity; Cellular component=myosin complex; Biological process =protein amino acid phosphorylation
  Homolog annotation: Hit_ID=Q93XL9; Match level="QueryCoverage=100%, HitCoverage=68%, E-value=1e-142, Identity=50%"; Hit description=CTR1- like protein kinase
MEMPARRSINYSLLSQTPDDKLTPPLFGSSSGDAKINNSKFERVSDWDSGVDHRQGNRIGNLHSSFGMQRQSSESSFGESSLSGEFYAPILSTVAANEIDGFRGRFPGNSAMRSGGSSGKSWAQQTEESYQLQLALALRLSSEATCADDPNFLDPVPDESALRPSSSSFSAEAVSHRFWENDRIPPLETLKSINPSSDSSLEVVFVDRRSDPSLRELQNRVQDISCCCIETTDVVDQLAKLVCNCMGGSASVWEDDLFPIWRERINDLRDCLGSVVVPIGSLSTGLCRHRAVLFKVILEFYVMVKAVLADTIDLPCRIAKGCKYCSRDDASSCLVRFGLDREYMVDLIGKPGCLCKPDSLINGPSSISFSSPLRFPRHKPAEPTIDFRSLAKQYFSDCMSAELVFDSSSAEQYERQYMGRNPGPIPNDNNKSSLVPLHSQPYCSSAHDRGSETFKSGNPAQNAVEPTMTSRDSLPLKHNRPGHRDTKTRLLIPSKPTREFSLDMEDLDIPWTDLDLKGRIGS

SEQ ID NO: 131311 - protein, 127 aa, Glycine max
  Coding DNA Sequence Number=SeqID_39626
MDMENKDFLEGSSSLEAMPFPQMHKSPVQENPFSHFLGSLPPNLSPFSSFVEEIVCCICGMGSGQTNIIEGMHVKIFVMLVTPEISRELDHSCNRGEKEEDLMSIYILSILHLSLPYLSSCIEIARN

SEQ ID NO: 131312 - protein, 1658 aa, Glycine max
  Coding DNA Sequence Number=SeqID_39627
  Gene Ontology: Mol. function=4 iron, 4 sulfur cluster binding; Cellular component=nucleus; Biological process=base-excision repair
  Homolog annotation: Hit_ID=A4PF88; Match level="QueryCoverage=85%, HitCoverage=81%, E-value=0.0, Identity=38%"; Hit description =Repressor of silencing 1
  Pfam annotation: Domain name=HhH-GPD; Domain location=1225-1362; Score=47.1; E_value=6.1e-11; Accession=PF00730.16; Description=HhH -GPD superfamily base excision DNA repair protein
MEVGETERNKLQGQVPWVPTTPLMPILPKPGPIWTPMEGNHLYSHSNGLTACFEPSCCAEINNWSHPRSEPVVLAYGNAKTRVPISFDEIPSSSNGIAELLTQGDAPSAYSNATHAGFFNQFAHAFNAQFNPHPTYALLSHQYHLSREEPFVNTVHDQFQDLQGKHCIKTSSFENHLAHSQHWHFAGVNYQRCAPAEESTSYFSYCSKTFPQIAPHLDNAIAAETRQDAMTQMTIEERNREGEEKNVPAAKCNNPHSKLYDPVTEIAAVSTPHKENHNHKEISHDFDLNKTPQPKPRRRKHRPKVIKEGKSKRTSKQVNAEVLSKEKLTDKRKARRKGLNTTSTPQTEMTGEWTKPLMPESAKKTCRRSLNFDIGEPRDDNSAYGETMHFGRDTSVVIEETRAWMIAHNGHEKSAKTLSKSVAQSSPNDLNSTGSGLHIVGSKRKQSGIEQVDNSSINQIGAQYNAVQAYCQKYSVQFPNVQKKRRSEKGRISKASHKSSMTATKDVRLATCPQEDARSHSYASSLNCWASSEYNAAGVSVITDTERAIHDKPQSLEYNLSLGQRRPTKRRSRVPTRIHDCSLLTITRNSDTKLALTAKETCSSDRQTSGDAKRPQTCIDALVAEMRGSLTKKKRTRKRSIPVNSKYSCTNEMQQHHKVVLENHSISHSHNALGVACEDIWKNIHTVDTLTEQFERLNIYREAREIVLHGQNMLVPYNQQNQKNKRLVHEYGTIIPFEGPFDPIRKQRPRPKVDLDEETNRVWKLLMLDINSHGINGTDEDKAKWWEDERNVFRGRAESFIARMHLVQGDRRFSPWKGSVVDSVIGVFLTQNVSDHLSSSAFMSLAARFPLRSSSNYKTCPEESTSLVINEPQVIIVEPEENEKLDEKISDQSVCELNSMTIDIIEHSEEREVVDRNNSCRTNGGLIGVADESNSKLLESAQRHNSEHSPVESGAISAVTGEGPKNLCHGSLGKELNGVFSSQCSAITSQISGGFSIDQNPEKIGSFSDSNSEIEDLSSAAKYNSYYNRISFSELLEMASSTMLHEVNSQRSKSTENLGDTCDQSIDMKHDNLAENLEKSDVTQGSAEAPITNGYTFKITPNSGVLEVNCYDPLKIEVPSSGSSKGKDENDNRSSFPTESDCQAAIVHSQGMLSQSHPQQQSNHEQHNVFHISGQTEDPMQKARGLDFGRNESSKIDSSPVKLRSREHGKEKKNNFDWDSLRIQAEAKAGKREKTENTMDSLDWDAVRRADVSEIANAIKERGMNNMLAERIQSFLNLLVDKHGGIDLEWLRDVPPDQAKEFLLSIRGLGLKSVECVRLLTLHHLAFPVDTNVGRIAVRLGWVPLQPLPESLQLHLLELYPVLESIQKYLWPRLCKLDQRTLYELHYQLITFGKVFCTKSKPNCNACPMRGECRHFASAFASARLALPGSEQKSIVITTGNNATEQNPSLVINQLPLLLPENINQAELQQTEVIRQLEAKSEINISQPIIEEPATPEPECSQVSENDIEDTFNEESCEIPTIKLDIEEFTLNLQNYMQENMELQEGEMSKALVALHPGAACIPTPKLKNVSRLRTEHYVYELPDSHPLLNGWNKREPDDPGKYLLAIWTPGETADSIQPPESKCSSQECGRLCNENECFSCNSFREASSQIVRGTLLV

SEQ ID NO: 131313 - protein, 533 aa, Glycine max
  Coding DNA Sequence Number=SeqID_39628
  Gene Ontology: Mol. function=transferase activity, transferring glycosyl groups; Cellular component=integral to membrane; Biological process=cell wall organization and biogenesis
  Homolog annotation: Hit_ID=A7PPK8; Match level="QueryCoverage=100%, HitCoverage=100%, E-value=0.0, Identity=80%"; Hit description =Chromosome chr8 scaffold_23, whole genome shotgun sequence
  Pfam annotation: Domain name=Glycos_transf_2; Domain location=100 -275; Score=28.9; E_value=1.9e-05; Accession=PF00535.17; Description =Glycosyl transferase
MDRFSSSTILPEAFQGAKDDFTMQLALVWNQIKAPLIVPLLRITVFLCLIMSVMMFIERVYMGIVITLVKLFGRKPEKRYKWEPMKDDIELGNSSYPMVLVQVPMYNEREVYQLSIGAACGLSWPSDRIIIQVLDDSTDPTIKELVQLECQRWASKGVNIKYEVRDNRNGYKAGALKEGMKRSYVKQCDCVAIFDADFQPEPDFLWRTVPFLVHNPELALIQARWKFVNADECLMTRMQEMSLDYHFTVEQEVGSSTYAFFGFNGTAGVWRISALNEAGGWKDRTTVEDMDLAVRASLKGWKFLYLSDLKVKNELPSTFKAYRYQQHRWSCGPANLFRKMAMEIINNKKVSLWKKIHVIYSFFFVRKVVAHINTFVFYCIVLPATVLVPEVVVPKWGAVYIPSIITILNAVGTPRSLHLMVFWILFENVMSLHRTKATIIGLLEASRVNEWVVTEKLGDALKAKAGGKAPKKPRFRIGDRIHLLELGVAFYLFFCGCYDVMFGKNHFFIFLFIQSFAFLIMAFGYVGTIVPNS

SEQ ID NO: 131314 - protein, 520 aa, Glycine max
  Coding DNA Sequence Number=SeqID_39629
  Gene Ontology: Mol. function=pyruvate kinase activity; Cellular component=cytoplasm; Biological process=glycolysis
  Homolog annotation: Hit_ID=Q1SN32; Match level="QueryCoverage=100%, HitCoverage=94%, E-value=0.0, Identity=87%"; Hit description =Pyruvate kinase
  Pfam annotation: Domain name=PK; Domain location=2-372; Score=241.7; E_value=1.6e-69; Accession=PF00224.12; Description=Pyruvate kinase, barrel domain
  Pfam annotation: Domain name=PK_C; Domain location=387-517; Score =120.9; E_value=3.9e-33; Accession=PF02887.7; Description=Pyruvate kinase, alphabeta domain
  Pfam module annotation: Pfam domain module=PK::PK_C; Domain location =2-372::387-517
MTKIVGTLGPKSRSVEVISACLKAGMSVARFDFSWDDPEYHQETLENLKNAIKTTKKLCAVMLDTVGAEMQVVNKSEKAISLEADGQVVLTPDRGQEASSQILPINFDGLAKSMKKGDTIFIGQYLFTGSETTSVWLEVSEVKGQDVICTIKNSATLAGSLFTLHASQVHIDLPTLTDKDKEVISTWGVKNKIDFLSLSYTRHAEDVRQAREFLSKLGDLSQTQIFAKIENVEGLTHFDEILQEADGIILSRGNLGIDLPPEKVFFFQKSALYKCNMAGKPAVLTRVVDSMTDNLRPTRAEATDVANAVLDVKFNQPIGHRNMSNALVQCCACACMRSECAETLRGLYPVETISTVGKICAEAEKVFNQDLYFKKTVKYVGEPMTHLESIASSAVRAAIKVKASVIICFTSSGRAARLIAKYRPTMPVLSVVIPRLKTNQLKWSFSGAFEARQSLIVRGLFPMLADPRHPAESTSGTNESILKVALDHGKASGVIKSHDRVVVCQKVGDASVVKIIELED

SEQ ID NO: 131315 - protein, 721 aa, Glycine max
  Coding DNA Sequence Number=SeqID_39630
  Gene Ontology: Mol. function=catalytic activity; Cellular component =nucleus; Biological process=metabolic process
  Homolog annotation: Hit_ID=A7PPP0; Match level="QueryCoverage=98%, HitCoverage=86%, E-value=0.0, Identity=40%"; Hit description =Chromosome chr8 scaffold_23, whole genome shotgun sequence
  Pfam annotation: Domain name=PPR; Domain location=147-181; Score=4.7; E_value=2.1; Accession=PF01535.11; Description=PPR repeat
  Pfam annotation: Domain name=PPR; Domain location=209-243; Score =41.2; E_value=3.6e-09; Accession=PF01535.11; Description=PPR repeat
  Pfam annotation: Domain name=PPR; Domain location=244-278; Score=2.1; E_value=4.3; Accession=PF01535.11; Description=PPR repeat
  Pfam annotation: Domain name=PPR; Domain location=312-346; Score =24.7; E_value=0.00035; Accession=PF01535.11; Description=PPR repeat
  Pfam annotation: Domain name=PPR; Domain location=348-382; Score=0.2; E_value=7.4; Accession=PF01535.11; Description=PPR repeat
  Pfam annotation: Domain name=PPR; Domain location=414-448; Score =41.3; E_value=3.5e-09; Accession=PF01535.11; Description=PPR repeat
  Pfam annotation: Domain name=PPR; Domain location=487-521; Score=0.9; E_value=6; Accession=PF01535.11; Description=PPR repeat
  Pfam annotation: Domain name=PPR; Domain location=553-587; Score =11.7; E_value=0.32; Accession=PF01535.11; Description=PPR repeat
  Pfam annotation: Domain name=PPR; Domain location=79-113; Score=9.6; E_value=0.56; Accession=PF01535.11; Description=PPR repeat
  Pfam module annotation: Pfam domain module=PPR::PPR::PPR::PPR::PPR::PP R::PPR::PPR::PPR; Domain location=147-181::209-243::244-278::312 -346::348-382::414-448::487-521::553-587::79-113
MTTRSHLPPNEYTYVAVLTACSSLLHHFHFGLQLHAAALKTAHFDSPFVANALVSLYAKHASFHAALKLFNQIPRRDIASWNTIISAALQDSLYDTAFRLFRNMQATDAFRVDDFTLSILLTASASLMEGQQVHAHAVKLGLETDLNVGNGLIGFYSKFGNVDDVEWLFEGMRVRDVITWTEMVTAYMEFGLVNLALKVFDEMPEKNSVSYNTVLAGFCRNEQGFEAMRLFVRMVEEGLELTDFSLTSVVDACGLLGDYKVSKQVHGFAVKFGFGSNGYVEAALLDMYTRCGRMVDAGKMFLRWELEEFSSVVWTAMICGYARNGQPEEAIYLFHVGRSDGKVIMDEVAAASMLGLCGTIGHLDMGKQIHCHVIKCGLGFNLEVGNAVVSMYFKCGSVDDAMKVFGDMPCTDIVTWNTLISGNLMHRQGDRALEIWVEMLGEGIKPNQVTFVLIISAYRQTNLNLVDDCRNLFNSMRTVYQIEPTSRHYASFISVLGHWGLLQEALETINNMPFQPSALVWRVLLDGCRLHKNELIGKWAAQNILALEPKDPSTFILVSNLYSASGRWDRSEMVREDMREKGFRKHPAQSWIVCEKKINSFYPRDRSHPQEKDIQRGLEILILECLKIGYEPDTSFVLHEVEEHHKKIFLFHHSAKLAATYGILMTKPGKPIRIVKNILLCGDCHAFLKYASIVTKRDIFLRDSSGFHCFSNGQCSCKDCW

SEQ ID NO: 131316 - protein, 523 aa, Glycine max
  Coding DNA Sequence Number=SeqID_39631
  Homolog annotation: Hit_ID=A7PPP1; Match level="QueryCoverage=100%, HitCoverage=51%, E-value=1e-130, Identity=51%"; Hit description =Chromosome chr8 scaffold_23, whole genome shotgun sequence
MISLQLQQEWEIAVNHYTGVMTANWISNDLLRPFLFFITRISTKHRKVHSKRIDSMKLCFTILLESLKSSGWKGITDDNHLDADLAVKDLIQFLGGNKSGCYVSIGRYISALENHSSQSKSITQADDFFFITASAITIAVRPFYLTNYDVEVPGALDVNHAAEQFFVYLLTIPWLVQHLPPVLLPALKHKSILFPCFQTLLTLKEKVLPEMSEFVKSEILVSFKAIPPVGWALTNSICLATGNEIESFNQGLEYALYVRVVTTLPEALLACLDNIGWVKRKKKSLQTDVESSTQPVDTIQHEGEATNESLIMSYMDQFRPVCQQWHLKNLLASIDRDATNKAEAVLSNGLACLGKLELCDVALFYSNLLRIFSFLSPIRGSLSVLNMLAFTPGFLVRLWGVLEDSFFSEDKHNSDNHTSESSKHKAFEKMQKHVSKDGANKWVSVLHKFTGKSQAAMDCTDSIGSHSEPSRVNDDSSDVWDIESMRHGPQGVPKDMFAMLHLFCATYSHLLLVLDDIEFYEKQ

SEQ ID NO: 131317 - protein, 421 aa, Glycine max
  Coding DNA Sequence Number=SeqID_39632
  Gene Ontology: Mol. function=peptidyl-prolyl cis-trans isomerase activity; Biological process=protein folding
  Homolog annotation: Hit_ID=A5C0W3; Match level="QueryCoverage=94%, HitCoverage=30%, E-value=2e-66, Identity=38%"; Hit description =Peptidyl-prolyl cis-trans isomerase
MENTTSKSEVLIKPIILKAGVPLAVSFAGFIYAWFVAKKSLSKTSSLSPNEASSYEESCHSHSLSCMEDEGHSTTLDESVVAESSMINDTPCLEEEINGLRSRIEGMHMKELALRLQFDRYCDLKEQETVVGEIKNMLSLETARVGFLDREISSMETQNKRLESFVAQYLRVVEQIERWKSENRTLRRKFKRLMEKSKAQTRLAKEQALKIKLEEEEILRSRDALETKIDVVGKLEDRMEELQRALDQLQDEKNELLKKLDTAEKSYASKIEDGDVSREECKQLLDELEQVKKERADEAKELIYLRWTNACLRHGLVRHHEQQQNQDKNHLELEFGRNDVVINYDSEHELHNSLLEHHSDPSFDEHASGHDHSDIACSKRTKLLERLKRWVDGSEKPRVGHSISKGAEEHLVPRRKSCSSA

SEQ ID NO: 131318 - protein, 230 aa, Glycine max
  Coding DNA Sequence Number=SeqID_39633
  Homolog annotation: Hit_ID=A2Q4W6; Match level="QueryCoverage=33%, HitCoverage=10%, E-value=4e-08, Identity=37%"; Hit description=RNA -binding region RNP-1
  Pfam annotation: Domain name=RRM_1; Domain location=14-84; Score =21.2; E_value=0.0016; Accession=PF00076.13; Description=RNA recognition motif. (a.k.a. RRM, RB
MQQTLQFNITFTSFYFTNFTDNVNEVRLWGKFKIWGDVREVFIAKRRNKEGRRFGFVRFKDVSDVKLLETHLDNIFIDDHKLFVNLPRFTRLASNVHTHTKVDKKEKQSKEAVKDSQATNRPRVRSYVEVVAQKGGLGGTTTAVDGIPTITIVPNKGREVWCKGAWVGRLKKPMQAEKMEDYISWELGYSISARSLGDDIVLITGLSADKAQQLINSETNGGNTLFYSLE

SEQ ID NO: 131319 - protein, 148 aa, Glycine max
  Coding DNA Sequence Number=SeqID_39634
  Homolog annotation: Hit_ID=Q3EBL9; Match level="QueryCoverage=27%, HitCoverage=18%, E-value=5e-13, Identity=87%"; Hit description =Uncharacterized protein At2g36680.1
MDEIEGGERGKATTVGCLEMFFGAYVASLRCHNTTLEARLQQQSQDGSSQSQSWYPPSVVSSPTSSRPVTPTASSSSLSQRPSSHVPPSEAAAVIAVLKDKSVDELRKLLSDKDAYQQFLHSLDQEIQHPPQMKTLLTEALTKSYRHI

SEQ ID NO: 131320 - protein, 417 aa, Glycine max
  Coding DNA Sequence Number=SeqID_39635
  Homolog annotation: Hit_ID=A5B5G7; Match level="QueryCoverage=48%, HitCoverage=14%, E-value=2e-11, Identity=28%"; Hit description =Putative uncharacterized protein
MASRKRRAVPTPGEASNWDTSRFTSEIAWHRYQDNIQLRNILPERNVELGPGMFDEFLQELRRRRWDQVLTHLPEKRIDVALVKEFYSNLYDPEDHSPRFCRVRGQVVRFDADTINDFLDTPVILEDGEEYTAYTRYLSTHPDPDTIAATLCTPGGRFVLNADGLPWKLLRKDMTTLAQTWSVLSYYDLAPTSHTYDVNLDRARLIYGLVSRMDMDVGSFISQQISQIAQSSTSRLGFPALITALCDIQWVVSDTLIFESLNPAINLAYVKKNCWNPTDPSITFPGPRRTRTRASASASEAPLPTQSQSQPSQRPRHPPASTSASMDMHGQMLRSLHVGQQLIMENMHRLSLHLQMDPPLTTPEAYRQRVAWPGDQPSTDRGEEPSGAAEDPAVDEDLIADLATADWGPWADLGGGS

SEQ ID NO: 131321 - protein, 437 aa, Glycine max
  Coding DNA Sequence Number=SeqID_39636
  Gene Ontology: Mol. function=binding; Cellular component=nucleus; Biological process=chromosome segregation
  Homolog annotation: Hit_ID=A7PU08; Match level="QueryCoverage=91%, HitCoverage=35%, E-value=1e-175, Identity=78%"; Hit description =Chromosome chr7 scaffold_31, whole genome shotgun sequence
  Pfam annotation: Domain name=STAG; Domain location=148-263; Score =195.4; E_value=1.4e-55; Accession=PF08514.2; Description=Stromal antigen (SASTAG) protein
MEDPAPPSEASNRPPRKRGRPPKHLPKEHDADADRTTVQADRESSPDDFDEAPAKSKRNRASEGTSSVAHKVSDQTLIEVVKGNGKFIPQAVKFWVECYEKDPKPAMVDLLTMLFEACGAKYCDKSDLVDETDVDEVVIALVNCAKRGEVEDYQNSKKKEIKNFKENLESFWDNLVRECQHGPLFDQVLFDKCMDYIIALSCTPPRVYRQVASLMGLSLVTSYITIANMLRAQRETTQRQLEAEKKKRTEGPRVDSLKKRSSDTHDRIQLLEEMMRKIFTGLFVHRYRDIDQNIRMSCIESLGAWILSYPSLFLQDLYLKYLGWTLNDKNAGVRKASISALQNLYEVDDNVPTLGLFTERFSSRMIELADDIDVSVAVQAIGLVKQLLRHQLIPEDDLGPLYDLLIDDPPEIRHAIGALVYDHLIAQKFNSLQSGSR

SEQ ID NO: 131322 - protein, 497 aa, Glycine max
  Coding DNA Sequence Number=SeqID_39637
  Gene Ontology: Mol. function=metal ion binding; Cellular component =endoplasmic reticulum; Biological process=ubiquitin cycle
  Homolog annotation: Hit_ID=A9PCA9; Match level="QueryCoverage=80%, HitCoverage=97%, E-value=1e-158, Identity=71%"; Hit description =Putative uncharacterized protein
  Pfam annotation: Domain name=NPL4; Domain location=155-409; Score =383.5; E_value=3.5e-112; Accession=PF05021.6; Description=NPL4 family
MMLRIRSRDGLERVSVENPHSTTVSYLKRIIETQLGIPVHNQTLSTNQNLLLAKSLEDLHRFTDMSNPDAPLSSLNLGHGSMVFLAYEGERRVAGPAFNPAGSFGRKMTMDDLIAKQMRVTRQENPHCELVSFDRDCANAFQHYVNDTLAFAVKRGGFMYGTVSEEGKVEVDFIYEPPQQGSEDNLVFFRDTEEEKFVEAIAVGLGMTKVGFIFTQTITQDKKDYTLSNREVLQAVEYHAESGLKEWVTAVVKLEANEEMGGADVHFEAFQMSDVCVRLFKEGWFETEIKEDDDPKLSKMKKDVVVGVKDTREVDNDFFLVVVKIADHQGPLSSSFPIENRNTQVPMKALKNHLDRTKNLPFVKRISDFHLLLVLARVLDLNADVPALTECVQTQTSVPEGSLLWEDRSSRLLWGNLERLVVERSTGGAITRAFAQLRWAYVSARAFYEPIPAIDFIESHFRVNPSRPNQAMVYDSIAAVLIPSAANTRNPRKKKRV

SEQ ID NO: 131323 - protein, 640 aa, Glycine max
  Coding DNA Sequence Number=SeqID_39638
  Gene Ontology: Mol. function=transferase activity, transferring glycosyl groups; Cellular component=integral to membrane; Biological process=metabolic process
  Homolog annotation: Hit_ID=Q8S9A0; Match level="QueryCoverage=99%, HitCoverage=94%, E-value=0.0, Identity=72%"; Hit description =Glucosyltransferase-9
  Pfam annotation: Domain name=UDPGT; Domain location=1-469; Score= -65.3; E_value=2.6e-07; Accession=PF00201.9; Description=UDP -glucoronosyl and UDP-glucosyl transferase
  Subcellular localization annotation: CTP_CleavageSite=39; ConfidenceScore=5.12e-01
MAQGHMIPMMDIARLLARRGVIVSIFTTPKNASRFNSVLSRDVSSGLPIRLVQLHFPSKEAGLPEGCENLDMVASNDLYKIFHAIKLLHKPAEEFFEALTPKPSCIISDFCIPWTAQVAEKHHIPRISFHGFSCFCLHCLYQIHTSKVCESITSESEYFTIPGIPDKIQVTKEQLPAGLSNELKDFGEQVIDADIKSYGVIINTFEELEKAYVREYKKVRNDKVWCIGPVSLCNKDGLDKAQRGNRASINEHHCLKWLDLQQPKSVVYVCFGSLCNLIPSQLVELALAIEDSKKPFVWVIREGSKYQELEKWISEEGFEERTKGRGLIIRGWAPQVLILSHPAIGGFLTHCGWNSTLEGISVGVPMVTWPLFADQFLNEKLVTQVLKIGVSVGAEVPMNWGEEEKTGVLVKKKNIERAICMVMDNDEEESKERRERATKLCEMAKKAVEKGGSSHLDMTLLIQDIMQQSSSKEDSITSESECFVLPGIPDKIEITIAQAGQPMNESWKRLMKNLGKLKCLVTGGWNSTLEAICAGVPMLTRPLFADQFLNEILVVHVLKVGVEIPLTWDKKVEIGVQLKKEDAERAIVKLMYETSESEERRKRVKELAEMAKRAVEKAGSSHSNMTLLIEEIMQKTKRDV

SEQ ID NO: 131324 - protein, 488 aa, Glycine max
  Coding DNA Sequence Number=SeqID_39639
  Gene Ontology: Mol. function=transferase activity, transferring glycosyl groups; Cellular component=integral to membrane; Biological process=metabolic process
  Homolog annotation: Hit_ID=A6XNC1; Match level="QueryCoverage=99%, HitCoverage=97%, E-value=0.0, Identity=64%"; Hit description =(Iso)flavonoid glycosyltransferase
  Pfam annotation: Domain name=UDPGT; Domain location=9-485; Score= -93.3; E_value=6.6e-06; Accession=PF00201.9; Description=UDP -glucoronosyl and UDP-glucosyl transferase
MGPQEQQLHFVLFPLMAQGHMIPMMDIAKILVHRNVIVTVVTTPHNAARFTSIFDRYIESGFQIRLAQLQFPCKEAGVPDGCENLDTIPSLGMAAGFFNATNFLREPAEKLLEELTPPPSCIISDMCLPYTKHIARKFNIPRISFVGVSCFYLFCMSNVRIHNVIESITAESECFVVPGIPDKIEMNVAKTGMTINEGMKEFTNTMFEAETEAYGMIMNSFEELEPAYAGGYKKMRNNKVWCFGPLSFTNKDHLDKAQRGKKASIDDGHLKSWLDCQKPGSVIYACFGSICNLTPSQLIELGLALEASERPFIWVFREGSQSEALEKWVKQNGFEERISDRGLLIRGWAPQLLIISHPAIGGFITHCGWNSTLETICAGVPMVTWPLFGDQFMNESLVVEILKVGVKVGVERPITWGKEEEIGVQVKKKDIERAIESLMGETSESEERRKRIRELAEKAKRAVEEGGSSHSNVTLLIEDVMQKVKRDV

SEQ ID NO: 131325 - protein, 229 aa, Glycine max
  Coding DNA Sequence Number=SeqID_39640
  Gene Ontology: Cellular component=extracellular region; Biological process=cellulose and pectin-containing cell wall organization and biogenesis
  Homolog annotation: Hit_ID=A7QJD4; Match level="QueryCoverage=67%, HitCoverage=74%, E-value=1e-62, Identity=60%"; Hit description =Chromosome chr8 scaffold_106, whole genome shotgun sequence
  Pfam annotation: Domain name=DPBB_1; Domain location=58-137; Score =38.3; E_value=2.7e-08; Accession=PF03330.9; Description=Rare lipoprotein A (RlpA)-like double-psi be
  Pfam annotation: Domain name=Pollen_allerg_1; Domain location=148 -217; Score=68.3; E_value=2.6e-17; Accession=PF01357.12; Description =Pollen allergen
  Pfam module annotation: Pfam domain module=DPBB_1::Pollen_allerg_1; Domain location=58-137::148-217
MHQSNKSNLSKFIPELVEAGIMIIMDIMAKLMKHRGVGEAAETESIPGPEDMVATAMARVGRGVTHVPPGKGRRGACGYDDVVKDGYGLDMAALSSVLFNHGDNGGWCNPPRQHFDLAKPAYLKIAQYKAGIVPVQYRRVPCKKQGGIRFTITGNPYFNLVEVWNVGGAGDITKVQVKGDKKLLNWTNLKRNWGEKWETNAMLVGETLTFRVKASDGSFGQTFEGKNFP

SEQ ID NO: 131326 - protein, 99 aa, Glycine max
  Coding DNA Sequence Number=SeqID_39641
  Homolog annotation: Hit_ID=A7QJC9; Match level="QueryCoverage=91%, HitCoverage=47%, E-value=1e-20, Identity=58%"; Hit description =Chromosome chr8 scaffold_106, whole genome shotgun sequence
MEETSVLSNPGNDGHVLVQFYGNLPSAWIDPMTDISTFEDSFEDRSNNPSEDFQKALKQALQRKAQLSSCQKLTPDRSAHYDLQERSSVGCYKKGHDGG

SEQ ID NO: 131327 - protein, 356 aa, Glycine max
  Coding DNA Sequence Number=SeqID_39642
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A5BUZ9; Match level="QueryCoverage=98%, HitCoverage=61%, E-value=1e-132, Identity=64%"; Hit description =Putative uncharacterized protein
  Pfam annotation: Domain name=MORN; Domain location=104-126; Score =25.3; E_value=0.00022; Accession=PF02493.11; Description=MORN repeat
  Pfam annotation: Domain name=MORN; Domain location=127-149; Score =28.1; E_value=3.3e-05; Accession=PF02493.11; Description=MORN repeat
  Pfam annotation: Domain name=MORN; Domain location=150-172; Score =28.2; E_value=2.9e-05; Accession=PF02493.11; Description=MORN repeat
  Pfam annotation: Domain name=MORN; Domain location=173-195; Score =28.9; E_value=1.9e-05; Accession=PF02493.11; Description=MORN repeat
  Pfam annotation: Domain name=MORN; Domain location=196-218; Score =42.2; E_value=1.9e-09; Accession=PF02493.11; Description=MORN repeat
  Pfam annotation: Domain name=MORN; Domain location=219-240; Score =25.0; E_value=0.00028; Accession=PF02493.11; Description=MORN repeat
  Pfam annotation: Domain name=MORN; Domain location=58-80; Score=23.4; E_value=0.00083; Accession=PF02493.11; Description=MORN repeat
  Pfam annotation: Domain name=MORN; Domain location=81-103; Score =40.7; E_value=5.3e-09; Accession=PF02493.11; Description=MORN repeat
  Pfam module annotation: Pfam domain module=MORN::MORN::MORN::MORN::MOR N::MORN::MORN::MORN; Domain location=104-126::127-149::150-172::173 -195::196-218::219-240::58-80::81-103
MSGPVTIADYSNGGALSCAERTKSVDAIPELDHLSILTNGEIDGFSVGQLLLFNGESYSGSLYGNVSEGHGTYVWCDGCVYEGEWRRGMRNGYGKLRWPSGAVYEGDFSGGYIHGTGTYIRSDKLKYKGRWRLNLKHGLGFQVYPNGDTFEGSWMQGTQEGPGKYTWTNGNVYVGNMKGGIMSGKGTLTWINGDSYEGNWLNGMMHGFGVYTWSDGGCYVGTWTFGLKDGKGTFYPRGSRLPWVQEIYLSALRKRGLLPDLRKQKQVRDVKVPENHMSSHVSSDKFAKGNLLNLEESNRRNVSLERRWSLEVSIEKVIGYDSALRFAESVPESRDGEVDAMIPILERDTLKPLYLL

SEQ ID NO: 131328 - protein, 275 aa, Glycine max
  Coding DNA Sequence Number=SeqID_39643
  Homolog annotation: Hit_ID=A5C6S6; Match level="QueryCoverage=81%, HitCoverage=61%, E-value=1e-31, Identity=39%"; Hit description =Putative uncharacterized protein
MNSRHRPLHACGVSILATVDFAIGKTQHINGPIGSTLRRVAKLAKFATPFIYAMQIQWLTFLSFIDDAILAIEKITEKLFPPSARVFDKVDEIVLMIVFLPEKFDGALNKFSTIIHRVPFLDRAPTLVITSLNSLVSMLNYWGHENSRVNEKTIGVDRSCNMDSSDDINHASLENFPPMISECEHKAVHDISLSSRVKGSYKEALERGKEETPNEIMEKEFLYDLLTKMDGGGCECEGRKKNDGNNDESDDAIMKCKVGGSESVKDALLKCVNYA

SEQ ID NO: 131329 - protein, 427 aa, Glycine max
  Coding DNA Sequence Number=SeqID_39644
  Gene Ontology: Mol. function=protein phosphatase type 2A regulator activity; Cellular component=protein phosphatase type 2A complex; Biological process=signal transduction
  Homolog annotation: Hit_ID=O04376; Match level="QueryCoverage=65%, HitCoverage=55%, E-value=1e-107, Identity=68%"; Hit description =Serine/threonine protein phosphatase 2A 57 kDa regulatory subunit B' beta isoform
  Pfam annotation: Domain name=B56; Domain location=1-270; Score=496.5; E_value=3.3e-146; Accession=PF01603.11; Description=Protein phosphatase 2A regulatory B subunit (B56 family)
DPREREYLKTILHRVYGKFMVHRPFIRKGINNIFFRFIYETERHSGIGELLEILGSIINGFALPMKEEHKLFLARALLPLHKPKPVGVYHQQLSYCIAQFVEKDYKLADTVIRGLLKYWPVTNCQKEVLFLGELEEVLEATQTAEFQRCMVPLFRQVARCLNSSHFQAHLAMQVAERALFLWNNEHIVSLIAQNRTVVLPIIFEALEKNIKSHWNQAVHGLTVNVRKMFIEMDAELFEECQRQYEEREAKAKELEEQRELNWKRLADAAAQNGSAEESRVEMSKGGSLQKDVPWRASSSSAKPIPRIHHSPLLRVSRTPVSDYGISVMRHPDPIGGGLGDEATVEPAGPDCLVPGQKMPIQLLGLQVWPIHVDLKFLEPVGRELKMLGKEKMTLLEVDLDELFAFDIDEMLRRFWMTPLPVKEDKSG

SEQ ID NO: 131330 - protein, 596 aa, Glycine max
  Coding DNA Sequence Number=SeqID_39645
  Gene Ontology: Mol. function=pectate lyase activity; Cellular component=anchored to membrane; Biological process=pathogenesis
  Homolog annotation: Hit_ID=Q9SCP2; Match level="QueryCoverage=74%, HitCoverage=92%, E-value=0.0, Identity=72%"; Hit description =Probable pectate lyase 12 precursor
  Pfam annotation: Domain name=Pec_lyase_C; Domain location=152-337; Score=316.9; E_value=3.8e-92; Accession=PF00544.10; Description =Pectate lyase
MLLQTTCIFLLSVLLSSFSPLGTAMLNLTLPGAHPDPEAVAHEVHRKVNASIARREMLSVSEKDGSSCLTGNPIDDCWKCDPDWPNNRQRLADCVIGFGQYAKGGKGGEFYVVTDSSDDDPVNPKPGTLRYAVIQNEPLWIVFPSNMMIKLSQELIFNSYKTIDGRGADVHIVGGGCITLQFISNVIIHNIHIHHCHPSGNTNVRSSPEHYGFRTESDGDGISIFGSKDIWIDHCTLSRCKDGLIDAVMGSTGITISNNMLSHHNEVMLLGHSDDYLPDSGMQVTIAFNHFGEKLVQRMPRCRRGYIHVVNNDFTEWEMYAIGGSGEPTINSQGNRYMAPENPFAKEVTKRVDTQQSKWKGWNWRSEGDILLNGAFFVASGEELEVKYEKAYSVQPKSADRISFLTMSAGVLGNARDNNLGMWSRGPADDTTESGMEYTDDMSTTATMLLSSFLLLFFLSYTILRLTANNISAIQIHGQDKLIDTQATAILKIRVYLRILSLTSSREVDVDIVAKFRGNSNLHIPYFIRKNSSCSIPSPSLMRIMKLAKYRLKVQVEKDEGLSGEGQSPQVEKDKGPSGEGRRPKWRRTKPPSGEG

SEQ ID NO: 131331 - protein, 145 aa, Glycine max
  Coding DNA Sequence Number=SeqID_39646
METPFELPDDDVTVIARAAEHGITTVPYRVEEYGSNKHRITKDIESLLCPICMDETVIAVDEESQKRIRSPEAKCAAFESKEGKSEGQVAELLSQYPRRVDAFKERIAKSEHMAVEQRIAIIEQLMEAVMLWLADFERRLRPHFE

SEQ ID NO: 131332 - protein, 505 aa, Glycine max
  Coding DNA Sequence Number=SeqID_39647
  Gene Ontology: Mol. function=metal ion binding
  Homolog annotation: Hit_ID=A7QJF6; Match level="QueryCoverage=76%, HitCoverage=66%, E-value=5e-91, Identity=47%"; Hit description =Chromosome chr8 scaffold_106, whole genome shotgun sequence
  Pfam annotation: Domain name=PHD; Domain location=125-174; Score= -5.2; E_value=0.053; Accession=PF00628.20; Description=PHD-finger
  Pfam annotation: Domain name=zf-C3HC4; Domain location=126-171; Score= 25.4; E_value=0.00011; Accession=PF00097.16; Description=Zinc finger, C3HC4 type (RING finger)
  Pfam module annotation: Pfam domain module=PHD::zf-C3HC4; Domain location=125-174::126-171
MDSTLFLNPADFELPHDYDENAEANLIEIPADFGLSHDDDDDDETDDEEEDDDDDEDEEYVPAGAPPRVSHDAPRVSTSNSEVVTLIESQNKRRRTEGGEASCSFANGSLSQENEWASPDVDGLLCPICMDAWTNNGEHHICCLPCGHIYGMSCIKKWLQHRRNSNKCPQCKVKCSLKDVRKLYASQVVAVEEENQKRIRSLEAKCAALESKVSNWHKKETGWQKREAALSFQVQKLTEGSDRHKKEAGWQKKEAALNLQVQKLTERNTYLEMLLDMQSRQLMFNFELQKTFDLDGARVFDMDISNQILLIAQKRKAIGGMHLLTKMSLMSPFEMQDILLPSGTNGVKDLHISASHSSSSLALFSSLGKKLSVLSLDSGNLVVNYDLQLLGGFTFTRIVFQVPAWSCSWDLNNSHYIYAGLQNGSVLVFDMRQTAGPMKSLVGLTSNPVHTVHALAQTSSLSSGVKTILSASAVGLCQWNIDSEERDQKGLESACIGIKRDDFKV

SEQ ID NO: 131333 - protein, 155 aa, Glycine max
  Coding DNA Sequence Number=SeqID_39648
MQVGRRETSMYLERHIKMFDLLISHQTISHSNKHSKTNPPHWHFIKQDVFTWESESESAEQTLQASTMVSYKKTQKRKQTHHGNWVTKNAKGAMKRKGNIVDDAPNVEKKALPEGWCGKVVKIQLWVLVAVSVSLANLKIAIAGAYKQAPHLCWL

SEQ ID NO: 131334 - protein, 616 aa, Glycine max
  Coding DNA Sequence Number=SeqID_39649
  Gene Ontology: Mol. function=histidine-tRNA ligase activity; Cellular component=mitochondrion; Biological process=tRNA aminoacylation for protein translation
  Homolog annotation: Hit_ID=A7PT77; Match level="QueryCoverage=99%, HitCoverage=99%, E-value=1e-115, Identity=59%"; Hit description =Chromosome chr8 scaffold_29, whole genome shotgun sequence
  Pfam annotation: Domain name=HGTP_anticodon; Domain location=534-616; Score=6.2; E_value=0.011; Accession=PF03129.11; Description=Anticodon binding domain
  Pfam annotation: Domain name=tRNA-synt_2b; Domain location=100-301; Score=111.1; E_value=3.4e-30; Accession=PF00587.16; Description=tRNA synthetase class II core domain (G, H, P, S and T)
  Pfam module annotation: Pfam domain module=HGTP_anticodon::tRNA-synt _2b; Domain location=534-616::100-301
  Subcellular localization annotation: CTP_CleavageSite=75; ConfidenceScore=5.90e-01
MPATPFSCSFLTLQPRFNSYVNPIFRSLTFQLSSSPLPFNANFSSVRLHSSLSRAAETDSPTGGRSGALTPGPAVAGEVQKIDVNPPKGTRDFPPEDMRLRNWLFNHFKEVSRLYGFEEVDYPVLESEALFTRKAGEEIKDQVMPVDNGCDGCTPFVGLVFLPWRSSKVALWGLVGHEFESRNNLFAYARLYCFEDRGNRRVALRPELTPSLARLVIQKGKSVSLPIKWFTVGQCWRYERMTRGRRREHYQWNMDIIGVPGVMAEAELIASIVTLFKRIGITESDVGFKVSSRKIEKIPADEIKKELKAVGLSQEAVQELLQVLSVKSLTELEERLGSSGEAVADLKQLFSLAEKIGYSKWLQFDASVVRGLAYYTGIVFEDVGSGNHPFSSPFTFTNPNNHPPSLASSSLCSLAATVIATSSSPLYPFDQFDLANPDPNNIEKENAHKDRLRGKLRAICGGGRYDHLFSTFGADDIAACGFGFGDAVIVEGWLQLRWLSNTPLHAQDYQPGAWKMLLLKEKGLLPELNLQIDDIVCALDEDLQGCAAMVANILREKGQIVELVLESKPLKWVFKRAARLNAERLVLVGNSEWQRGVVGVKILSTAEQYEVKLDDL

SEQ ID NO: 131335 - protein, 106 aa, Glycine max
  Coding DNA Sequence Number=SeqID_39650
  Homolog annotation: Hit_ID=Q7XXN8; Match level="QueryCoverage=31%, HitCoverage=62%, E-value=2e-11, Identity=87%"; Hit description =Putative uncharacterized protein ROT4
  Pfam annotation: Domain name=DVL; Domain location=40-58; Score=34.6; E_value=3.5e-07; Accession=PF08137.3; Description=DVL family
MAVKESNTSQNIQQQQQQQQQQEACDPCKSFGQKCSHIVKKQRAKFYILRRCIAMLLVGPLEETARIVMRRKDELWVRPGAVPSCSPDPDPRAALSAPWAHSFPNP

SEQ ID NO: 131336 - protein, 58 aa, Glycine max
  Coding DNA Sequence Number=SeqID_39651
MKEVTWPVPVSTRVRKERVKRERNKNVRKLEEKEENDSFKRVRKKVAGSMGVGGCFTR

SEQ ID NO: 131337 - protein, 1385 aa, Glycine max
  Coding DNA Sequence Number=SeqID_39652
  Gene Ontology: Mol. function=carbonate dehydratase activity; Cellular component=chromatin; Biological process=one-carbon compound metabolic process
  Homolog annotation: Hit_ID=A3B7I8; Match level="QueryCoverage=60%, HitCoverage=40%, E-value=1e-130, Identity=37%"; Hit description =Putative uncharacterized protein
  Pfam annotation: Domain name=Chromo; Domain location=10-64; Score =15.4; E_value=0.0069; Accession=PF00385.15; Description='chromo' (CHRromatin Organisation MOdi
  Pfam annotation: Domain name=SNF2_N; Domain location=168-439; Score= -41.3; E_value=2.1e-06; Accession=PF00176.14; Description=SNF2 family N-terminal domain
  Pfam module annotation: Pfam domain module=Chromo::SNF2_N; Domain location=10-64::168-439
MELGVHSVSKGVKSILDSREVLLLVMQREYFVTYHGLAHAHNRWIPESKLLLEAPKLLAKFKRKLQEVSMKIISSFDAKLPGYHQVEKRLEYTPPGLGYDNATWELDDASFLTSPEGRKVIDDYESRRKRAERLSKNHFEANEERKASFSELSVLPTGDSPGFYNQHLTYVNKLRMCWHKGQSALIVDDQIDQERVMKVILFILSLNCNVRRPFLIISTSAALSVWETEFLRLAPSANLVVYKGDRDARSSIRALEFFNEHGGILFQILLSSSHIIVKDLHELRCITWEAIIIDECQQSRISGHLDDIKILKAEMRLLLVSGQIKEDQADYIKLLSLLKSGQHGSSIAQVETYFSASSTISNLKSQLEKYVVFKCKSGSTRFVEYWVPACLSHLQLEQYCSMLLSNLMLLCSGQKSDSVDALHDLIISIRKCCDHPYLLNPELQSFVTKGLPDEERLNIGIQASGKLQLLEKILLEARSRGLRDSASSLSLKKLQSTCGSGSIGDILDDVLCQRFGKDCYVRYDRGYTPKSKQAALDTFNDGESGKFVFLMENRACLSSVKLSSVDTVILFDSDLEPQNDLRGLQRMSISSQFKQITVFRLYSFFTVEEKILMLAKEGIALDSNVRLLSQSICPTLLKWGASYLFNKLDDLHASVVSTPDTVDMSLLCDTTSELSSQLVCGADDTDCHGWSFISRIQQNGGEYARDVLLPGERIMKSGGEPCGFSWSDLEGRHPKWKFLPVSSQRIRNTVKHFDYGLRESECEKYTFIEKRTASKDNVDPKRRKVSKDNADPEWSKWTMNKVDPKRRKVSNDVVDSKGREASRNIVDSKYWKTRLKSKKNTSVVNRANKSNGHPLTNETTGKIATNMQFSEKKNPPDIRNLPKPDISACLLEHEIDMKDSLALAKLYLNFDCKEEEATDVYSELWKHVKDFSNCVQNGLCVEKCNRSGASDSNMPELNDLAEEEKQKDFLGTCVSKLVKSVTNELNLQMKSPTTVVSQDLSCTHEICLSPNTPGSFPVEGDAISMESGSEDDRVNAITLITAEDSSVDHGSNDVNPVTGSLERQSPIRSTDITQSDGNVFEDPQILVNKVVAIDNGMNMSTHSAQLDSVEADAGTSASTAVPEVRRWYSVMSPVCDESTALKFPETTLPYMQPSDSNLWPLPQMAMSAIPSFPENNAASTVMPLDDIFRHSGEDHRYIHEAEVILEAPKDLNSSFVSPVIPQPFTSVPMNENATHAPHGITIPGFMNSDYSEAHSVTSEVSHLAYTDPLLGEMSIIENMNEEAFIDLLPIEMERIEKEKEEAFKIHEQKILQLQSDYEKEVEKLSVKYKMLLQNVNTEVALKRTELETQCELVLRNKVLAQVWTHNLDSCEGDVVQCSEQGTDHE

SEQ ID NO: 131338 - protein, 102 aa, Glycine max
  Coding DNA Sequence Number=SeqID_39653
  Homolog annotation: Hit_ID=A7NYD6; Match level="QueryCoverage=61%, HitCoverage=83%, E-value=4e-07, Identity=39%"; Hit description =Chromosome chr6 scaffold_3, whole genome shotgun sequence
MSSSFQDMGNICYPKVKLCMWRVLLDCIPSRANLVARGITLQLHLFPLCELQQESTEHILLHCPIAYSIWLQQWQVNTTYCLHVRSAWFCVAGQTCAELPYQ

SEQ ID NO: 131339 - protein, 127 aa, Glycine max
  Coding DNA Sequence Number=SeqID_39654
  Gene Ontology: Mol. function=sequence-specific DNA binding; Cellular component=nucleus; Biological process=regulation of transcription, DNA-dependent
  Homolog annotation: Hit_ID=A7LHG2; Match level="QueryCoverage=92%, HitCoverage=64%, E-value=4e-33, Identity=64%"; Hit description=WRKY17
  Pfam annotation: Domain name=WRKY; Domain location=1-35; Score=26.8; E_value=3.9e-07; Accession=PF03106.6; Description=WRKY DNA -binding domain
CSSAPSCPVKKKVQRSLEDPTILVTTYEGEHNHGHQRAEISLVSNQREAPPKGSSPVSSPTPTIRSAACPTVTFDLVKSGLVELESAQKSSIQQFLVQQMATSLTRDTNFTTALATAISGKILEAQW

SEQ ID NO: 131340 - protein, 97 aa, Glycine max
  Coding DNA Sequence Number=SeqID_39655
MGTSKNRNLPLEGKCGEDDEGFWGGRHGNSGGADPVMEETLEVISNKLSKVHDIWAEIGSTDVEKGEKVVIKMENIEKDVQKGRKQIEKEEESREEV

SEQ ID NO: 131341 - protein, 117 aa, Glycine max
  Coding DNA Sequence Number=SeqID_39656
  Gene Ontology: Mol. function=transcription regulator activity; Cellular component=nucleus; Biological process=regulation of transcription
  Homolog annotation: Hit_ID=A7P5W9; Match level="QueryCoverage=100%, HitCoverage=17%, E-value=3e-46, Identity=78%"; Hit description =Chromosome chr4 scaffold_6, whole genome shotgun sequence
  Pfam annotation: Domain name=WD40; Domain location=25-63; Score=39.7; E_value=1e-08; Accession=PF00400.23; Description=WD domain, G-beta repeat
MSPDGLNLASGDEDGTIMIWDLSSGCCITPLVGHTSCVWSLTFSCEGSLLASGSADCTVKFGDVTTGIKVPRNEEKSGNTNRLRSSKSLPTKSASVYSLQFSRRNLLFAAGAIAKSG

SEQ ID NO: 131342 - protein, 319 aa, Glycine max
  Coding DNA Sequence Number=SeqID_39657
  Homolog annotation: Hit_ID=A2Q234; Match level="QueryCoverage=51%, HitCoverage=81%, E-value=1e-08, Identity=27%"; Hit description=IMP dehydrogenase/GMP reductase, putative
MIRTRGLHRALRRVIGRALGTHVNGDADEAHQYRRSIAYARRQQAVAAVADNVEHVDHPADEVHEQSQEPLLMMYMLMPRVFQAGPKFITTVWVGEECPKLKLSSHGRKCWIYEYFPTIASCVAGENYLERKPRACQWKSGKALLVSMYHKRFDRLTSDAVCWIPYGDHRSLREFELISFFFGQIRWCSSIVIHRPKRVVRRLVMCRPFLHTPIAPSSSIEEIDNRWIHISEYLAPVSQICVAPGQCAADYIKWFYMISHPFMSPTQPGDPSRHPPVVHDETFIVLDPPQQLFDATAMPKSPAPAPAPDDVDMPRHAVV

SEQ ID NO: 131343 - protein, 103 aa, Glycine max
  Coding DNA Sequence Number=SeqID_39658
MSEEKNEVGGIREVFGQFVKLPAVMDCTLSEGHGVAQRPFLHLATVLCALSVWNEFLHRGVSRLSANVALSEWDPCLGLSLALSLKWNMVSQMGFGLSIIGCA

SEQ ID NO: 131344 - protein, 325 aa, Glycine max
  Coding DNA Sequence Number=SeqID_39659
MASKKKRASSSRPQESYDSSRHVELAYSHYDEFLHELEHRQWHRNLTRQMENRIDMALVKEFYSNLYDPKDRSPKKCKLRGKLIKFDATTLNNFLETLVILEVGERYPEYSHYCHTYPDHQAIAAKLCIPRQGFMLNVEGAPWKLLRKDLTTLAQTWSVLSYSNLAPTSHTSDLNVNRAQLVYRLVMKMNMDVGLSPSSPSARPLIWPTSARIVGTPMIPLSPFRGPARPGPGLQQRHPSCSSPSQIIGIFQLFHFLKPARAHVVEYSSWSLPHNLEHAPSLSAVAIHFPAKIHGAGVADTEMDADYVTNITLAQGAWDPWPTHD

SEQ ID NO: 131345 - protein, 102 aa, Glycine max
  Coding DNA Sequence Number=SeqID_39660
MGAVKVKVRCGSRWRQTRYAKSGDCVANMYEDEWMYEIMSEQADMNYENEEACGANEPHVDCSDAFNTSQVFECRDDVLRWARSVAHENGFVAVILRSDTNP

SEQ ID NO: 131346 - protein, 65 aa, Glycine max
  Coding DNA Sequence Number=SeqID_39661
MEGFIVEQLRNLYAKMLGTRIINLKGQNNSRKITENNWEVQEATTLDMGGVKTFLPRPFLVNLNT

SEQ ID NO: 131347 - protein, 60 aa, Glycine max
  Coding DNA Sequence Number=SeqID_39662
MLDYVESLLHLPVVGDLHAFQPVHVDDVVQMLVELLMVPTEASRAETAQCRGPRIISNWA

SEQ ID NO: 131348 - protein, 227 aa, Glycine max
  Coding DNA Sequence Number=SeqID_39663
  Gene Ontology: Mol. function=catalytic activity; Biological process =metabolic process
  Homolog annotation: Hit_ID=A7P647; Match level="QueryCoverage=33%, HitCoverage=20%, E-value=6e-26, Identity=78%"; Hit description =Chromosome chr4 scaffold_6, whole genome shotgun sequence
  Subcellular localization annotation: CTP_CleavageSite=77; ConfidenceScore=5.68e-01
MNSGRICGPLKTAGTQVGYRGKAFFNFRVRASFQTQSNTTVQSTNIKHLLCTQKPESKMQRFKALLPQQTRSSLRTFCSHRRAFSAQPNYSEHHDDDSQEQILVEGRAKSRAAILNRPSSLNSLNASMVARLKRLYDSWEENSDIGFVLMKGSGRAFCSGADVVRLYQSLNEGSSLCEGMGEGCCTQPYPCICKEAVSGFEPMTNKSPRHNFTAAPGLALFYKLTYA

SEQ ID NO: 131349 - protein, 104 aa, Glycine max
  Coding DNA Sequence Number=SeqID_39664
  Homolog annotation: Hit_ID=Q6L4N7; Match level="QueryCoverage=64%, HitCoverage=9%, E-value=1e-08, Identity=44%"; Hit description =Putative uncharacterized protein P0473H02.5
MWSSVLKVLSMVDEDGRGPSQAAVDVVKARLGTMRESGWNNFFADVQGFCVAKSIPVPNMDDEIPVRGRLRAEGRTITNLHHYRAKIFNVAIDKNMCGDGSPLY

SEQ ID NO: 131350 - protein, 264 aa, Glycine max
  Coding DNA Sequence Number=SeqID_39665
  Gene Ontology: Mol. function=transcription regulator activity; Cellular component=nucleus; Biological process=regulation of transcription
  Homolog annotation: Hit_ID=A7PGU7; Match level="QueryCoverage=90%, HitCoverage=93%, E-value=2e-55, Identity=54%"; Hit description =Chromosome chr17 scaffold_16, whole genome shotgun sequence
  Pfam annotation: Domain name=HLH; Domain location=160-210; Score =23.3; E_value=0.00051; Accession=PF00010.17; Description=Helix-loop -helix DNA-binding domain
MAEFTENLQRIGPSSFPFLDIDPSMELLNQFIGMNQLYVLDNSNLMPYFSFDTFLLGPQEPEFPGNLEEDFPFLFNHVNHNNALPISLPIFQAENEIHEGKKRKSMDLPETSSVNSTPKVSESGNKFKHSSGRGKRVKNNVTEEEKAKEVVNVRARSGQATDSRNLAERVRRGKINEKLRYLQNIVPGCYKTMGMAVMLDEIINYVQSLQNQVEFLSLKLTAPSTFYDFNSEIDALETMQRARASEAKELGMYKREGYGGVSFF

SEQ ID NO: 131351 - protein, 523 aa, Glycine max
  Coding DNA Sequence Number=SeqID_39666
  Gene Ontology: Mol. function=5-formyltetrahydrofolate transporter activity; Cellular component=membrane
  Homolog annotation: Hit_ID=Q9LEV7; Match level="QueryCoverage=87%, HitCoverage=90%, E-value=1e-167, Identity=59%"; Hit description =Putative uncharacterized protein T30N20_90
  Pfam annotation: Domain name=BT1; Domain location=83-497; Score =345.5; E_value=9.1e-101; Accession=PF03092.7; Description=BT1 family
  Pfam annotation: Domain name=DUF81; Domain location=142-374; Score= -68.2; E_value=0.039; Accession=PF01925.10; Description=Domain of unknown function DUF81
  Pfam annotation: Domain name=MFS_1; Domain location=76-442; Score =21.8; E_value=0.0025; Accession=PF07690.7; Description=Major Facilitator Superfamily
  Pfam module annotation: Pfam domain module=BT1::DUF81::MFS_1; Domain location=83-497::142-374::76-442
MTNIFLHTVKVNPNLPSQNPVPSHPHETDTMGENENATVTTKKKTSKTLLTLLTEPFQWIQKLSSQLNPTFVIGVFLIYGIGQGFSGSLFKVVADYYWKDVQKIQPFTVQLYVGFYFIPWVLKPLWGILTDAFPVRGYRRRPYFIISGVIGAVSAAVIAFAGNLAAVAALMCFVGVSASLAIADVTIDACIARNSIEVRELAPDLQSLCGFCSGAGALVGYLASGFFVHRLGPQESLGLMALSPALTIVLGFVIYENRTSGSHIEKKQAVESVGMKIRSMYQTMLYPHVWKPSLYMFLALALNVTTHEGHFYWYTDPKAGPAFSQEFVGVIYAIGAVASLIGVLIYHKALKDYPFRDLVFYAQLLYGISGVLDLIFILRWNLVIGIPDYFFVVIEESATRITSKIRWMPMMVLSTQLCPLGIEGTFFALLMCIDSIGALLSRWGGGVLLRVLHITRTDFTNLWLAVLIRDMLRFATLALVFLVPKTDQYEELLPFEVSGKNTSDKVDEEETLELVPINGKTEV

SEQ ID NO: 131352 - protein, 199 aa, Glycine max
  Coding DNA Sequence Number=SeqID_39667
  Subcellular localization annotation: CTP_CleavageSite=43; ConfidenceScore=5.13e-01
MQMADRGRGGGRRTFNRGRRCGFSLGAPITTNPSSSSIHISTSESMIHVVAQTPNTLPTSQDQPNPTFVRESIPTTPVRDASPSAPDDSLTPEYPLDPNCEHIVDQRPFIRAYKGEFQPTYGCSNFISNIIREKFDELAASWLKVSVDLRDRWFGEFKKEYRWHPQEKRAIRAVFETKGSRILKSAMNKSKMVKINENG

SEQ ID NO: 131353 - protein, 371 aa, Glycine max
  Coding DNA Sequence Number=SeqID_39668
MALAGLAGLSSVEKSAHNGVDQPSYLLRGFMFLWRLLIASWLIYLVASNPCLGGFVKGSLMDSSKLKASSRIVVRLAIRVSLGASFSLVELLFGLSKFVPEYGHFFHLDVALVLFMQLVHSTRDLDNNVCKPIHEFVEKFIICLSQTAIDGPWRKSTVLSQCHTFEGHWEDTPQDCIVIGVQVCLGYVSFHDVVDEGVSMSSPPCRTVDVGETWIILIVDYAWAFNFLRSSLWRRSISTMRFSRCWRVLVSVMVVGGGLELSKKVSRLRLDQVLTMGERERGNMILRGMFYHDPTVDAKCTYQNPKLAHVRVDVAKEAEGGTCKAKGSDTQGVQGNLVLIGVSGSCEYLFIGVVTAFVDNYQLVDTVRDNA

SEQ ID NO: 131354 - protein, 433 aa, Glycine max
  Coding DNA Sequence Number=SeqID_39669
  Gene Ontology: Mol. function=protein serine/threonine kinase activity; Cellular component=plasma membrane; Biological process =protein amino acid phosphorylation
  Homolog annotation: Hit_ID=Q6UY57; Match level="QueryCoverage=34%, HitCoverage=26%, E-value=8e-51, Identity=60%"; Hit description =Lectin-like receptor kinase 1;1
  Pfam annotation: Domain name=Pkinase; Domain location=168-402; Score=- 77.7; E_value=0.00059; Accession=PF00069.16; Description=Protein kinase domain
  Pfam annotation: Domain name=Pkinase_Tyr; Domain location=135-402; Score=-148.6; E_value=0.0026; Accession=PF07714.8; Description =Protein tyrosine kinase
  Pfam module annotation: Pfam domain module=Pkinase::Pkinase_Tyr; Domain location=168-402::135-402
MIAETKPFGSDGNGEEEEKEGVVEICVPDHGSTHNKKGEADVGGKDAVAGGLCVGPVTGGWEEWEVVMGREGGVVSAVGGGGVVSAGGGGLAEEEDRLVTLGSRGGMGGDFIEAKDGKGCLGTMVFNIQRMASSLEAMEVWAAASLAMAASRRSMQAAESSVSTIEEWQALRAKVLKHLDGAWKEDENSGLSLLKCLVQDEKNEVEYDRQGIRQYNMQQVHLVEVTANRGDHSNMSSEEIKEYREHLRQLESTSEEQSDNSSKGTYKVALSVALALRYLHEDAEQSVLHRDIKLANVLLDTDFSTKLGDFEMAKLVDPRLRTQRTGVVGIYRRTYKDGEFLVPLVNWMWQLYVEGKVLDAADEKLNKEFEVDEMTSLIIVGLWCTNPKNKERPTAVQVTKVLRLKAAFPMLPLESVIESSSFSKYVYACIIHL

SEQ ID NO: 131355 - protein, 312 aa, Glycine max
  Coding DNA Sequence Number=SeqID_39670
  Gene Ontology: Mol. function=protein serine/threonine kinase activity; Biological process=protein amino acid phosphorylation
  Homolog annotation: Hit_ID=Q6UY57; Match level="QueryCoverage=31%, HitCoverage=20%, E-value=3e-13, Identity=34%"; Hit description =Lectin-like receptor kinase 1;1
  Pfam annotation: Domain name=Lectin_legB; Domain location=84-280; Score=-90.7; E_value=0.00031; Accession=PF00139.10; Description =Legume lectin domain
LPVVRLNAFNLAQGYPEREGDNVARNHGMQVQEKRESRGLRSQPSGHRARRIQWAYATRGGRRESSRPPNCCRDDGGGEGNEHAYDVFIALKDEEEEQNFVALEEVIGLGGKVVELEGLREGEVAAQRCRDLWDGSVGEHHHRNPRIAGSVGCDVREGRGQGSVNATVYSSTTFLRDRDSAKIRSDGSTLGLYSDTQNNIVAVEFDTFVNDNDPPMLHVGIKNNSLASINYSRFGIERNLGKMEHIVLGEILLELISTVEFSGATGSSSEENVIHSWEFALTLNSMSLELFYFFGARGYWCFPVDLHQEKKK

SEQ ID NO: 131356 - protein, 224 aa, Glycine max
  Coding DNA Sequence Number=SeqID_39671
  Homolog annotation: Hit_ID=Q9LJA5; Match level="QueryCoverage=46%, HitCoverage=34%, E-value=1e-10, Identity=38%"; Hit description =Arabidopsis thaliana genomic DNA, chromosome 3, P1 clone: MTO24
  Pfam annotation: Domain name=Transposase_24; Domain location=10-157; Score=-25.2; E_value=0.092; Accession=PF03004.5; Description=Plant transposase (PttaEnSpm family)
MFGNSIRAIRGKNWRNLRELLEMLLSLAKDTRNKEIRSKQVIPHTGGSKANPRRRNELFLETGKLPSRGQLYIETHKRKDGSFVNEAAKTIAEQIEVGLTQRIVDEFEVSPLDVVGRVLGLEHSGRVRCMRLGVVPFNTFRNTRLRAFSLSSSSSGVAFPSSNQWQEKYNNLESAFKAYMIMKEGRIPKELACYFTPDQTHPNDASSVPNTPLDARGSSGASNP

SEQ ID NO: 131357 - protein, 279 aa, Glycine max
  Coding DNA Sequence Number=SeqID_39672
MQAYTETSGNLKGLPQGIIQATSDLELRHLWSPSNLRSKGRVYSNNNLLAVEVCYEQRIEFLGFECRDNIHTPSFTHNPSNEQEVLGAENRTWIPNESRCRNEFLKIVAEIEPFGNDKNDEDDEEEGVVEICVPDCGSTYNGKGEADVGGKDVAAGGSMRDWGSEKGARCLALTGRWEVAMGRGGNMVSAVGGGFAEEEDGKSWLVTLGSRGSMVLAGGGDFAEEEDGEGCLGTMVFNFRRMTSSLESMEAWAATSLAMAASRRSMQAVKSSASTIEER

SEQ ID NO: 131358 - protein, 136 aa, Glycine max
  Coding DNA Sequence Number=SeqID_39673
MAFSNGALMLTNMDGEKLPSPVNSDDIKAQRALPLCFIGLNVLAFTFHWTQHPPSLCFIGLNARLTGAFSKGGKCVESPPTFICGKRQKNRRKPVKKNIPSSGVVFTFEEGISTSHVDKSGALAPTYPPSKRKSNL

SEQ ID NO: 131359 - protein, 116 aa, Glycine max
  Coding DNA Sequence Number=SeqID_39674
MDATNAKDVWSTLLEEFKGSDKEEFEVGLSQSRFDVAPSVGESQLTPLDPAKEQRLRTQCWVTAAGPKRKGRLYGTGDLAHTYKYTQGSSSHAQDSAEINQLREELRRSKEDIRVF

SEQ ID NO: 131360 - protein, 323 aa, Glycine max
  Coding DNA Sequence Number=SeqID_39675
  Homolog annotation: Hit_ID=Q2HW90; Match level="QueryCoverage=68%, HitCoverage=45%, E-value=2e-23, Identity=32%"; Hit description =Putative uncharacterized protein
MDQLQRQAFHKTYGKIWDLAMIEVSVEAIASLVQYYDQLLRCFTFGDFQLVPTVEEYEGILGCLLGGRRSYLFSGLYPSMARIAKVVKVLTQELDQVKQNNNGVIGIPRKHLEEKAKALADQGKWASIIDVLALLVFGAILFPNMDGLVDLAPIDVFLAYHHSKESLVVAMLVDAYDTFDRRCEKSEARIVCCTPALYVWLDKELRGSSNGIIGGYHKWLKARTQEITWLPKLGVSNEEEAKVPEESKEVQALKVELERTQIVKEKFKTTTIRVRKECDELRDVNTATAATLEPETSFEGLYGAATSNSSSKGLKGTSRESNV

SEQ ID NO: 131361 - protein, 219 aa, Glycine max
  Coding DNA Sequence Number=SeqID_39676
MAGRRVRIMCTSMTTLTQIWMTLLLKNIFPSSHNSDLPLQKCQLVYTILTQFAGITPPRHPVDPGKSNRTLEFPTLITGLCQFYGVSVTPTKLIRPPISAAAARGGPAAASHRCTIAPSRGDTVPGVHLRSPAEAIAPDAANHRGQVQLNETFYRYTMHQQSQDTSPFPWPTAEQFKATVAWPGDALDFETRVGPAEVPGDDDGAQEDDDMADVLDFFT

SEQ ID NO: 131362 - protein, 67 aa, Glycine max
  Coding DNA Sequence Number=SeqID_39677
  Gene Ontology: Mol. function=sequence-specific DNA binding; Cellular component=nucleus; Biological process=regulation of transcription, DNA-dependent
  Homolog annotation: Hit_ID=A7P4P4; Match level="QueryCoverage=76%, HitCoverage=30%, E-value=1e-19, Identity=80%"; Hit description =Chromosome chr4 scaffold_6, whole genome shotgun sequence
  Pfam annotation: Domain name=WRKY; Domain location=7-54; Score=60.4; E_value=6.1e-15; Accession=PF03106.6; Description=WRKY DNA -binding domain
MSEIEVLDDGYRWRKYGKKMVKKCPNPRNNYRCSVDGCTVKKRVERDKDDPRDKGSKLLRKYRKSKL

SEQ ID NO: 131363 - protein, 230 aa, Glycine max
  Coding DNA Sequence Number=SeqID_39678
MEASTISRSLNPFLNPSTTKLKESGADLECGLGEMRGLARAQVARGSGFEAVGVGVRVGGVGFRGVIGGATEAVVVSGGGGENERESEEAAQLKVEEGMWYGMEIRESWFDFILSFSLRVLLLKLGEKGKEVFAERAIATLGKLEAWILGFATIRANCNDEGLQCKVGVEMLKVFIVIGDGGEFYHELIDHGYPDGNEKALWTEALLVGSGTSTGTVDWLLEELLKDKLQ

SEQ ID NO: 131364 - protein, 309 aa, Glycine max
  Coding DNA Sequence Number=SeqID_39679
  Gene Ontology: Mol. function=catalytic activity; Cellular component =cytosol; Biological process=spermidine biosynthetic process
  Homolog annotation: Hit_ID=A7P4S1; Match level="QueryCoverage=89%, HitCoverage=82%, E-value=1e-132, Identity=80%"; Hit description =Chromosome chr4 scaffold_6, whole genome shotgun sequence
  Pfam annotation: Domain name=Spermine_synth; Domain location=9-246; Score=206.0; E_value=8.8e-59; Accession=PF01564.8; Description =Sperminespermidine synthase
MSMIRTMILLGTRKSSMMISNGLLNSTAISEYQDIALLDTKRFGKALVLDGKMQSAETDEFVYHECLIHPPLLCHPNPKTVFIMGGGEGSAAREALKHRSMDRVIMCDIDKEVVNFCRKYLIVNKEAFSHKKLDLVINDAKAELEKRKEKFDIIVGDLADPLEDGPCYQLYTKSFYEKILKPKLNDNGIFVTQAGPAGIFTHKEVFTSIYNTIKQVFKYVIAYTTHVPSFADTWGWVMASDQPLSICANEMDRRIEARIDGELLYLNGAWFHSSTTMNKTVYQSLQNETHVYTEESARFIPGHGMAFHL

SEQ ID NO: 131365 - protein, 149 aa, Glycine max
  Coding DNA Sequence Number=SeqID_39680
  Gene Ontology: Mol. function=aspartic-type endopeptidase activity; Cellular component=small subunit processome; Biological process=DNA integration
  Homolog annotation: Hit_ID=A5CB76; Match level="QueryCoverage=92%, HitCoverage=49%, E-value=3e-29, Identity=43%"; Hit description =Putative uncharacterized protein
MTSPGPVFSFSRTPTITTAKLKWKNYPSWSASVELWFLSQGHHDHLDKASDSVSSDKRVEWEKLDYQLCAVLWQSVEPDILDILRSFKTCRSFWKKAQEIFANDIQSLFDATMKVTTLKQTSHDMIAHVGKARAAVEELRKFLVADSLE

SEQ ID NO: 131366 - protein, 70 aa, Glycine max
  Coding DNA Sequence Number=SeqID_39681
MVMVVSVVMTTLVSMVRVVMTMIIVSIGGSGISCGGDNDSGSSSTSGDGGDNANGNGDGGCGCTSGGDGG

SEQ ID NO: 131367 - protein, 64 aa, Glycine max
  Coding DNA Sequence Number=SeqID_39682
MKRVGKDRSWEREGEEERVRKENNWGREKRKGVPGKRGKSMGEREGFLLSAVRFNLLCEKYVTY

SEQ ID NO: 131368 - protein, 85 aa, Glycine max
  Coding DNA Sequence Number=SeqID_39683
MVGCPTSNMESDSIDVFERAYILDDRVIGVSECVTGMHVIIADNHGIVANDHDAIALTIFNLDLNGVLFGSERKRGYQRQHVAGK

SEQ ID NO: 131369 - protein, 133 aa, Glycine max
  Coding DNA Sequence Number=SeqID_39684
  Gene Ontology: Mol. function=binding; Cellular component=protein complex; Biological process=protein catabolic process
  Homolog annotation: Hit_ID=A7PJ89; Match level="QueryCoverage=81%, HitCoverage=44%, E-value=1e-37, Identity=70%"; Hit description =Chromosome chr12 scaffold_18, whole genome shotgun sequence
MLHACLDIKAIMLGKYHYVLYFLILAMQPRMLWIVDENIKPLSLCVCVGQAVNVVGQAGHPKTITGFQTHYTPVLLSAGDKAKLATEKYLPLSPILEGFVNLKENPDYTKYLPLSPILEGFVNLKENPDYTKE

SEQ ID NO: 131370 - protein, 300 aa, Glycine max
  Coding DNA Sequence Number=SeqID_39685
  Subcellular localization annotation: CTP_CleavageSite=77; ConfidenceScore=5.41e-01
VATLWHHQNIQLDPLSTPRSHWRGRNFQMISLCKTRNALNALMFAWNRRARTKKKSPSDTMRKLRVAHNRSSSSSSSAELVSSFFEDEPSSSCYNICKNSFRFLVRISFDFDLAKNAARCDFWFKNTEVSGSAALRNSGWDWNQSFTCSGSALDESNCVHHFTNALDGSGLIEVIWVYDPSKLVFWVDDPAWVGDPEEVDDFLVVGSGRASLDPLPVLHPPLREIPDALGGITTFLDEAGCYTSGRGRTTTTLAGLFDWTTELRAGQGFAPFVCPTLEQFRAEVAWPEDWPDAQTGEEPA

SEQ ID NO: 131371 - protein, 108 aa, Glycine max
  Coding DNA Sequence Number=SeqID_39686
GYTPSPWVLATLTVERPTRPRLERTTRPHIRGLHALTSRGLHVLALRGLHALTLGLHVLALRGLHALTLGTSYPHVERTTRPRLERTTRPHHQRAASPSPLEDYMSSP

SEQ ID NO: 131372 - protein, 53 aa, Glycine max
  Coding DNA Sequence Number=SeqID_39687
MYPCQKWHGNSSQMNEMAPRKLSAKRSRKDAAAEGTSAAPEFDSHRFRSAEHQ

SEQ ID NO: 131373 - protein, 137 aa, Glycine max
  Coding DNA Sequence Number=SeqID_39688
  Subcellular localization annotation: CTP_CleavageSite=54; ConfidenceScore=5.40e-01
GPFNQQGQWRSHPGNQFNKDQGGPSNRPIQQRPNIFQRTTKLEETLTQFMQVTMSNHKSTESALKNLEVQVGQLPKQIADKSSNSFVANTEKNPKEECKAVMIRSKRFVEVEDEDSVVSKKKAAKKKGTDKNKDDAR

SEQ ID NO: 131374 - protein, 91 aa, Glycine max
  Coding DNA Sequence Number=SeqID_39689
  Gene Ontology: Mol. function=aspartic-type endopeptidase activity; Biological process=RNA-dependent DNA replication
  Homolog annotation: Hit_ID=Q6WAY3; Match level="QueryCoverage=100%, HitCoverage=6%, E-value=8e-16, Identity=39%"; Hit description =Gag/pol polyprotein
MGCMLGQHDESGKREHAVYYLSKKFTACVPPSKTIHVEPYHLADIQDGPGQAIKGSALADYLAQQPLNDYQPMHLEFLNEDIMALFEKKAR

SEQ ID NO: 131375 - protein, 76 aa, Glycine max
  Coding DNA Sequence Number=SeqID_39690
MGWIMDILTELRHMKDIVKITKRRRYGFSGFQSSTNPSPRSDSQEYMITNLEFQIFPPLIKITFLPALSSPHPFLD

SEQ ID NO: 131376 - protein, 94 aa, Glycine max
  Coding DNA Sequence Number=SeqID_39691
MTRGNPGDLQPFDPEIDRTFHRLVRHSVHPDHSVHFEHSEYSVASDSEYFDFEHSTTNFHTENMAQPPPHERNLREMVAPDFTYESLCIQYPDE

SEQ ID NO: 131377 - protein, 104 aa, Glycine max
  Coding DNA Sequence Number=SeqID_39692
MVAWPGTQPSLHREGEGPTAQVRQVAAATPERSIEATSKPLAPVVDLPSSQHTTDPSTPILEIPEDPTTPVLTMDTSPPATPVLHLTDEEDVQTQDTQDQSQEF

SEQ ID NO: 131378 - protein, 161 aa, Glycine max
  Coding DNA Sequence Number=SeqID_39693
MCSVQDSLDEQASQGSFVPHGRWDILTAAIGRPEHPGRVRAVGVGVTIKQYFGSASRTSRSSSSMPPEDLEQLTQQIRDQLEESITEKVTRKMMASFSQMQSQFQSQMQSHGLALPPEPEVGPSGPRVSTKESCVAPSWNDPWTGDSDKCGLYIEENPSRL

SEQ ID NO: 131379 - protein, 173 aa, Glycine max
  Coding DNA Sequence Number=SeqID_39694
  Gene Ontology: Mol. function=protein transporter activity; Cellular component=membrane; Biological process=protein secretion
  Homolog annotation: Hit_ID=A4W7E7; Match level="QueryCoverage=100%, HitCoverage=64%, E-value=1e-51, Identity=71%"; Hit description =Efflux transporter, RND family, MFP subunit precursor
DYDTALADAQQANAAVVAAKAAVETARINLAYTKVTSPISGRIGKSSVTEGALEGTLEFSDVTVDQTTGSITLRAIFPNPDKNLLPEGVTRTPRGDASALVVGADDKVEMRNITATQAIGDKWLVTEGLKDGDRVIVTGLQKVRPGAQVKAQEVKSDDKQSASAADQSEQTKS

SEQ ID NO: 131380 - protein, 61 aa, Glycine max
  Coding DNA Sequence Number=SeqID_39695
MMLYWHRVTGCTICAEAHETGQCVPIEENTQEVHYMGNQQRQGYTQGGFSGFQQGPYNQQG

SEQ ID NO: 131381 - protein, 63 aa, Glycine max
  Coding DNA Sequence Number=SeqID_39696
GGRGGEGGGGGGGGGEGGGGGGGGVEAEIHMYMASLGLHPADVCRQFHHPPPLPSLPSHVYCC

SEQ ID NO: 131382 - protein, 149 aa, Glycine max
  Coding DNA Sequence Number=SeqID_39697
MIMRGEDIYSSQDEATTSPFSSELEEAKGEESSEEIYPQEEGQPLIVKEECKEVSVSSKRLAKKESHFTIKTNTKETSPLRQPPHFLLCKKTLVSIATPLGLEVIPQVKELLDEGVEGRSPEYEEPRDLRSNPFQGDGDDAILPPKGIG

SEQ ID NO: 131383 - protein, 324 aa, Glycine max
  Coding DNA Sequence Number=SeqID_39698
  Homolog annotation: Hit_ID=Q6WAY4; Match level="QueryCoverage=26%, HitCoverage=19%, E-value=9e-09, Identity=34%"; Hit description =Putative uncharacterized protein
AIDAFLAYHHSKESLVVAILTDLFDTFDRSAINWFPRWKEGKEGVLFSCGDYPNVPLLGTRGCINYNPALAIRQLGYPMRDLGAQSLKVIQRVHKAWRSSLRKDKELRGIRNGVIGGYHGWLRVHTRGLDCLSKLKVIDEENFEAPEEDEEEKFKSAATHIRKECTKLQEENAAIARALEQETKRARKEEHGQEKFRGALWGSNNELKLRREERDRSRVHGMILKEELAACTRSKRSLAQHLEATEQSMLAIIGQYKEELNQSVTHEQKLAEDFAQVYAEKEARGRVIDALHQEATMWMDRFALTLNGSQDLPRLLAKAKAMAE

SEQ ID NO: 131384 - protein, 70 aa, Glycine max
  Coding DNA Sequence Number=SeqID_39699
MARSVSASCPYSRDLYGRELTRLLVIIPKVVISHLMVSRGIIPFKEHIATVGTTSNNMSSKRKTLDEGSL

SEQ ID NO: 131385 - protein, 172 aa, Glycine max
  Coding DNA Sequence Number=SeqID_39700
GYIYLGILSRKEAEVPKESEEVKALKAELEKTRVVKEKLKMTVTRVRKECDVLRDVKMTMVKALERATKRARKEEWSRNKFRGALWGSSNELKLRRAERDESRLESMVLEDKLKACQRAKRSKGWRMNEHAKVSTLQMEGEAKERVIESLHREAMKWMDRFALTLNGNQELP

SEQ ID NO: 131386 - protein, 73 aa, Glycine max
  Coding DNA Sequence Number=SeqID_39701
MSRNLTDYATVPSLASGMLRNFTDCTLTLPFDSRHVAELHGLPNDGCQAKVASHQTDGPRTKLGYDRIVSRNS

SEQ ID NO: 131387 - protein, 152 aa, Glycine max
  Coding DNA Sequence Number=SeqID_39702
  Gene Ontology: Mol. function=helicase activity
  Homolog annotation: Hit_ID=Q9C925; Match level="QueryCoverage=48%, HitCoverage=7%, E-value=8e-13, Identity=50%"; Hit description =Putative uncharacterized protein F14G24.23
MHTIEFQKRGFPHVHLLLFLHPDNKYPSSDDIDHIISAEIPSHENDPELYTLVQNHMKGYDRVTAVVIHDANGTLENAINQNDEIKEYVDCRYISPCEATWRIFGFPIHARKPVVERLHFHLPGQHSVLYEDDDDIDDILSKPSISDSKFLA

SEQ ID NO: 131388 - protein, 320 aa, Glycine max
  Coding DNA Sequence Number=SeqID_39703
  Gene Ontology: Cellular component=extracellular region; Biological process=lipoprotein metabolic process
  Homolog annotation: Hit_ID=A0A8Y3; Match level="QueryCoverage=80%, HitCoverage=68%, E-value=1e-12, Identity=26%"; Hit description =Putative uncharacterized protein
MIHVVAQTPNTLPTTEDQPNPTFVRESIPTTPVRDASPSAPDDSLTPEYPTNPNYEHIVNERPFIRAYKGEFQPTYGCCNIISNIIKAKFDELAPSWLNVSVDLRDRWFGEFKKEYRWHPQEERAIRAVFETKATLDEHWGSTDFLNNSSTAKANRSIDRGASAYYGGSISTATHFEKLEKYQHYRDEILQRSTEEGTSTQGSPNTTTFVNDNEIYLNVVGGPNYKGNVYGLGTLSKRFSCSKSAPSTSIAPVEDQIEEMRETINKLNAEFLAKANKEKTLEEKDPIIPAPSLSPTIADGTDHHVNDTQVDRPYDMENDH

SEQ ID NO: 131389 - protein, 88 aa, Glycine max
  Coding DNA Sequence Number=SeqID_39704
MDHAEPSIDQYIEQQGVIETECMKENPNPEAQKFFDMLATAQTPFDRYLTVNRRGIEKKFPIKKMWYFPLIPRLKRLYSSMATASHMR

SEQ ID NO: 131390 - protein, 202 aa, Glycine max
  Coding DNA Sequence Number=SeqID_39705
MNSLGEHAALSEFISSHCIEAFSEELAKRAYRAKRVHPLRMNTHPLAELPLVPLSVAFKELSAYPCEKKVEIYHSELDEFKAELERRNFHKHLTNLVDGGIDLALVKEFYANLYSSEDHPPKQSRVRGHLVKIDADSLNIFLETPVVLAEGETLPAYTRYCRLPPDYREIEAALCIPSQGFILNSKGHPGKILRKDLTTLAQ

SEQ ID NO: 131391 - protein, 128 aa, Glycine max
  Coding DNA Sequence Number=SeqID_39706
  Subcellular localization annotation: CTP_CleavageSite=41; ConfidenceScore=5.22e-01
MAETSKKRKGSSSTTTIAGQRHHGTSGDPPAPPNPYFSSPRSLNLFSLDEQRQRYYSLFLNRVILDHKYLDIEFFDGETFDCYQGVPFESTLVDDWKHIYSSHDARKMVCNDHADMTDRLLAGSFTFE

SEQ ID NO: 131392 - protein, 197 aa, Glycine max
  Coding DNA Sequence Number=SeqID_39707
MASMMEAMLGMRKLMEKNVATAAAVSSAAKAATVNHPPPNTLGRGRNTLGHNNNPHLGYNRAAYPYGLPPNYTPPVMQDDACHISSPVLERKPPRQPDEVHEDHQEYAQGDVEFYPPIPVEGPTPNTLPQPNLTAQPIILSTEGVPSATEERRKLDLLEERLRAVEGFGDYPSADMTDLCLVPDVVIPPKFKVPDFD

SEQ ID NO: 131393 - protein, 289 aa, Glycine max
  Coding DNA Sequence Number=SeqID_39708
  Gene Ontology: Mol. function=sequence-specific DNA binding; Cellular component=intracellular; Biological process=regulation of transcription, DNA-dependent
  Homolog annotation: Hit_ID=A4W569; Match level="QueryCoverage=100%, HitCoverage=96%, E-value=1e-136, Identity=83%"; Hit description =Transcriptional regulator, AraC family with amidase-like domain
  Pfam annotation: Domain name=DJ-1_PfpI; Domain location=16-161; Score= 1.7; E_value=0.0023; Accession=PF01965.15; Description=DJ-1PfpI family
  Pfam annotation: Domain name=HTH_AraC; Domain location=202-248; Score= 33.0; E_value=1.1e-06; Accession=PF00165.14; Description=Bacterial regulatory helix-turn-helix proteins, araC family
  Pfam module annotation: Pfam domain module=DJ-1_PfpI::HTH_AraC; Domain location=16-161::202-248
MTGPAETFVLAGDAFRLHYIGPQPEVQTSIGLAMSGIQPLPEWLPAGSLLVLPGVSDSRTQFSTPQALQIQHWLMRLQPAIQRRDITVMCVCSGALLAAKSGLLNHRQCTTHHDVISRLRTAAPSAVIKENRIFVQDENIWTSAGITSGIDLALHMINRLCGPEKALAVAREMVVWFRRSGDDPQLSPWLRYRNHLHPAIHRAQDALTAEPQKAWSVPDIAALAHVSPRHLTRLFQTHLGISVRDYLEQLRLAVAEQWLLQGRGVEQASLAAGFSSPRQFHRARLRTVN

SEQ ID NO: 131394 - protein, 123 aa, Glycine max
  Coding DNA Sequence Number=SeqID_39709
PPGAERPVVHVDPGTGKADGPHKKKLRTYSGIVARDKAEFEIPEASDSRTKKKLLQTDGVDDTVCEKYDISKEKWAQFCQTRRDPSWEDVWKKAQAIQKQNTAPHVLSRGGYEYLEQKLLAEK

SEQ ID NO: 131395 - protein, 35 aa, Glycine max
  Coding DNA Sequence Number=SeqID_39710
EKREVVAAQLAHASWVASTRWHHLLLEHPGRPKWV

SEQ ID NO: 131396 - protein, 232 aa, Glycine max
  Coding DNA Sequence Number=SeqID_39711
  Gene Ontology: Mol. function=unspecific monooxygenase activity
  Homolog annotation: Hit_ID=Q6I666; Match level="QueryCoverage=27%, HitCoverage=98%, E-value=1e-25, Identity=78%"; Hit description =Cytochrome P450 like_TBP
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDVLVELILGHLRYLLTDVPPQPNSPPDNVFRPDRPPEAVLGSKKRGSAPLPIHGITPTYPTPLKSFHKVGLESSSTGSSFPADSAKPVPLAVVSLDSRQGQWESR

SEQ ID NO: 131397 - protein, 105 aa, Glycine max
  Coding DNA Sequence Number=SeqID_39712
  Subcellular localization annotation: CTP_CleavageSite=77; ConfidenceScore=5.16e-01
MVKVGTSYVPINVSFSPKVGPGLPAVPPVQLLTGWCVTAKAPPDISAGKCSVHAARNHHTRPRLMRRYRARPIRHSGCATVGKGDRSGPLRYYASWRKGDVLQGD

SEQ ID NO: 131398 - protein, 173 aa, Glycine max
  Coding DNA Sequence Number=SeqID_39713
MGDQEETQEQMKADMSALKEQMASMMEAMLGMRQLMEKNVATAAAVSSAAEADPTLSATAHHPPSNIVGRGRDTLGHDGNPHLGYNRAAYPYGLSPNYSPPVLQDDAGHIASPVLEREPPQQPDEVHEDPQDYARRDVEFYPPSPKGRHPARCSAQHHDTTNSFVHGRTAPGN

SEQ ID NO: 131399 - protein, 232 aa, Glycine max
  Coding DNA Sequence Number=SeqID_39714
  Gene Ontology: Mol. function=chloramphenicol O-acetyltransferase activity; Biological process=response to antibiotic
  Homolog annotation: Hit_ID=P62577; Match level="QueryCoverage=79%, HitCoverage=84%, E-value=1e-108, Identity=99%"; Hit description =Chloramphenicol acetyltransferase
  Pfam annotation: Domain name=CAT; Domain location=6-189; Score=407.5; E_value=1.9e-119; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLIAAGDSVVLLHVFPGWTQDDSYRIRRSGRTERGVRAYSPAWSELPTRN

SEQ ID NO: 131400 - protein, 246 aa, Glycine max
  Coding DNA Sequence Number=SeqID_39715
  Gene Ontology: Biological process=transposition, DNA-mediated
  Homolog annotation: Hit_ID=Q1J7G7; Match level="QueryCoverage=13%, HitCoverage=47%, E-value=2e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDVLDIRQTAQQELTEAHHRLDDSEYRFHRLLALPIGSSLSIPSTSRGGPVPAFVPFSEVGKPVVPAALMNRPTRGERRFAYWALAECILAYYVGTDEGEKKGCTGASAEYVIQDIFRFLAH

SEQ ID NO: 131401 - protein, 149 aa, Glycine max
  Coding DNA Sequence Number=SeqID_39716
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=74%, E-value=2e-24, Identity=68%"; Hit description=LacZ protein
  Subcellular localization annotation: CTP_CleavageSite=43; ConfidenceScore=5.21e-01
MASELLGMSQQGQTIPHTGLSGSVVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPARQ

SEQ ID NO: 131402 - protein, 32 aa, Glycine max
  Coding DNA Sequence Number=SeqID_39717
MANAKHMATPMSTACYLHHDETGHSIDVKQYQ

SEQ ID NO: 131403 - protein, 50 aa, Glycine max
  Coding DNA Sequence Number=SeqID_39718
MPISPCRWIAPTRHLSGPEEVQQGPEVTSSGYGPLSVLQGDRSPSEVMPS

SEQ ID NO: 131404 - protein, 200 aa, Glycine max
  Coding DNA Sequence Number=SeqID_39719
MAKFDPEVVLEFYANAWPTEEGVRDMRSWVRGQWIPFDVDALSQFLGDPLVLEEGQECEFSQRRNMANGFDEEAIAQLLCTPGQDFARNAAGRQVWIMRTSITTLTQTWMTLMPSNVLPSDHNSDLPLPKCQLMYAILTRMSVHVAQVIADNIYLFAGMPPTRHPLDPDKSNRALGFPALIMTISISRELLLFNFESLNM

SEQ ID NO: 131405 - protein, 252 aa, Glycine max
  Coding DNA Sequence Number=SeqID_39720
  Homolog annotation: Hit_ID=Q84VI1; Match level="QueryCoverage=100%, HitCoverage=36%, E-value=5e-90, Identity=71%"; Hit description =Envelope-like protein
MATSPKEISASGSPAVPSSPHQEQPEFNIQPIQVIPGQASVPEKLVPRRQQGVKIDENPSPATIPREVDTEMDKKIRGIVSSILKDASVPDAEKDVPTSSTPDVSVPDVNKDVPTSSAPNAEALPSPSEEESTEEEDQASEETPAPRAPEPAPGNLIDLEEVESDEEPIANRLAPGIAERLQSRKGKTPIKRSGRIKTMAQKKSAPITPATSRRSKVAIPSMKRKEISSSDTDDDVELDVSTSKRAKTSGRK

SEQ ID NO: 131406 - protein, 31 aa, Glycine max
  Coding DNA Sequence Number=SeqID_39721
MGVQIATRPTWAFQDVPPERAASGGSNLPRL

SEQ ID NO: 131407 - protein, 116 aa, Glycine max
  Coding DNA Sequence Number=SeqID_39722
MTLLLSNILPSERIANLPLQKYQLVCVVPTWKRNANIQDLIYGYGGSHQQTLLPCGENTETFSSLTSYPELRRSEFLIGGYVGARASLLSTTPPFVAMTQELVARGDTLRLSASRV

SEQ ID NO: 131408 - protein, 156 aa, Glycine max
  Coding DNA Sequence Number=SeqID_39723
  Homolog annotation: Hit_ID=Q6UUU1; Match level="QueryCoverage=61%, HitCoverage=83%, E-value=4e-25, Identity=55%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRIPLAAPSCALLFLPFGLPFAPSWTVCTNPPFSPTAAPYP

SEQ ID NO: 131409 - protein, 207 aa, Glycine max
  Coding DNA Sequence Number=SeqID_39724
MSITSSTASTRIRYPIERPPAIIQFRAALHNDQTFIEIPPFYHEQWAPNYPQEVRFKYNGATYPIRVQQHRGRYFFADGLADFKADLKIYESIIINFFACDDNTIFYLHFTPPLNQQTCGRPILHSRQHIWTTEITQCILGAPQPLEISSHARKYLKECDNHLTILRKNAPPLQWDVVTLDHDIKDKSIFRSWYKFLKENDFHHGDE

SEQ ID NO: 131410 - protein, 179 aa, Glycine max
  Coding DNA Sequence Number=SeqID_39725
  Homolog annotation: Hit_ID=Q2HW90; Match level="QueryCoverage=91%, HitCoverage=30%, E-value=2e-22, Identity=39%"; Hit description =Putative uncharacterized protein
MDILTLLIFGVVLFPNVDGLVDRAAIDAFLSFHDCKENAFVAILANLYDTFERRCEKNSARIVCCTPALYVWLVSHLFRQEVRHACPLEGHRSCTEKKEANWDQLLANKEGASVNWFPRWKEGRTEILISCGGFPNVPLMGTRGCINYNPILAIRQLGYPMRGAPLEEGLTSVIARGFK

SEQ ID NO: 131411 - protein, 81 aa, Glycine max
  Coding DNA Sequence Number=SeqID_39726
MLLSLPPPVYVDDTPWSSTSMLGGCCIGSLLGSSAIPVELSTGVERCEDSGVGWSEDCGVGWCEDSGVGWSEDCGVGWCEL

SEQ ID NO: 131412 - protein, 107 aa, Glycine max
  Coding DNA Sequence Number=SeqID_39727
  Homolog annotation: Hit_ID=A0PAV3; Match level="QueryCoverage=35%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFRLRNCWEGRSVRASSLLRQLAKGGCAARRLSWVTPGFPSHDVVNDGQ

SEQ ID NO: 131413 - protein, 118 aa, Glycine max
  Coding DNA Sequence Number=SeqID_39728
SMMIGCGITWMLWKLGRIDGDPALRGTRIRATWEYVSSVGGGQQGMVGYTSFVDVENRFAPSPDRHLVPHVMVVPGDISRGSGDLGDVRRAPGSQQIKGTKTTKQGGLCGGWPAVNFD

SEQ ID NO: 131414 - protein, 53 aa, Glycine max
  Coding DNA Sequence Number=SeqID_39729
GQDHLKLPSGLGTKHGQQKPIKERMQVGMESRPTDRCPFSALNKQRTLLQGSP

SEQ ID NO: 131415 - protein, 20 aa, Glycine max
  Coding DNA Sequence Number=SeqID_39730
MNRFIWTMETLSGLQQAATA

SEQ ID NO: 131416 - protein, 59 aa, Glycine max
  Coding DNA Sequence Number=SeqID_39731
  Gene Ontology: Mol. function=RNA-directed DNA polymerase activity; Biological process=RNA-dependent DNA replication
  Homolog annotation: Hit_ID=Q0KIL0; Match level="QueryCoverage=100%, HitCoverage=5%, E-value=3e-12, Identity=55%"; Hit description=RNase H family protein
QKGIEVDLEKVKAILEIPEPCTEKQHNESRNRERAIYYLSKKFTACEMNYSLLESTCCA

SEQ ID NO: 131417 - protein, 85 aa, Glycine max
  Coding DNA Sequence Number=SeqID_39732
MAIQGEDSEAGKKMEEHKQQLAPKPAPKPISDVVELEEINEETEDDKEEKTPIKVEEKERIKEEEKEKEKEKKSKNEKQKEKVVD

SEQ ID NO: 131418 - protein, 54 aa, Glycine max
  Coding DNA Sequence Number=SeqID_39733
RLQDVLTATIGRSEYPGRVRATGVDVTIKQYFGSAPWTSHTSSSMAPKELEQLT

SEQ ID NO: 131419 - protein, 142 aa, Glycine max
  Coding DNA Sequence Number=SeqID_39734
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=36; ConfidenceScore=5.07e-01
MWYHVTLTKYNHKVTSQGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131420 - protein, 161 aa, Glycine max
  Coding DNA Sequence Number=SeqID_39735
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPSKAFNLHSPHQVHVKLVPAPLESGLMLKLLVGHLDLLSNLTFTTDSAFFYFQIGNASNSTFGQ

SEQ ID NO: 131421 - protein, 328 aa, Glycine max
  Coding DNA Sequence Number=SeqID_39736
  Homolog annotation: Hit_ID=A5AZG1; Match level="QueryCoverage=26%, HitCoverage=27%, E-value=7e-07, Identity=35%"; Hit description =Putative uncharacterized protein
  Pfam annotation: Domain name=zf-CCHC; Domain location=132-149; Score =16.6; E_value=0.0047; Accession=PF00098.14; Description=Zinc knuckle
MKREKHASYSSHNSCKSLSEELRDYYEGRHRSHLRPHSHRREKERKPQEANINLPYFHGKDNVEANLVWEIRVEQQLKKKSTSKFYGSHSYPKKDQGQGILGVTPSKPKGDKGKTIENQAPKASVQEKTSSIKCFKCLGRRHITSQCPTTKTMIMRSQDIYSSQDEATTSPSSSETEEAKGEESSEEIYPQEEGQPLMLRRSVRRQPPHFLLCKKTLVSIATSLRLEFIPQVKELLDEGLVRKRLNPCALLVPKIGIIRHQIPKIGGVMNALGGATLFRKITRAPNIFMICVHRDSLGRNNQHENTQKGVPMNPKRIKVIPEWPAPPS

SEQ ID NO: 131422 - protein, 112 aa, Glycine max
  Coding DNA Sequence Number=SeqID_39737
PGMGGVTKVSPHYLRLCTIYFQRTTCCLKVTIRHEFQEMSKCPIYGTSWYKVKDEEESSSDENSNKGPPVKTLHGMQNGKISDGMVRHPADCSQWKKIDGLYPEFRERAKKS

SEQ ID NO: 131423 - protein, 103 aa, Glycine max
  Coding DNA Sequence Number=SeqID_39738
MVPRKLASKRSRKDKAAEGTSSTPEYDSHRFRSAEEVGRQRWTSLVTPMAKFDPEIVLEFYANAWPTEEGVRDMRSWVRGQWIPFDADAIGQLLGYPLVLEEG

SEQ ID NO: 131424 - protein, 115 aa, Glycine max
  Coding DNA Sequence Number=SeqID_39739
  Homolog annotation: Hit_ID=A0PAV3; Match level="QueryCoverage=56%, HitCoverage=31%, E-value=3e-07, Identity=52%"; Hit description =Restriction endonuclease
  Subcellular localization annotation: CTP_CleavageSite=44; ConfidenceScore=5.12e-01
MVKVGTSYVPINVSFSPKVGPGLPGINRDTRIYLFCEHRRTSALASVAVTLRVTTTPAALNAPLQGASHSPIQAAQLLGRAIAAGLFAITPAGERGMCCKAIKLGNASVFPVTTL

SEQ ID NO: 131425 - protein, 111 aa, Glycine max
  Coding DNA Sequence Number=SeqID_39740
  Homolog annotation: Hit_ID=O69421; Match level="QueryCoverage=27%, HitCoverage=32%, E-value=6e-10, Identity=96%"; Hit description=InsA protein
  Pfam annotation: Domain name=Ins_element1; Domain location=4-60; Score=-5.3; E_value=0.00037; Accession=PF03811.4; Description =Insertion element protein
  Subcellular localization annotation: CTP_CleavageSite=73; ConfidenceScore=5.71e-01
GAPVASVSISCPSCSATDGVLRNGKSTAGHQALASVTVTLRVTTTPTALNAPLQGASHSPFRLRNCWEGRSVRASSLLRQLAKGGCAARRLSWVTPVFSQSRRCKTTASEL

SEQ ID NO: 131426 - protein, 162 aa, Glycine max
  Coding DNA Sequence Number=SeqID_39741
  Homolog annotation: Hit_ID=A5BGR5; Match level="QueryCoverage=85%, HitCoverage=28%, E-value=3e-07, Identity=26%"; Hit description =Putative uncharacterized protein
MWDTLQVTYEGTTGNGNQKVTAIAESRDLTNMSLATLFGKLQEHEMELMRLHQHEENDIKRKGIALRASSSFIQEESDKEDLTETEEDDDDFRLFVKRFNKFLRNKRNKRESNINTKKKEEDSSLAPTWYDSNQPGHVRFDYLVFERKIEKSDKRNLKEKKA

SEQ ID NO: 131427 - protein, 306 aa, Glycine max
  Coding DNA Sequence Number=SeqID_39742
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFARLSNHLLASKLALAIDGPWIDRVGFDIGFVLGAIKDVVRAVVHQKAAKLARFFSECTDSSAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131428 - protein, 149 aa, Glycine max
  Coding DNA Sequence Number=SeqID_39743
MAADFVEEIHSGHIHLICNCTMTRRLWWEPLRWVNRVGPFSTDPKNHFLQFTQWNNKASINNIWKFLWLALSFFVWHHRNAMIFKNQPFDPEKRRTTPGTTPSICSSCMWRSTPGCLMNDNSISHLPAVNDMVCMQRDSRNLNTLQYMF

SEQ ID NO: 131429 - protein, 133 aa, Glycine max
  Coding DNA Sequence Number=SeqID_39744
RIPPSGPEEIQQGPGVSSSGYEPLSVLQGARTPPARSRHHRDRACKTPSGPEEVQQGLGVASSKYGSLKVIRPPYQSSFHPEVLRPQASAGRSTTAALGWPVAGNRHTATTSKVHLSSSIKRLERCLRHMADQ

SEQ ID NO: 131430 - protein, 225 aa, Glycine max
  Coding DNA Sequence Number=SeqID_39745
  Homolog annotation: Hit_ID=UPI00016621D1; Match level="QueryCoverage =97%, HitCoverage=39%, E-value=8e-14, Identity=33%"; Hit description =UPI00016621D1 related cluster
GLHVLANRGLHALTLRGLCVLTFRGLHVLTFRGLHALAIRGLRVLTFRGLRVLTFRGLHALTIRGLHVLTFRGLHALAIRGLHVLTFVGLHALTFRGLQVLANRGLHALTLRGLHVLANVGLHALTFRGLHVLANRGLHALTFRGIHLHVLTLRGLHVLALRGLHVLALRGLHVLTIRGLHALTSRGLHVLALRGLHVLTIRGLHALTSRGLHVLALRGLPALAL

SEQ ID NO: 131431 - protein, 76 aa, Glycine max
  Coding DNA Sequence Number=SeqID_39746
  Subcellular localization annotation: CTP_CleavageSite=58; ConfidenceScore=5.11e-01
MHLRDQGSLLYNKEKNKMKDCKNTSGEDVSFTSRIPQPLTNSSQALRTASSSSSGLCRSSHNKISQNSLELGPFSL

SEQ ID NO: 131432 - protein, 136 aa, Glycine max
  Coding DNA Sequence Number=SeqID_39747
  Pfam annotation: Domain name=G-patch; Domain location=32-76; Score =8.9; E_value=0.016; Accession=PF01585.14; Description=G-patch domain
  Subcellular localization annotation: CTP_CleavageSite=38; ConfidenceScore=5.08e-01
AFQSLEMAFQSFEVVSCASMEPSPSLPSLSKVAIMVARVMLRNRFEPGMGLGKDCLGNADVVDIKGNPCKYGLGYEPGMPGRRNVPSRFRADRVWPGRISQCFTSAGMVSEEEVATIEEEFPQDPPILCNHATPIP

SEQ ID NO: 131433 - protein, 72 aa, Glycine max
  Coding DNA Sequence Number=SeqID_39748
MSSPLEDYISLPSEGCTPSPSEDYTSSPSEGYTSSLSEGSTSAPSEDLSPLVSPLILEEGQLCEHNQREAIV

SEQ ID NO: 131434 - protein, 158 aa, Glycine max
  Coding DNA Sequence Number=SeqID_39749
  Homolog annotation: Hit_ID=A5AVN9; Match level="QueryCoverage=77%, HitCoverage=11%, E-value=5e-12, Identity=32%"; Hit description =Putative uncharacterized protein
  Pfam annotation: Domain name=zf-CCHC; Domain location=126-139; Score =16.9; E_value=0.0043; Accession=PF00098.14; Description=Zinc knuckle
MPVYMEGETLDQTRKCSKWENDDYICRGHILNGMSDSLFDIYQMLSLLRNYGTLLNPSIWQKMPQFTQHDLKMDESIAVSSIIDKLPSSWKDFKHTLKHMKEELTLVQLGSHFMIEESLRAQEIDKCGKPGHLKRDCRVFKGKNKAGPSGSNDPEKQQ

SEQ ID NO: 131435 - protein, 102 aa, Glycine max
  Coding DNA Sequence Number=SeqID_39750
MEEEYETAASLGAGAASGGGTSNFLLDLKPSAPSDLSDSEWRLLSLVEIAYSGWLFASLTLLRKVEEGPQSLVVFVVIVAAAVALEEEHMACLDQQHSGKEG

SEQ ID NO: 131436 - protein, 223 aa, Glycine max
  Coding DNA Sequence Number=SeqID_39751
MTGRLLAGSLTFDNRIMHYIIVRILLPRSSNLAQASEEDLILMWAFLTGRQIDWAHLVRYRMHKALRANAPLPYPQLITLFLRHFQIPLDDEPFVQVKRSFAIGAGAVTSFGYRKDRNGQWLKKDALPPQDERTPSPPPQRDDSTLMNAVLSELRGLRSYVGEHFDSLDTRFAGMVSQPTLRREGDARLAGCVFHERNTRGVTTNIYLRKTSGKPEKTRSTNF

SEQ ID NO: 131437 - protein, 63 aa, Glycine max
  Coding DNA Sequence Number=SeqID_39752
MRKCGRVRLPTFIRWPQSGTWRYVAGVRRPWGRQASSWKSIDKRTKTTKQGGLCGGWPAVNLE

SEQ ID NO: 131438 - protein, 47 aa, Glycine max
  Coding DNA Sequence Number=SeqID_39753
MGAKHLTRTKEKSHVIKQRSPDEIRVKWWLDRNIEMAITEATELQMR

SEQ ID NO: 131439 - protein, 88 aa, Glycine max
  Coding DNA Sequence Number=SeqID_39754
MKSDKASQDINSISQACSELQNKERETRLKRAIKGINSRTHQQESSQGYCANNQWGKTHQMIIMMDGSNSHKGKIITFKLSFQNYHDM

SEQ ID NO: 131440 - protein, 101 aa, Glycine max
  Coding DNA Sequence Number=SeqID_39755
GVSSLSSFSIMLPFIFQEAKESIDEEDPRPTSSNGAYISFLLLSQLYAGPEELPPTVLRPRARPAEAPSTSTAPHLAFTSIAPPPARIAVAPSTLPPADFQ

SEQ ID NO: 131441 - protein, 82 aa, Glycine max
  Coding DNA Sequence Number=SeqID_39756
MRTCFSKETKLPTNQSNICFSDEKQSTGEGDISLLNDHLEETLSSTKIEENHSKCIKLTQCGAKNSLTHMILGWAIKGRGPL

SEQ ID NO: 131442 - protein, 127 aa, Glycine max
  Coding DNA Sequence Number=SeqID_39757
MVICEEKHQWHLSPPNRHVRKEDNPKKSTKANISANGPHFSWLAISLALPSKYFRGRPTMPLRVCFMQSNSLAESPTTAAILLKEGRNPEKRYGFLPPRGHPSISSNSSIVGTIWKSPNVKHLNGWS

SEQ ID NO: 131443 - protein, 218 aa, Glycine max
  Coding DNA Sequence Number=SeqID_39758
MGDPISRLSFPENTETLSSLTSYPELRRSEFLIGGYVGARASLLSTTAPFVAMTQELVARGDTLRLSAPRHLVTPSVIHEQRPIWSSAPFPEMSAFSDGDFSSLTSYPELQTKSGHSAPLYHPEAAGPMIRGDTLRLSAPFCHPEAAGPMTSRDQVWSFCTLVSSRGGGPDDTRRYLTVIRTFLSSRGGEPDDTRRYLTVIRTLLSSRGGGPDDKQRP

SEQ ID NO: 131444 - protein, 262 aa, Glycine max
  Coding DNA Sequence Number=SeqID_39759
  Homolog annotation: Hit_ID=Q2HW90; Match level="QueryCoverage=65%, HitCoverage=37%, E-value=3e-20, Identity=38%"; Hit description =Putative uncharacterized protein
MRRLEERAEALAYQEEWTSFIDILALLVFGTILFPNVDGLVDLAAIDTFLAYHHSKESPVIVVLADAYDTFDLRCKKSGARIVCCTPALYVWMVSHVLRHEGRPVCPLQGHHMCAKKGKENWEELLAGFPNVSLMEARGCINYNPMLAIRQLGYPMRAAPSEETITPFVARGFSEGNAKILQRIRKAWNIVERKDKELRGLNVFDDFDVFCQDFNVFFTFQDFNVFCQDFNVFFTFQDFKVFCLVSLLWFSPVASQIARSLG

SEQ ID NO: 131445 - protein, 118 aa, Glycine max
  Coding DNA Sequence Number=SeqID_39760
MTERYAWGVAALVLMYDQLNDASMSHNRQLGGYITLLQYWIYEYFPSVGDSIADQDYDEDSLRACRWIVTKKTVKSICGVFVVPGQCSSDYMDWFFRISHPFMTPGHALDPLPDGHAP

SEQ ID NO: 131446 - protein, 62 aa, Glycine max
  Coding DNA Sequence Number=SeqID_39761
MGLLLKQRNQDHTRKIIEHGDVKIEKVDGKENATNPFTKVLGIKEFDKHKWELGMKFMNDWL

SEQ ID NO: 131447 - protein, 216 aa, Glycine max
  Coding DNA Sequence Number=SeqID_39762
VAGCTICGGAHESGCCIPIEEHPAGEVNYMGNQPRKNFNVGGFSGFQHGQQYNQQQGQWRNHPGNQFNRDQGGPSTRPQQQGPNRSSSSFTANTEKNPKEECKVVMTRSRMAIQGDDKINEETEDDKEEETPIKEKEKERIKEEEKENKLKIEKQKEKVVDDEMRKGKSEANIDKKKDNDAILPTKGLVTRAMNKRLQEDWARAAEEGPRVLMNLR

SEQ ID NO: 131448 - protein, 108 aa, Glycine max
  Coding DNA Sequence Number=SeqID_39763
MSRGLGDLGDVRWGAIAQNQAWPIPTQPGHSQPGVWETLEGNERCRFRGIVRLTATSLVHPEQPACTLQQPVEWILPTPTPYRLVEPAQLIECHPLMRILKRTQGVIS

SEQ ID NO: 131449 - protein, 46 aa, Glycine max
  Coding DNA Sequence Number=SeqID_39764
GKLPGNHITSETSKRVGLRPQKEATPENVAFHGFKQKTQMKHEAVM

SEQ ID NO: 131450 - protein, 145 aa, Glycine max
  Coding DNA Sequence Number=SeqID_39765
MSDPLVLHVHTATMPQPPAPATVDAGMPQHAMGIEATPDEAYIIFESSDPCIHGIKTLTHKSSKVAELYEYFSQKRKGIIPLWWRRWGTFVRNRWWWRKIPFASLMILPFEGVSANFDRDLVKKCERYADLKIGEGFAPSHEREE

SEQ ID NO: 131451 - protein, 82 aa, Glycine max
  Coding DNA Sequence Number=SeqID_39766
MAKELSISIKHNSLRQTMKPHKFSKEESRDVTNIIYLMAWYEMCHLAKPIYHHKDRVYTPLGPRKSMDKVHANIYPGCRWNG

SEQ ID NO: 131452 - protein, 233 aa, Glycine max
  Coding DNA Sequence Number=SeqID_39767
  Gene Ontology: Mol. function=peptidyl-prolyl cis-trans isomerase activity; Cellular component=periplasmic space; Biological process =protein folding
  Homolog annotation: Hit_ID=Q6CZV2; Match level="QueryCoverage=85%, HitCoverage=73%, E-value=2e-94, Identity=85%"; Hit description=FkbP -type peptidyl-prolyl cis-trans isomerase
  Pfam annotation: Domain name=FKBP_C; Domain location=150-233; Score =124.1; E_value=4e-34; Accession=PF00254.19; Description=FKBP-type peptidyl-prolyl cis-trans is
  Pfam annotation: Domain name=FKBP_N; Domain location=19-146; Score =173.2; E_value=7e-49; Accession=PF01346.9; Description=Domain amino terminal to FKBP-type peptidyl-prolyl isomerase
  Pfam module annotation: Pfam domain module=FKBP_C::FKBP_N; Domain location=150-233::19-146
MAVALNAPLAMAAETTAAPADAAQAAPQAPKNAAFKNEDQQSAYALGASLGRYMDNSLKEQEKLGIKLDKDQLIAGVQDAFGGKSKLSDEEIEQTLQAFEGRVKGAAQAKMEKDAKENADKGTAYADKFAKEKGVKKTESGLLYQVEKEGSGETPKDSDTVVVNYKGTLIDGTEFDNSYTRGEPLSFRLDGVIPGWTEGLKHVKKGGKIKLVIPPNLAYGKNGVPGIPANSTL

SEQ ID NO: 131453 - protein, 351 aa, Glycine max
  Coding DNA Sequence Number=SeqID_39768
  Gene Ontology: Mol. function=peptidyl-prolyl cis-trans isomerase activity; Cellular component=cytoplasm; Biological process=protein folding
  Homolog annotation: Hit_ID=P0A9L1; Match level="QueryCoverage=42%, HitCoverage=75%, E-value=8e-72, Identity=92%"; Hit description=FKBP -type peptidyl-prolyl cis-trans isomerase slyD
  Pfam annotation: Domain name=CHP02443; Domain location=44-100; Score =39.7; E_value=8.9e-10; Accession=PF09526.1; Description=Probable metal-binding protein (CHP02443)
  Pfam annotation: Domain name=FKBP_C; Domain location=120-259; Score =24.0; E_value=2e-05; Accession=PF00254.19; Description=FKBP-type peptidyl-prolyl cis-trans is
  Pfam module annotation: Pfam domain module=CHP02443::FKBP_C; Domain location=44-100::120-259
  Subcellular localization annotation: CTP_CleavageSite=25; ConfidenceScore=5.16e-01
PTTTACRFHACVRRDASWRTFSSVKCSMKNGSLTAGMMSKATLNEKDTLAMWRENNVDVVECVKCGHQMREADKQARDQVRSTEQLSLTAVLNSATIGAINAEQYGPTALLASSVLNLSGDIMKVAKDLVVSLAYQVRTEDGVLVDESPVSAPLDYLHGHGSLISGLEKALENHAVGDKFDVHIPANDAYGQYDDNLVQRVPKDVFMGVDELQVGMRFLAETDQGPVPVEITEVEDEHVVVDGNHMLAGQNLNFNVEVVAIREATEEEIAHGHVHGADGHHHDHDHDHGHDHEHGHGGCGGHARDINSAAAGSLPLAKRPWTGRRPLLYPPADAPAHAVYSFPARAEPPSD

SEQ ID NO: 131454 - protein, 65 aa, Glycine max
  Coding DNA Sequence Number=SeqID_39769
MTVAEYAAKFEELVRQKGHFQRDSPHPKREQNGGGLNDQIGHPKATGRVFTLNGAEASKSKDLIQ

SEQ ID NO: 131455 - protein, 163 aa, Glycine max
  Coding DNA Sequence Number=SeqID_39770
MTGRLLASSLALESRILHYLIVCILLPRSSNLAQVSEEDLIVMWAFHTGRQIDWAHLVRSFLIGAAVVASFGYRKKRDGSWVKKGAQLNDDEGHLSVEKDSSLLQSILDRFDGLQTYVGERFNSLERQVDTRFEEMNLGIAKVEEDVTIIRDCFDLPPPLPSV

SEQ ID NO: 131456 - protein, 61 aa, Glycine max
  Coding DNA Sequence Number=SeqID_39771
MVSQPTLRQEGNAGLTGASFKKGKCAESPPRLIRGKRQKNRKGCFPRSYVFLNCDEEIRPT

SEQ ID NO: 131457 - protein, 130 aa, Glycine max
  Coding DNA Sequence Number=SeqID_39772
  Homolog annotation: Hit_ID=A5C7C5; Match level="QueryCoverage=84%, HitCoverage=15%, E-value=1e-16, Identity=37%"; Hit description =Putative uncharacterized protein
MRRMIRKRKELLLKINHQPKKKPGHLRVDCPIFKKRIEKSKKKVFNEKKTKKAYITWDDNDMDLSEDSENEVVNLSLMAKNYESDEEDSLKKSWYIDSGCSKHMTGDASKFTHISPKKSGHMTYGNNNKG

SEQ ID NO: 131458 - protein, 287 aa, Glycine max
  Coding DNA Sequence Number=SeqID_39773
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131459 - protein, 139 aa, Glycine max
  Coding DNA Sequence Number=SeqID_39774
MGWLEYQGNVWKQKQESWQAAIVTFLAFHDRKESPVVAILADLYDTFDRRCEKNSTRIVFCTLTLYVWLPFPPRGETCLHARRPPLMHREKRGKLGPTLSKERRSVCQLVPSMERRKNRVSYFVRRISKCSLDGDKGLH

SEQ ID NO: 131460 - protein, 79 aa, Glycine max
  Coding DNA Sequence Number=SeqID_39775
MDNCGNSRANTCHLADAVPFKFLTYQLSTVGYWPTVALTGNGELGFDSGEGARETATTSKEGSRRANYPILTQGGSDKK

SEQ ID NO: 131461 - protein, 80 aa, Glycine max
  Coding DNA Sequence Number=SeqID_39776
MVVVSLHELYVLLHLFLGGVIATDEDRVIIAAEGNIIVREDLVDIPGFTLPEDLSENCIVHPDGGFVMKGLEWCWGGWGC

SEQ ID NO: 131462 - protein, 144 aa, Glycine max
  Coding DNA Sequence Number=SeqID_39777
  Homolog annotation: Hit_ID=Q6WAY6; Match level="QueryCoverage=95%, HitCoverage=28%, E-value=2e-07, Identity=27%"; Hit description =Putative uncharacterized protein
MGTRGCISYNPILAIRQLGYPMRGAPLEDELAPVISRGFNKTNVETLQKVHKAWEVLQKKEKELGGSNNGTIGGYQEDEEVQALRAELEQAQTINERFKSAALKIRKENAELRDINIATTKALEQETKRARREEHGRNKFRGAL

SEQ ID NO: 131463 - protein, 106 aa, Glycine max
  Coding DNA Sequence Number=SeqID_39778
  Subcellular localization annotation: CTP_CleavageSite=32; ConfidenceScore=5.40e-01
MYPLLFSVTTTQVDVPSTCTTKDVPSNVLRQRSQAGKGRIKRILRLCRFEFFEKRERTHKRIQANKVWKPENLENFWQRKKKKKFKKTFKNTLVIDYQYIVIDYAI

SEQ ID NO: 131464 - protein, 91 aa, Glycine max
  Coding DNA Sequence Number=SeqID_39779
MAKCPASGKCIGSPKECRNVHFAGERGRGSRVRFPKEERCAESPPTFICGKRRKNRRKPVKMKILSSGVVFTLEEGISTSYVCLEGQQPMF

SEQ ID NO: 131465 - protein, 70 aa, Glycine max
  Coding DNA Sequence Number=SeqID_39780
MYKDNWTKPWPMGSVIYPEVHENPRAFFNSSSPILLEPLAQGSNDWSLPREDCITSELRTQQIQCKKNIF

SEQ ID NO: 131466 - protein, 120 aa, Glycine max
  Coding DNA Sequence Number=SeqID_39781
VWSPTNFLPSTVRLSSTIKSYLEPHELIVIHASTTIENGVPRIDCLALLVYPPPSNLIPSPTNCLPSAIHLSSTLKSYPDPHELIVIHASSTIESGAPRIAWLALFGYPPPSNLIRSPMN

SEQ ID NO: 131467 - protein, 301 aa, Glycine max
  Coding DNA Sequence Number=SeqID_39782
  Homolog annotation: Hit_ID=Q6WAY4; Match level="QueryCoverage=90%, HitCoverage=53%, E-value=3e-24, Identity=30%"; Hit description =Putative uncharacterized protein
MGTKQTGKRFYQVKIKGLDVTSLKELGRLMGPLQMQAFSKAYGKILDLTIAEIFTEAVVSVTQYYDQSLRCFTFGDFQLVSTVEEFEEILGCPLGGRKPYLFFGFLPSLSKIAVVVRDSARELDRVKQTREWRSGATTKVLRRKGKGYGESRGVGPVYGRISIANLWGCPLSKQDGLVDLAAIDAFLAYHHSKESPVVAISTDLFDTFDQSHHSFVQKRRVDWDQHLAGIGDRTINWFPRWKEGNEGVLFSCGDYPNIPLIGTRGCINYNPALAIRQLGYPMRGAPMEESLSPFLVRDFGE

SEQ ID NO: 131468 - protein, 109 aa, Glycine max
  Coding DNA Sequence Number=SeqID_39783
MKRQIIEIIGYVMCRSTVKQKIMLRWAGSCSIDLNLSSVSQRVTRWRWDTRMLLLEGFALRENMTFDVAPLTAAEKRVLSMPRFVIGIGSSLSIQGCQRGRSLSLGSTN

SEQ ID NO: 131469 - protein, 248 aa, Glycine max
  Coding DNA Sequence Number=SeqID_39784
  Homolog annotation: Hit_ID=A5BSK3; Match level="QueryCoverage=40%, HitCoverage=10%, E-value=1e-10, Identity=40%"; Hit description =Putative uncharacterized protein
MLKSFKQQEQMSVLELYVEKDVADGSMFHSTNSLTSCENYLSNDETQPPTNMSNLHVDEDDDDDYLVSNSYVEESLDEDDSVDSISDTDDEVTDMIQPVKIVHPAKGVQGIQNPFWNDALHYNNINWSHPDEENICGLEMPSSFNVGQELYVGMDFDSKDAVKNAVKQYVMKVHQSFKVVESKWNKYVVCCLNKNADCPCPFYMRAILSKKTYSWKVTQWGGPHILYVLRLPQDHEKLDSDLIATCVA

SEQ ID NO: 131470 - protein, 139 aa, Glycine max
  Coding DNA Sequence Number=SeqID_39785
MSEVYGIKMVIDQSLFYDLTQLPSEGVPFEGALIDDWKFDFSVHDARRLVCTNQADMTGRLLAGSLDFESRILHYLIVRILLPRSLNLAQVSKEDLIVMWAFHKGLKIDWAHLVRYCMHKALRLNAPLPYPHLCRCNCL

SEQ ID NO: 131471 - protein, 136 aa, Glycine max
  Coding DNA Sequence Number=SeqID_39786
  Homolog annotation: Hit_ID=Q2HTA0; Match level="QueryCoverage=54%, HitCoverage=11%, E-value=3e-11, Identity=47%"; Hit description=IMP dehydrogenase/GMP reductase, related
  Pfam annotation: Domain name=DUF1723; Domain location=10-59; Score =56.4; E_value=9.5e-14; Accession=PF08330.1; Description=Protein of unknown function (DUF1723)
SPLIACSVDTNDRGLLSAFVERWHRETSNFHLQVGELTITLDDVSSLLHLPVIGDLHTFEPLHVDDAVQMLVDLLMVSPEFVRAETAQCHGPYVRLQWGLILSVLIYILPTFENGSRWVQRNAKNWNQRGGTQTEA

SEQ ID NO: 131472 - protein, 232 aa, Glycine max
  Coding DNA Sequence Number=SeqID_39787
  Subcellular localization annotation: CTP_CleavageSite=30; ConfidenceScore=5.38e-01
MAGSSTSRTRMVPWSRSNCIQASKAPGITVASRPARAWRRRAWCPGRTALDAAGAGVEEPPKPGHFPGRRSLRGPAARMRAGATSLYSSNSSCAAARRAADPSRPRSASRPAQWLREVHDTPKVGPTVPGRVVNMVDRWDAAPASRSRRRRRGASGRVRSAPGLVEQLVGRAGRRTCRRSGCGTACGPRDVAAGQVDLRGGGPVGLEEVLQAGDGVGDTRHQRVAVFGVIDG

SEQ ID NO: 131473 - protein, 54 aa, Glycine max
  Coding DNA Sequence Number=SeqID_39788
MRTCPTCGVSCYKVNNHEISDAVTAENSHPAKLMWHAEGQKIDGLLRHPADSPQ

SEQ ID NO: 131474 - protein, 173 aa, Glycine max
  Coding DNA Sequence Number=SeqID_39789
MAPRKLASKRSSNDKAAEGTSSAPEYDSHRFRSVEHQQRFEAIKGWSFLRERRVQLRDDEYTDFQEKIVRRRWASLVTPMAKFDPDIVLEFYANAWPTEEGVRDMRSWVRAQWIPFDADAISQFLGYPLVLEEGQECEYGQRRNRSDGFDEEAIAQLLYLDDFAAQQHPAQQP

SEQ ID NO: 131475 - protein, 381 aa, Glycine max
  Coding DNA Sequence Number=SeqID_39790
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=47%, HitCoverage=26%, E-value=8e-71, Identity=64%"; Hit description =Lipoxygenase-4
  Pfam annotation: Domain name=Lipoxygenase; Domain location=8-365; Score=-82.9; E_value=9.1e-15; Accession=PF00305.10; Description =Lipoxygenase
  Pfam annotation: Domain name=NMD3; Domain location=1-194; Score=-6.3; E_value=2.5e-06; Accession=PF04981.4; Description=NMD3 family
  Pfam module annotation: Pfam domain module=Lipoxygenase::NMD3; Domain location=8-365::1-194
MASAAYGTEGLLKRLVLVHCPKCQSCNHQEVGVKLQLESKELLTFCLKKLQKNLNSNKVRLVHAEFIWTEPHSRRVKVKVKVQKEVLNGAILEQSYPMEYVQQEHMCESCSRVQANPDHHGVKFVEFIGKIALVTNNIALLDPFTLRHCFIDVDQYWRASFKSLLTSRQLVDYIVLDVETVSSEVTIGGTKYRLADAQVAQIWDDIKSWVEEYVSFYYKSAEELQKDPELQAWWKELVEYPYGGLILNRPTISRRFMLEKGSLEYDALAKNPGKEFLKPITGKKETLIDLTIIEILSRHASDEFYPGQRDGGEYWTSDAGPLEAFKRFGKNLEEIEKKLIEKNNDETLRNRYGPAKMPYTLLYPSSEEGLTFRGIPNSISI

SEQ ID NO: 131476 - protein, 132 aa, Glycine max
  Coding DNA Sequence Number=SeqID_39791
MPFIGSKSGASNRSPYFHFSHNSYKSLSEELRHYYEGRHRSNLRPHSHRREKERKPQETNINLPYFHGKDNVEANLDWKIRVEKQLKRKSTSKSYGSNSYPKKYQGQGILGVTPSKPKDDKGKTIEKQPLKA

SEQ ID NO: 131477 - protein, 73 aa, Glycine max
  Coding DNA Sequence Number=SeqID_39792
MEAKWRRKRERRHHFKEKMSLEEAHHHRRPWIRAWRKKEMNEGRGREEHEILCSKRALKSETTNPRINSKILH

SEQ ID NO: 131478 - protein, 66 aa, Glycine max
  Coding DNA Sequence Number=SeqID_39793
MVGYVPSSFADLVFADERIEVGLKRGKFNHPAWTNEKTGANEEGENKGETHVATAIPTCPNFPPAQ

SEQ ID NO: 131479 - protein, 97 aa, Glycine max
  Coding DNA Sequence Number=SeqID_39794
MYPLLFLVNTPSRCTLYLYHKGCTLQCVKTKEREESKEFSDCVILNSLTREKGDTKEFRQLVLHSFGKGRRETQKEFRRLVLGKFFLAKGEGNEKDE

SEQ ID NO: 131480 - protein, 185 aa, Glycine max
  Coding DNA Sequence Number=SeqID_39795
  Homolog annotation: Hit_ID=Q6UUU1; Match level="QueryCoverage=32%, HitCoverage=40%, E-value=2e-18, Identity=78%"; Hit description =Putative uncharacterized protein
IALKASSSIQEESDQDNDPDDDDDLSLFVKRFNKFLKVRGNQRRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131481 - protein, 257 aa, Glycine max
  Coding DNA Sequence Number=SeqID_39796
  Gene Ontology: Mol. function=transcription factor activity; Biological process=regulation of transcription, DNA-dependent
  Homolog annotation: Hit_ID=A0G7B0; Match level="QueryCoverage=92%, HitCoverage=72%, E-value=3e-58, Identity=49%"; Hit description =Transcriptional regulator, LysR family
  Pfam annotation: Domain name=HTH_1; Domain location=19-78; Score =68.5; E_value=2.2e-17; Accession=PF00126.18; Description=Bacterial regulatory helix-turn-helix protein, lysR family
  Pfam annotation: Domain name=LysR_substrate; Domain location=102-252; Score=20.0; E_value=0.00032; Accession=PF03466.11; Description=LysR substrate binding domain
  Pfam module annotation: Pfam domain module=HTH_1::LysR_substrate; Domain location=19-78::102-252
MARDVRIDEVFRTVSSLPPGELAAFLAVAEHGGFRAAARTLDQSASALSHAVAGLEKRLKVKLFHRSTRNVSLTESGSRFASRLVPAISEIGLAVEEIEDMNAAPAGLLRINTDANAAEQVLMPLLTKFMAIQPAMRFEIVSDKRLVDIAEGGFDCGIRLAELVPEEMVAIPIGPDQQHIVVASPGYLDNAPELAQPSDIALHKCVQLRMSGGSIYRWEFQRRGETLAVETSGNLVVDHSRLLLAAAREGYGLAYVT

SEQ ID NO: 131482 - protein, 178 aa, Glycine max
  Coding DNA Sequence Number=SeqID_39797
  Gene Ontology: Mol. function=oxidoreductase activity; Cellular component=extracellular space; Biological process=metabolic process
  Homolog annotation: Hit_ID=A1TH74; Match level="QueryCoverage=95%, HitCoverage=55%, E-value=1e-37, Identity=50%"; Hit description=Short- chain dehydrogenase/reductase SDR
  Pfam annotation: Domain name=ADH_zinc_N; Domain location=25-157; Score=-19.7; E_value=0.034; Accession=PF00107.17; Description=Zinc -binding dehydrogenase
  Pfam annotation: Domain name=KR; Domain location=29-173; Score=-78.6; E_value=0.0088; Accession=PF08659.1; Description=KR domain
  Pfam annotation: Domain name=Shikimate_DH; Domain location=7-130; Score=-16.2; E_value=0.0053; Accession=PF01488.11; Description =Shikimate  quinate 5-dehydrogenase
  Pfam annotation: Domain name=adh_short; Domain location=27-169; Score= 44.5; E_value=3.8e-10; Accession=PF00106.16; Description=short chain dehydrogenase
  Pfam module annotation: Pfam domain module=ADH_zinc_N::KR::Shikimate _DH::adh_short; Domain location=25-157::29-173::7-130::27-169
MTMSADIPFGFASTANEVLEGIDLSGKNIIVTGGSGGIGLETTRALAAAGASVTIAARRPDDARAVAERIASEITKGSVSVRQLDVADLSSVRAFVEGWDQKLDVLVNNAGVMAIPDLQRTPEGREMQFATNYLGHFALALGLRTHLAKANGARVVSVASVGSLFAPVFWDDPDFRFI

SEQ ID NO: 131483 - protein, 56 aa, Glycine max
  Coding DNA Sequence Number=SeqID_39798
LENEARKLRKPLVIDYPGRNGSLVIDYQIVMAAQLIHDRVEMECLGGAWETLEGNT

SEQ ID NO: 131484 - protein, 65 aa, Glycine max
  Coding DNA Sequence Number=SeqID_39799
ARLTGALSKGGKMRGVATDVYLWKTSEKPKETGHKEYSKFGSCIYVDKSGALAPTYPPSKRKSDL

SEQ ID NO: 131485 - protein, 136 aa, Glycine max
  Coding DNA Sequence Number=SeqID_39800
  Subcellular localization annotation: CTP_CleavageSite=41; ConfidenceScore=5.11e-01
MDRSMTLTNAPRSSMAFSNLLFPIMQGGNGRGIRGCGSGAGAATGGGTSIWLPDLKFVKAICQNFGIVLGSTEQPSAPSDLSDSKWRLLSLAKIAYSGWSFAALTLLRKVEEEPQLLFVFVVTAAVLEEEHMACLD

SEQ ID NO: 131486 - protein, 92 aa, Glycine max
  Coding DNA Sequence Number=SeqID_39801
  Homolog annotation: Hit_ID=A0PAV3; Match level="QueryCoverage=41%, HitCoverage=17%, E-value=5e-07, Identity=76%"; Hit description =Restriction endonuclease
MVKVGTSYVPINVSFSPKVGPGLPGINRDTRIYLFCEVIFRHRCSQVASVSIQAVPPVQLLTGWCVTAKAPPDISAGKCSGHAARNHHTRRA

SEQ ID NO: 131487 - protein, 227 aa, Glycine max
  Coding DNA Sequence Number=SeqID_39802
MVSIWDLAMVEVSMEPIASLAQYYDQPLRCFIFGDFQLSPMVEEFEEILGCPLGGRKPYFFSGFYPSLARISKKSPNLGAGIKPPKASRKWGGRNTKKIFGVLFPNMEGLVDLAAIDAFLAFHHGKESPIVAILAMYDTFVRGCEKSGARIVCCTPALYVGLVSHLFLQEGRPAYPLQGYRSCVEKGKANWDQLLASMEGRLLIGFLARRKEESGFYLHAKDVQMFS

SEQ ID NO: 131488 - protein, 76 aa, Glycine max
  Coding DNA Sequence Number=SeqID_39803
MTSKLQMLITFATVVRLRPTIYRNAQNSEENPDKGIWIEPVSRAEALIPDDVILTRNRSLDTGYGDLDDATSSKGR

SEQ ID NO: 131489 - protein, 45 aa, Glycine max
  Coding DNA Sequence Number=SeqID_39804
MMGLGSSSSMDSFAYWKMNGSRIEKEEREETPLQGEDESRRSSIP

SEQ ID NO: 131490 - protein, 220 aa, Glycine max
  Coding DNA Sequence Number=SeqID_39805
GTERRCSTDKLLSACAKESFFQYDQESNFKVTPFLRSPTAAASATAEDGGKKTKTRGPFFELSLIDSDLIFRRNQTPFVHEPILSSVTPLDQHRGGGPRPLSLSIDFLKDDLAVDDVPAREPLATLDTSYSRIVTLPSLSASSKAIEEFFNQYPLFCIWSFRKPAHRAERRAGFVVPSRDWNANPSRKISNGREQAKSSCLFSSLSPRLAKTSSAHSGIL

SEQ ID NO: 131491 - protein, 142 aa, Glycine max
  Coding DNA Sequence Number=SeqID_39806
  Gene Ontology: Cellular component=integral to membrane
  Homolog annotation: Hit_ID=Q6D4K6; Match level="QueryCoverage=35%, HitCoverage=9%, E-value=2e-19, Identity=94%"; Hit description =Putative membrane protein
  Pfam annotation: Domain name=TerC; Domain location=12-115; Score=6.4; E_value=0.00012; Accession=PF03741.7; Description=Integral membrane protein TerC family
MEFLFDPSIWAGLLTLIVLEIVLGIDNLVFIAILADKLPPKQRDKARLIGHHGTARAAGKPRHGASGQQSLCQLLGGRDADCGAGRGVLPGCGDYRRRYGEPSAGDDDGGGDCHGRDAAGLKTADPLRQRAPNGGGAVSELC

SEQ ID NO: 131492 - protein, 421 aa, Glycine max
  Coding DNA Sequence Number=SeqID_39807
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=A8GFH4; Match level="QueryCoverage=100%, HitCoverage=66%, E-value=0.0, Identity=76%"; Hit description =Helicase c2
  Pfam annotation: Domain name=DEAD; Domain location=2-239; Score= -24.2; E_value=0.0027; Accession=PF00270.20; Description=DEADDEAH box helicase
MAQAVSEAVQQAGELVVEAGTGTGKTYAYLAPALRAKKKVIVSTGSKALQDQLYNRDLPTIARALAFSGKTALLKGRSNYLCLERLEQQNQTGGDLSVQALGDLINVRSWSSETVDGDVSSCAGVAEDSPIWPYVTSTNDNCLGSDCPLYKDCFVVKARKKAMDADVVVVNHHLFLADLVVKEGGFGELIPEADVMIFDEAHQLPDIASQYFGQQLSSRQLQDLAKDIILAYRTEVRDVQQLQKSADRLAQCAQDFRLTLGEPGFRGNLRDLLSDNNIMRMFTLLDDALELCYDVIKLSLGRSALLDAAFERAALYRTRLKRLRAIDEPGFSYWYECSSRHFTLALTPLSVAERFREVMDGRKAAWVFTSATLAVNEQMSHFASRLGVDNARTLILESPFDYAQQALLCVPRNMPEPNYPG

SEQ ID NO: 131493 - protein, 559 aa, Glycine max
  Coding DNA Sequence Number=SeqID_39808
  Gene Ontology: Mol. function=pyruvate kinase activity; Cellular component=integral to membrane; Biological process=glycolysis
  Homolog annotation: Hit_ID=Q8ZNW0; Match level="QueryCoverage=56%, HitCoverage=65%, E-value=1e-154, Identity=90%"; Hit description =Pyruvate kinase II
  Pfam annotation: Domain name=MFS_1; Domain location=337-549; Score =23.2; E_value=0.00099; Accession=PF07690.7; Description=Major Facilitator Superfamily
  Pfam annotation: Domain name=PK; Domain location=1-189; Score=157.7; E_value=3.2e-44; Accession=PF00224.12; Description=Pyruvate kinase, barrel domain
  Pfam annotation: Domain name=PK_C; Domain location=201-317; Score =191.2; E_value=2.7e-54; Accession=PF02887.7; Description=Pyruvate kinase, alphabeta domain
  Pfam annotation: Domain name=Sugar_tr; Domain location=154-519; Score= -138.1; E_value=0.0014; Accession=PF00083.15; Description=Sugar (and other) transporter
  Pfam module annotation: Pfam domain module=MFS_1::PK::PK_C::Sugar_tr; Domain location=337-549::1-189::201-317::154-519
INKLAAGLSAEALTEKDKLDIITAAKIGVDYLAVSFPRNGEDMNYARRLARDAGCDAKLVAKVERAEAVATQEAMDDIILASDVVMVARGDLGVEIGDPELVGIQKALIRRARQLNRTIITATQMMESMITNPMPTRAEVMDVANAVLDGTDAVMLSAETAAGQYPAETVSAMAKVCLGAEKIPSVNVSKHRLDVQFDNIEEAIAMSAMYAANHLQGVSAIITMTESGRTALMTSRITSGLPIFAMSRHERTLNLTALYRGVTPVFFDSNNDGVAAAHDAVNLLRDKGFLVSGDLVIVTQGDVMATTGTTNTSRGQMARYQPISQLTGRVLLFPLALVLFEFATYIAHDMIQPGMLLVTAEFNVGPEWVSTSLTAYLMGGVVLQWLLGPLSDKYGRRPVLLFGILFFAAACVLTTWVSNIEQFVTLRFIQGISLCFIGAVSYAAVQEAFDEALAVRMMALMANVALLAPLAGPLAGAAWLTVGEWRSMFWLFAVCSLLAFVVLWRIMPETAGDRSHSIALPNLARGYGRLARDKQVMYGSFAIGLVFIPILTWVAHCRR

SEQ ID NO: 131494 - protein, 491 aa, Glycine max
  Coding DNA Sequence Number=SeqID_39809
  Gene Ontology: Mol. function=glucose-6-phosphate dehydrogenase activity; Cellular component=cytosol; Biological process =carbohydrate metabolic process
  Homolog annotation: Hit_ID=P0AC54; Match level="QueryCoverage=100%, HitCoverage=100%, E-value=0.0, Identity=89%"; Hit description =Glucose-6-phosphate 1-dehydrogenase
  Pfam annotation: Domain name=G6PD_C; Domain location=188-490; Score =662.8; E_value=2.8e-196; Accession=PF02781.7; Description=Glucose-6 -phosphate dehydrogenase, C-terminal domain
  Pfam annotation: Domain name=G6PD_N; Domain location=13-186; Score =330.3; E_value=3.5e-96; Accession=PF00479.13; Description=Glucose-6 -phosphate dehydrogenase, NAD bindi
  Pfam module annotation: Pfam domain module=G6PD_C::G6PD_N; Domain location=188-490::13-186
MAVTQTAQACDLVIFGAKGDLARRKLLPSLYQLEKAGQIHDTTRIIGVGRAEWDKEAYTKVVREALETFMKEKIDEALWDKLSGRLDFCNLDVNDTSHFSKLGKMLDQKNRVTINYFAMPPSTFGAICEGLGAAKLNAKPARVVMEKPLGTSLETSQEINDSVGKFFDESQVFRIDHYLGKETVLNLLALRFANSIFVNNWDNRTIDHVQITVAEEVGIEGRWGYFDKAGQMRDMIQNHLLQILTMIAMSPPSDLSADAIRDEKVKVLRSLRRIDQTNVREKTVRGQYTAGFVQGKKVPGYLEEEGANKQSSTETFVAIRVDIDNWRWAGVPFYLRTGKRLPTKCSEVVVYFKNPEMNLFKDSYAELPQNKLTIRLQPDEGVDIEILNKVPGLDHKHKLQTTKLDLSYSETFNQSHLADAYERLLLETMRGIQALFVRRDEVEAAWTYVDSIIEAWNADGDASKPYQAGTWGPVASVAMITRDGRSWNEFE

SEQ ID NO: 131495 - protein, 154 aa, Glycine max
  Coding DNA Sequence Number=SeqID_39810
  Gene Ontology: Mol. function=hydroxymethyl-, formyl- and related transferase activity; Cellular component=plasma membrane; Biological process=purine nucleotide biosynthetic process
  Homolog annotation: Hit_ID=A7MEA0; Match level="QueryCoverage=89%, HitCoverage=35%, E-value=9e-59, Identity=82%"; Hit description =Phosphoribosylglycinamide formyltransferase 2
  Pfam annotation: Domain name=ATP-grasp; Domain location=1-57; Score= -72.7; E_value=0.012; Accession=PF02222.13; Description=ATP-grasp domain
MSELALQRAQDIAANVVKALGGYGLFGVELFVCGDEVVFSEVSPRPHDTGMVTLISQDLSEFALHVRAFLGLPIGGIRQYGPAASAVILPQLDSHNVQFVNVEAALGAGLQLRLFGKPEIAGQRRLGVALATGDSTDDAVARAIASAAAVQVQG

SEQ ID NO: 131496 - protein, 213 aa, Glycine max
  Coding DNA Sequence Number=SeqID_39811
  Gene Ontology: Cellular component=integral to membrane
  Homolog annotation: Hit_ID=A7MKI1; Match level="QueryCoverage=100%, HitCoverage=98%, E-value=2e-64, Identity=59%"; Hit description =Putative uncharacterized protein
  Pfam annotation: Domain name=DUF533; Domain location=19-209; Score =261.1; E_value=2.3e-75; Accession=PF04391.3; Description=Protein of unknown function (DUF533)
MSNWLQQIQSVLAKKGGDGKTGGLSDMLAPGALGGLAGLLVASKSSRKLLTKYGGTALLVGGGAAAGAVLWNKYKQRVRETHQDEPAFGQLQTPLDQRAERLVTALVFAAKSDGHIDDRERSAIEQNIHQAGYGAQAEALIQQAMNRPLDPQWLAADVKNEEEALELYFLSCAAIDVDHFMERSYLSALGDALKIPQDVRDGIQRDIAAEKAA

SEQ ID NO: 131497 - protein, 363 aa, Glycine max
  Coding DNA Sequence Number=SeqID_39812
  Gene Ontology: Mol. function=copper ion binding; Cellular component=1- 2nm peptidoglycan-based cell wall; Biological process=cellular copper ion homeostasis
  Homolog annotation: Hit_ID=Q5PHL1; Match level="QueryCoverage=42%, HitCoverage=52%, E-value=9e-19, Identity=40%"; Hit description =Putative cation transporter
  Pfam annotation: Domain name=CopC; Domain location=2-119; Score=32.5; E_value=4.3e-07; Accession=PF04234.3; Description=Copper resistance protein CopC
  Pfam annotation: Domain name=CopD; Domain location=102-362; Score =76.2; E_value=1.1e-19; Accession=PF05425.4; Description=Copper resistance protein D
  Pfam module annotation: Pfam domain module=CopC::CopD; Domain location=2-119::102-362
MMKTASRRVIALLLAGATLGFSQLALAHAHLKAPVPADNAVVEHAPQQLTLTFTEDIEPAFSGVEMTNAQQQPVALDKAQLNPQQHDQLIVPIAQALASGQYQRVLDRPAGAAFSGAVSADRQCILYRAAGAGALPTGADTALAAADGIQRRAEFTQCAVDAGGADRADERRLAHTLALRLRGNLRQQALLTTALLQLVALAGVGHAAMRDGMPGLLQQGNHALHLIAAAFWAGGLLPLLLLMREARNIAWRTDAIRSMMRFSRYGHLAVALAIVTGTVNSLLIAGTPLNWTATLWSELLVSKALLVALMVLIALLNRYLLVPRFRLAASRAPKLFIRLTQLELLLALIVIGLVSVFATLSPA

SEQ ID NO: 131498 - protein, 353 aa, Glycine max
  Coding DNA Sequence Number=SeqID_39813
  Gene Ontology: Mol. function=methyltransferase activity; Biological process=metabolic process
  Homolog annotation: Hit_ID=A8GI60; Match level="QueryCoverage=44%, HitCoverage=65%, E-value=3e-50, Identity=57%"; Hit description =Methyltransferase type 11
  Pfam annotation: Domain name=Methyltransf_11; Domain location=1-64; Score=16.1; E_value=0.0026; Accession=PF08241.3; Description =Methyltransferase domain
MLAQAAAMTDRPGITYQRADLETLQLSSTFDVVYSSLALHYLSHIDALFATIFHALRPGGALVFSCEHPIYTASRQQEWFIDDAGQRSWPVNQYQQEGERVSNWFAAGVKKQHRKLATWINALIAAGLVIERLDEWGPDVQQVAENPALEEERERPMLGCILQPCENSPRRLSPALNQGVSSVRDGARMITDYTFNYLDGLDVHYRYKPASLDNQHLLIVMSGFNLPDPTVYDFTLLEHTRAAVLWIKDDFNGLPAYYLCNNLQFNIEHGVSQLIRAVIELTQPSDVTILGASKGGSAALYFGIRHNIRNIITAVPQFFLGDYASQIWPSVGKAMMGEISPAAVATGRSSARA

SEQ ID NO: 131499 - protein, 460 aa, Glycine max
  Coding DNA Sequence Number=SeqID_39814
  Gene Ontology: Mol. function=S-adenosylmethionine-dependent methyltransferase activity; Cellular component=nucleus; Biological process=rRNA processing
  Homolog annotation: Hit_ID=A8AFL6; Match level="QueryCoverage=99%, HitCoverage=96%, E-value=0.0, Identity=70%"; Hit description =Ribosomal RNA small subunit methyltransferase F (EC 2.1.1.-) (rRNA (cytosine-C(5)-)-methyltransferase rsmF)
  Pfam annotation: Domain name=Methyltransf_11; Domain location=106 -228; Score=-0.6; E_value=0.095; Accession=PF08241.3; Description =Methyltransferase domain
  Pfam annotation: Domain name=Nol1_Nop2_Fmu; Domain location=175-460; Score=161.3; E_value=2.7e-45; Accession=PF01189.8; Description =NOL1NOP2sun family
  Pfam module annotation: Pfam domain module=Methyltransf_11::Nol1_Nop2_ Fmu; Domain location=106-228::175-460
MRASLADEAELERFLAISQQPLRRSLRVNTLKISVEDFLTRVAGYGWQLTPIPWCREGFWIARDDESLPLGSVAEHLSGLFYIQEASSMLPVSALFDAAPDARQVMDVAAAPGSKTTQMAALMCNQGAILANEYSASRVKVLHANISRCGVSNVALTHFDGRVFGAALPEQFDAVLLDAPCSGEGVVRKDADALRNWTLASTEAIAATQRDLLDSAFHALQPGGTLIYSTCTLNTIENQQVIAWLQQRYPQALEIVPLNDLFAGAERALTPEGFLHVFPHIFDSEGFFVARLRKTASVPPLPAPTYKLGKLPFSPASRKLVAEVAQAAHKVGLHWDESLTLWQRDKELWLFPAALESWLSKVRFSRIGLKLAETFPKGFRWQHEAVVALAQPDSALAFELDEAQAESWYRGQDIHPDTPPVRDEVIVTYQQQPLGLAKRVGSRIKNSYPRELVRDGRLFR

SEQ ID NO: 131500 - protein, 83 aa, Glycine max
  Coding DNA Sequence Number=SeqID_39815
MHIHGKDHKGKGERNNETLKLMKSKQMMIFQENGELLDIILLTTSLVIVANCRNLPFGGRATRDSRDACSTKGIRVESPPTFI

SEQ ID NO: 131501 - protein, 130 aa, Glycine max
  Coding DNA Sequence Number=SeqID_39816
  Subcellular localization annotation: CTP_CleavageSite=59; ConfidenceScore=5.02e-01
MGDSISGLSFPGRRIVFHSKKACAALIGWNIGLFAKACLHFSGGNTETFSSLTRYVRAKASLFSTTPPFVAMTQELVTRGDTLQLSAPRHSVTQSVIDEQRPMWSSVPFPEMSTSSGGDFFKSHKLSRTT

SEQ ID NO: 131502 - protein, 97 aa, Glycine max
  Coding DNA Sequence Number=SeqID_39817
MGRTKEFSDCVIVEFFDKGEGRSKRIQAVSPSIFWKREKRDTKRIQAVEKRMKRMNSTSFHRFSRKPGEDFRKLLVAIKARRRSSNDSRLRKGCKLK

SEQ ID NO: 131503 - protein, 95 aa, Glycine max
  Coding DNA Sequence Number=SeqID_39818
  Pfam annotation: Domain name=zf-CCHC; Domain location=23-40; Score =26.9; E_value=7.5e-05; Accession=PF00098.14; Description=Zinc knuckle
MRGTQRRKSFKPKRRTEESSQTPRCYECNQPGHLRVECPIFKKRMEKFKKKNIGEKKAKKAYITWDDNDLESSDDSEKEVINLCLMGKNYESDEK

SEQ ID NO: 131504 - protein, 170 aa, Glycine max
  Coding DNA Sequence Number=SeqID_39819
  Subcellular localization annotation: CTP_CleavageSite=57; ConfidenceScore=5.09e-01
MSSFPSNSIIGMGSSDSRGSIQQPLVDREVISIGGSSSKDTCHGSFNNESSSLERLRVLRRAGGDISRLGGRAQPFPACPPRKPIPVTIILPPSVSRGARQSERDVRASPRVRRNHSARSLLSFPAIASFKWARDDVLKYKSSITSATSVTTLQRQVKLANPEDSYKTTI

SEQ ID NO: 131505 - protein, 380 aa, Glycine max
  Coding DNA Sequence Number=SeqID_39820
  Homolog annotation: Hit_ID=Q6WAY4; Match level="QueryCoverage=94%, HitCoverage=63%, E-value=1e-37, Identity=31%"; Hit description =Putative uncharacterized protein
MGTNQNGKRFYQVKVKSLDVTSLKELGRLMGPLQRQAFRKVYGKILDLTAAEVFTEVVVSLAQYYDQPLRCFTFGDFQMVPTIEEFEEVLGFPLGGRKPYLFSGFLPSLSKIATVVGDSAKELDHMKQTRNGVVGQPRKYLEGKARDMASQEKWGPFADILALLIFGVVLFLDVDGLVDLAAIDAFLAYHHSKESPVVAILADLFDTFDRRCEKNSARIVCCLPALCVWLVSHLFQQDTRHPCPLQSYRSCAEKGRVDWDQHLAGIGGNAINWFPRWKEGKEEVLFSCGDYPNVPLIGTRGCINYNPALAIRQLGYPMRGAPTEESLSPFLVRDLDAQSLKVIQRVHKAWRSPLKKDKELRGIRNGVIGGYHGWLRVDTR

SEQ ID NO: 131506 - protein, 62 aa, Glycine max
  Coding DNA Sequence Number=SeqID_39821
VDGDPVLRGTRIRARWGYMSSVEELICTIAQSPPSTTYDGVVPGDMSRGSGDLGDVRWGAIA

SEQ ID NO: 131507 - protein, 202 aa, Glycine max
  Coding DNA Sequence Number=SeqID_39822
MTARRSTHLGPLLHLRKDPSPHELPQPEHSPPTGFTHTRNSESSEGLGNYPILGSSGPLREERDQSWVHGMILKEELAACARSKRSLAQHLEATEQSMLAIIGQYKAELNQSVAHEQKLVEDFAQVYAEKEARGRVIDALHQEATMWIDRFALTLNGSQNLPRLLAKAKAMAEVCTAPEEIHGLINYCQHMRDLMAHIIRNR

SEQ ID NO: 131508 - protein, 55 aa, Glycine max
  Coding DNA Sequence Number=SeqID_39823
MPIGWTSQKSGADTELEEPTDLRSNPLQGGGDDTILPVEGISHQSHEQKTPRGLG

SEQ ID NO: 131509 - protein, 124 aa, Glycine max
  Coding DNA Sequence Number=SeqID_39824
MSILSISFNIVTVVYGINLKILMSHNNSFQNCPMYGVACQCYDSTSDSPQISASPYQLDFTLYASGSYNAQWIEWIWDQVWHMTTEFGMNPTGFLLQNSFSLVFFWFVLKVVFVIGSAVDRLRG

SEQ ID NO: 131510 - protein, 74 aa, Glycine max
  Coding DNA Sequence Number=SeqID_39825
CSRHEWATKNERNICIPFYVYHNKISWEYKVFHLHQNIFNHSIWSCDGAICQLKVHACRHYLKLSKSLAHGERH

SEQ ID NO: 131511 - protein, 279 aa, Glycine max
  Coding DNA Sequence Number=SeqID_39826
  Gene Ontology: Mol. function=chitin binding; Cellular component =extracellular region; Biological process=chitin metabolic process
  Homolog annotation: Hit_ID=UPI00006A17C9; Match level="QueryCoverage =51%, HitCoverage=100%, E-value=7e-19, Identity=32%"; Hit description= UPI00006A17C9 related cluster
YILCGTRRGYIYLGCYTENKRGYISCGSVQVKGTSTWLFKEIKGGYIPCGSLACKGFYKVRTCSPLKARTCSPLMARACSPLKARTCSPLKAMACSSLKTRTCSPLKVRACSPMKARTCSPLKVRACNPLKARTCSPLKVKACSPLKARTCSPLKVRTCSPLKARACGPLKARTRSPLKARTCSPLKVRVRNPLKAWACSPPKARVLVPKDDDKGDDKKLKGQSKNEFKMFKIESRKLQDSRGKLKNTSRIKRKVKFKDQASRIKIKIQDSRFKNQEKT

SEQ ID NO: 131512 - protein, 57 aa, Glycine max
  Coding DNA Sequence Number=SeqID_39827
MDGIKRPWVSCRGFLNTREGLSLCGSDFVKGVLQREWEISSGLLEDWTYAREVAEPV

SEQ ID NO: 131513 - protein, 124 aa, Glycine max
  Coding DNA Sequence Number=SeqID_39828
  Homolog annotation: Hit_ID=A5B1P9; Match level="QueryCoverage=69%, HitCoverage=6%, E-value=8e-07, Identity=34%"; Hit description =Putative uncharacterized protein
MTIEESIHVSFDESDVISPRKDVLDDVSDFLEEMHTHERDSKRKRDESNEDSQDYETKVNNDLPKEWKASRNHPFDNIISNISKEVAFELPQVGSESYWKLKVENASWKWKLLEVEVGSWKLEF

SEQ ID NO: 131514 - protein, 17 aa, Glycine max
  Coding DNA Sequence Number=SeqID_39829
MGLYMCSVVGRLLANQM

SEQ ID NO: 131515 - protein, 28 aa, Glycine max
  Coding DNA Sequence Number=SeqID_39830
MEEEKKKEKMVEDDKKQQRKKKKRRMNR

SEQ ID NO: 131516 - protein, 31 aa, Glycine max
  Coding DNA Sequence Number=SeqID_39831
MVETGMIKILESGDQAVQMTVTYKGHIPPPL

SEQ ID NO: 131517 - protein, 144 aa, Glycine max
  Coding DNA Sequence Number=SeqID_39832
  Homolog annotation: Hit_ID=A7QIT8; Match level="QueryCoverage=35%, HitCoverage=14%, E-value=1e-08, Identity=52%"; Hit description =Chromosome chr2 scaffold_105, whole genome shotgun sequence
METHEMMQGTKVYASAINRHVGLMGLSTGPLHDDREKFTKDSVREQEEYVSYLGVTYWKRMFSGASSSKSAQSTTSPFAVSIRKPIAPLNCTAYNLTGTCPTNLQDHQRSPATATCPDYFRWIHEDLRPWARTEHAPQTYNLNI

SEQ ID NO: 131518 - protein, 93 aa, Glycine max
  Coding DNA Sequence Number=SeqID_39833
MNCLSFMHPPDEDMTKSKGKDPLEGLGGPIDEDMTKSKGKDPLEGLGGPMTRARARKAKEALQQVLSILFEYKPKFQGEKSKVVSCIMAQMED

SEQ ID NO: 131519 - protein, 219 aa, Glycine max
  Coding DNA Sequence Number=SeqID_39834
  Gene Ontology: Mol. function=oxidoreductase activity, acting on NADH or NADPH; Cellular component=mitochondrion; Biological process =electron transport
  Homolog annotation: Hit_ID=A7QCZ4; Match level="QueryCoverage=37%, HitCoverage=27%, E-value=2e-42, Identity=95%"; Hit description =Chromosome undetermined scaffold_79, whole genome shotgun sequence
  Pfam annotation: Domain name=Complex1_49kDa; Domain location=1-164; Score=-87.9; E_value=1e-06; Accession=PF00346.10; Description =Respiratory-chain NADH dehydrogenase,
MPPEAYENDSSRMKGNYHWWAYPSQPGVCWDSRRAAPYDVHDQSDPDVPVGTRGDRYDRYCIRIEEMRQSLRIILQCPNKIPSGMIKADDRKLCPPSRCRMKLSMESCAVIPRLAHLVGRGEALGTSISFFGAVSFPVPPPRHSASLPVLRKNPLTSPFFIDLGEKEPSTSWQARHQGGALPHRRRTRGSVRGGASGFQCTASKIRTSLPADHCRPILE

SEQ ID NO: 131520 - protein, 77 aa, Glycine max
  Coding DNA Sequence Number=SeqID_39835
MKYGSILFGWRTHERKRNSWGLHEKRARMEDCTSGSSLVNHEAQLQTLWVERYMNENAIHGAPEKRREWRIALEGPH

SEQ ID NO: 131521 - protein, 101 aa, Glycine max
  Coding DNA Sequence Number=SeqID_39836
MEKELGTLEMVLEERKEKRWRFFLSYLDHKAQNAQVSNALGNGNVAHTPNIFSEIPTMQTKFREDPTVKEGWAVFLPRQLHVASLRSFIKRLPREVFSWLL

SEQ ID NO: 131522 - protein, 53 aa, Glycine max
  Coding DNA Sequence Number=SeqID_39837
  Homolog annotation: Hit_ID=Q10I04; Match level="QueryCoverage=100%, HitCoverage=3%, E-value=3e-08, Identity=50%"; Hit description =Retrotransposon protein, putative, unclassified
MENSKHLATPMSTGCYLDKDEFGQPIDEKQYRGYSNSDFSGSKTDRKSTSGTC

SEQ ID NO: 131523 - protein, 99 aa, Glycine max
  Coding DNA Sequence Number=SeqID_39838
MSAGKYQSRLYNDRCRLIKVILVASTLTYLPSPESGVYPDLSSFIGSGVYPDLSSFTGSGVYPDLSSFTGSGVIQISVTCIKRSAPTQVHIIWYQSFSS

SEQ ID NO: 131524 - protein, 209 aa, Glycine max
  Coding DNA Sequence Number=SeqID_39839
MEKASVNAIQEDGPSRARRLGEVATSRRFIYQSLQAACMVSRGGGERDECLFHLGESHDMETCPAVEGLLQRLMDCGQLEVSIGGREEPQICMQSEEKKVPLTPKALVICFTRKGTDSTPIYPRTAPKPTPFAYQSNKAVPWKYTPPAFSERVATEVDSLSAKVTNITGLSGVTRSGRVFASPHPAELPSKGKAPMVQEPTNVATPSKE

SEQ ID NO: 131525 - protein, 33 aa, Glycine max
  Coding DNA Sequence Number=SeqID_39840
MGIFNFHRNWVQAISLFAQATCAPEFGLPRPFN

SEQ ID NO: 131526 - protein, 289 aa, Glycine max
  Coding DNA Sequence Number=SeqID_39841
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=68%, E-value=1e-139, Identity=74%"; Hit description =Photosystem II P680 chlorophyll A apoprotein
  Pfam annotation: Domain name=PSII; Domain location=1-283; Score =349.4; E_value=6e-102; Accession=PF00421.10; Description=Photosystem II protein
LYGPGIWVSDPYGLTGRIQSVNPAWGVEGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQ

SEQ ID NO: 131527 - protein, 89 aa, Glycine max
  Coding DNA Sequence Number=SeqID_39842
MYKDNWTQPWPMGSQIYPKAHENPRAFSCIFGPIFLESSIQCPWGGQDHLELPSGVETKNEQQKPIKVHRDECEWGWGHDRPIVAPSLR

SEQ ID NO: 131528 - protein, 157 aa, Glycine max
  Coding DNA Sequence Number=SeqID_39843
GTTRRHHQEGCNALTFRGLHVLALERATRPHLGAARPHLQRTTRPRLERTTCPHLQRATCPRHQRTSCPRHQRAARSSPPEDLHVLTIRGLHALTIRGLPVLALRGLHALTLGTSYPHQSEDYTGLHVLAFRGLHALTFRGLHVLALRGLHAPHLGY

SEQ ID NO: 131529 - protein, 279 aa, Glycine max
  Coding DNA Sequence Number=SeqID_39844
  Homolog annotation: Hit_ID=UPI00016621D1; Match level="QueryCoverage =64%, HitCoverage=41%, E-value=8e-16, Identity=33%"; Hit description =UPI00016621D1 related cluster
GGPFGTSTLTFRGLHVLTFRGLHALRGLHVLAIRGLHAITFRGLHVLAFRGLRVLAIRGLYVLAIRGLHALSFRGLRVLTFKGLHALAFRGLHALTFRGLHVLTFRGLHILAFMGLHTLSFRGLHALAFRGLHVLAFRGPHALTFRGLHVLTFRGLHVLAFRGLHTLSFSGLHTLAFRGLDALVFKGSVPGPPPDLGGGPTVRAQLEEEAIVQPLCILGQDFTHAVTKRRVRIIWGRAHKTPNGPGEVQQGPGVSSLGYGPLSVLQGARSPQQGHTIMT

SEQ ID NO: 131530 - protein, 127 aa, Glycine max
  Coding DNA Sequence Number=SeqID_39845
MTRGNPSDLQPFDPEIDRTFHRLVRHHFIPFDHSKHSITGESVHSVIGDFEHPDLEHSDSEHSDSEHFDFAHSENMAQPPPRERTLREMVALDFTYESLCIQYPYEDVPYVRKTGLIHLLPKFHGLA

SEQ ID NO: 131531 - protein, 53 aa, Glycine max
  Coding DNA Sequence Number=SeqID_39846
MVIFHHEDAAEDKGEELAEDASIEEKKEGGKEGGKERGDSMNLKEETGREVEL

SEQ ID NO: 131532 - protein, 56 aa, Glycine max
  Coding DNA Sequence Number=SeqID_39847
  Subcellular localization annotation: CTP_CleavageSite=36; ConfidenceScore=5.11e-01
MCLPSASQAHQASRLSLLALSAPSSLSQISLSEPISLSEPSEAETSKLNLLVGKFC

SEQ ID NO: 131533 - protein, 271 aa, Glycine max
  Coding DNA Sequence Number=SeqID_39848
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-42, Identity=31%"; Hit description= UPI00006A17C9 related cluster
  Subcellular localization annotation: CTP_CleavageSite=30; ConfidenceScore=5.50e-01
MACSPLKAMTCSPLKARACSPLRVRMCIPLKARAWSPLKVRTCSPRKARTCSPLKARACSPSKVRACSPLKAGACSPLKARANRPLKMRACRPLKARACSLLKARMCSPLNARTCSPLKARTCSPQKARARSPQMARTCSPLNRRTCSPMKATACSPLKAETCIPLKERAYSPLEARACSPLKERTCIPLNMRTCSPLKARACSPLKVRTCSPLMTRTCSPLMVRTCNPRKVRACIPLKARTNSPQKLRACSPLKAMTCSPLRAKTCSPLK

SEQ ID NO: 131534 - protein, 285 aa, Glycine max
  Coding DNA Sequence Number=SeqID_39849
MSWKRTHYFSMPTTKTMIMRGQDKATTSPFSSENEEAKGEESSEEIYPQEEGQPLVVKEKCKEVSVSSKRLAKKETNFTIKTNIKETFPLRQPPHFLFCKKTLASIATPLGLEFIPQVKKLLEEGLVRKSLNPCALLVPKIGIIRHQVPKIGGMINVLSGATLFCKITRTPNIFMVCVHRDPLGSDQGVPMNPKRIKVIPEWPTPPTPLIELVRNHVPSWEDAQEMGFQTLPYFNFPNTTNIYVLVFFFTLVEEKSPKFQEPQDLRSNSFQGGGNDAILPHKGIG

SEQ ID NO: 131535 - protein, 99 aa, Glycine max
  Coding DNA Sequence Number=SeqID_39850
MEFYATPWPTKEGVMDKHSSMRGQWIPYDEDAINQFLGHLLILEEGQHYEYAEKRGQVSSFDEEAIGQLLCSPRQDFAQSVTGRRVRIMHTSMTILTQI

SEQ ID NO: 131536 - protein, 184 aa, Glycine max
  Coding DNA Sequence Number=SeqID_39851
MSVHVAQVIADTIYLFVGMLPTRHPLDPDKSNRALVFLALITGLCQLFGVPVTPTKVIRPPITRAFIEKYCTPRQAQGDAPQAVDAPPPPHQVDPAGSLGMERYLQHLIHECLYRFSLSQQGQGFAPFACPTPEQFGAKVAWPKDWPEAQAGEEPARSPGEAEEARMDEEMTDLLGFLGRSGAT

SEQ ID NO: 131537 - protein, 78 aa, Glycine max
  Coding DNA Sequence Number=SeqID_39852
MVVNECVIDICRDITCHVSYELYSKPDQKVRPKRILQSLGLGGKDTRFECSFKPMLIPCGWGILAKQSNPDWSPYDVT

SEQ ID NO: 131538 - protein, 134 aa, Glycine max
  Coding DNA Sequence Number=SeqID_39853
LCQSFGVPVAPTKVIRPPITRAFIEKYCTQRQAQGDAPQAAGAPPPPHQAGQAGAFDMEQYLRHLMSLSMQSQGFASFSCPTPDQFRAEVAWPGDWPEAQAGEAPPEAPDGGEEAHEDEEMADLLDFLGGSGDT

SEQ ID NO: 131539 - protein, 104 aa, Glycine max
  Coding DNA Sequence Number=SeqID_39854
  Gene Ontology: Mol. function=zinc ion binding; Cellular component =intracellular
  Homolog annotation: Hit_ID=Q1E3W1; Match level="QueryCoverage=83%, HitCoverage=10%, E-value=4e-30, Identity=68%"; Hit description =Putative uncharacterized protein
MESVRIDCPKQRPQICFLCLGNPELPLKDRPLKHSTPGSLTRHFLRKHVNPPWPAKGVTCTVCDGKPLQQKSELLNHAEGSHGTVVGGTTRLMLAQEVDARLKW

SEQ ID NO: 131540 - protein, 152 aa, Glycine max
  Coding DNA Sequence Number=SeqID_39855
  Subcellular localization annotation: CTP_CleavageSite=83; ConfidenceScore=5.52e-01
MSGRSSTCQFPSRKPGGHGRTKSDPLGESSSHITTTWPSWRAPFDFSSQSRALTSALPSRNTFPYVQRFSLGDLSPEYPRLKLCRQVGGCKQATATGHAAQPRDIGHLGSQRADVGGLFFPFTWRCIPPRDCVVVSVWERNRFNYREVSGLW

SEQ ID NO: 131541 - protein, 143 aa, Glycine max
  Coding DNA Sequence Number=SeqID_39856
MAAQLIHDRVVMECLEGVWETLEGNERCRFRGMIRLTATSLVHPEEPARTLQRTVEWILPTPTPYRLVEPVQVIEVSSSEEDPKEDPEELPPEPTVDALDFPEDDEDPLPDVDSPEDIMSASEANSTEESGPGGTANSGDSSS

SEQ ID NO: 131542 - protein, 70 aa, Glycine max
  Coding DNA Sequence Number=SeqID_39857
KSQLAAFLACSKSKESLAQNLKEVLQLLRQEVEEVPPKKEAESSETNDDQEDDPFYQNEDDCSGISLDDD

SEQ ID NO: 131543 - protein, 59 aa, Glycine max
  Coding DNA Sequence Number=SeqID_39858
MHRVSSMIQNVLALGNVFSVHGEAFQCVSRLRCQQLRGGDDEGSAAGNRETTGKVTESE

SEQ ID NO: 131544 - protein, 68 aa, Glycine max
  Coding DNA Sequence Number=SeqID_39859
MCTYALFGSQSALSMHEMAPRKLASKRSRKDKAAEGTSSAPEYDSHRFRSAVHQQQFEAIKGWSFLRE

SEQ ID NO: 131545 - protein, 69 aa, Glycine max
  Coding DNA Sequence Number=SeqID_39860
GQDHLELPSGVRTKCGQQKPIKVLRNGCKWGWGHELIVPFLCAYGQLSRTSNCGSPVPLYMGWSCLTIV

SEQ ID NO: 131546 - protein, 90 aa, Glycine max
  Coding DNA Sequence Number=SeqID_39861
MYKDNWTKPWPMGSEIYPKVHENPRAFFSSSSPILLEPLAHGSSDWSLPREDYITRDVLKDQGRGEKAIRRWLFLCSSIPRMGSQYCASP

SEQ ID NO: 131547 - protein, 134 aa, Glycine max
  Coding DNA Sequence Number=SeqID_39862
MTLLLSNILPSDHKVNLPLQKYQLVCVVPTWGSHSQRHPVDLKKSNRALVFPALVTGLCHSYRVSVPQQGIAPASHLVDPEKSNRVLGFLARIMGLCQFYRVPVDPSKVIRPPTNRAFIKKYCAPRQAQGKTSQ

SEQ ID NO: 131548 - protein, 153 aa, Glycine max
  Coding DNA Sequence Number=SeqID_39863
NSHLPCLADTSGKIIITTACSVSGKTTSKAGSDEVNDPLYLMTLTILELFLRPYQVRWDATVLGVFNPDFPLYIKHEDLSEIAHGGQCLSISVLRLWILSGQSQFESESYIKSWMQCSQRDVYLGAYLNGAIKGLDDAPQPKSKASARWIVVK

SEQ ID NO: 131549 - protein, 301 aa, Glycine max
  Coding DNA Sequence Number=SeqID_39864
GLHILAIRGLHALTFRGLHTLAFRGLHPQTSEDYTSSPSEGYTSSNFRGLHILTFRVLHVLTFRVLHVLTFRVLHVLTFRGLHAIAFRGLRVLTFIPGPPPNIGGRPTVQAQLEREAITQLLCIPGQDFTRAAAKRQVWIMRTNMTTFTQIWMTLLLSNVLPNDRNVDLPLRKDRGYKTPSGPGEIQQGPGVSSSGYGPLSVLQGARTPPTKSCHRDIGKDRARKTPNGPEEGQLGIGVASSNYGPLLVLRSAPLPPASSSGPLLTGFSSRSTAPPGRRKAKHHSSLGRAGSGQQAHRHHL

SEQ ID NO: 131550 - protein, 89 aa, Glycine max
  Coding DNA Sequence Number=SeqID_39865
  Subcellular localization annotation: CTP_CleavageSite=23; ConfidenceScore=5.06e-01
GSRSRHQRLFEKNAGKTRMCGLRTLSVKGSGVVFTHGEGVFLAPTYSSIAMRKSDLRSSLRVVDKSGAFAPMYPRFVVRNSDLRSSCKS

SEQ ID NO: 131551 - protein, 83 aa, Glycine max
  Coding DNA Sequence Number=SeqID_39866
MGHLRLVVLFGRNNQHENTEKDQGVLMDLRRIKVIPEWPTPPSIRKIWGFHDLTNFYKRCCGKKPRASRTSRFEVKSFSKGRE

SEQ ID NO: 131552 - protein, 100 aa, Glycine max
  Coding DNA Sequence Number=SeqID_39867
RQNLVILHPLSSRGGGPDDTRRQNLVILHPFAIQTQSCPMRQNLVILHPLSSRGGGPMTRGDKIWSFRTPLPFRHSRVRWYAETKLGHSAPFVIQRRRAR

SEQ ID NO: 131553 - protein, 59 aa, Glycine max
  Coding DNA Sequence Number=SeqID_39868
GSRQNPYAMPMQKTQCGNVHSMTIFTEHKQKGIIPFEEHIVAVGTTSNNRFSKRKALDE

SEQ ID NO: 131554 - protein, 164 aa, Glycine max
  Coding DNA Sequence Number=SeqID_39869
  Gene Ontology: Biological process=transposition, DNA-mediated
  Homolog annotation: Hit_ID=Q1J7G7; Match level="QueryCoverage=20%, HitCoverage=48%, E-value=8e-12, Identity=97%"; Hit description =Transposase
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSMTIDFDQAISQTINEEEEEDILSPELERLISQEEREMKPHQEETELIN

SEQ ID NO: 131555 - protein, 99 aa, Glycine max
  Coding DNA Sequence Number=SeqID_39870
MESLPLLVFGSPKTKSMDKSIQGYSGIGNGCCHVFDEDMTKSKGKDPLEGLGGLMTRARARKAKEAFQQVLSILFEYKPKFQGEKSKVVSCIMAQMEED

SEQ ID NO: 131556 - protein, 90 aa, Glycine max
  Coding DNA Sequence Number=SeqID_39871
MSNLAEVAYHSELHNSLSVHLCAKPKTFSDELAKMASRKRKATASRPEEPYDTTRFISEVTWERYEQNVHSRNILPERNITLYVTEYDEF

SEQ ID NO: 131557 - protein, 318 aa, Glycine max
  Coding DNA Sequence Number=SeqID_39872
  Pfam annotation: Domain name=Transposase_23; Domain location=143-213; Score=-1.4; E_value=0.0017; Accession=PF03017.5; Description =TNP1ENSPM transposase
ALAVDKDGVDDTDVRKKAQAIQKQNTAPHVLSRGGYEYLEQKLMAEKIKKRLEEVAQSGSTEGVIDPPSPIRRHAKWKMARTKKTGPTVADPTNQRPSGGVDHRKSDLAGDGILQPDAIPVSVSDAITRTCIASGAIGNDPETGDSDKCGLYIKENPSHLVVLGKLYEGYTAVHNIPLLHGQVKVGVEEVKDAEASVPVPTDEVALVGQALKTFLAWLTHLVKRLSEQAAVSPAKPPESPDHEVDDPLYLMTLTIPQLFLKPLQVMWDATIALKGLDDTPQPKSKVVARWIVIKYFNDVRPLEAERFKVFASSGHNIV

SEQ ID NO: 131558 - protein, 134 aa, Glycine max
  Coding DNA Sequence Number=SeqID_39873
MRKFSSIRFGDRSHLQEKQRKKKEERTAQPSLEGTQSSESSSAFPNLRESEVGASEAHIMAEDQPRRVTLEDYSSSIVPQFFTSIVRPKVEAHNIIYHHSLIQLIQGNLFHGLPNEDPYVCLATYIEICNTVKL

SEQ ID NO: 131559 - protein, 58 aa, Glycine max
  Coding DNA Sequence Number=SeqID_39874
MGLMKERGMEKEEREESHFKEKMSLEEAHHHRRSWIRAWRKKEMNGRERKRKARNFVL

SEQ ID NO: 131560 - protein, 49 aa, Glycine max
  Coding DNA Sequence Number=SeqID_39875
MEVEEPWLGLWLPLHYRVDRGASFVADLGVAFVNDWVFLTGRVVGNEKD

SEQ ID NO: 131561 - protein, 50 aa, Glycine max
  Coding DNA Sequence Number=SeqID_39876
MAMFYCSPMVGAKCTYQDSELAHVRVDVAKVNVFHVGVAVVSMSREYEGT

SEQ ID NO: 131562 - protein, 92 aa, Glycine max
  Coding DNA Sequence Number=SeqID_39877
MTFITMINFEQKRVLHRWNWHFYDGRHVFKANVVVEGGCFYIGRKRTVLETRDKRSRAYSSIDVESTAFYIVLGSRTTLFLTFSTMVILQTM

SEQ ID NO: 131563 - protein, 177 aa, Glycine max
  Coding DNA Sequence Number=SeqID_39878
MASRKRKSIGSRPTTQYDTRRFHSFEAWTWYTDNVLGRHILPERKVEIYHTELDEFKAKLERHNFHKRLTNLVDNNIDLALVKEFYATLYSSEGPSLKQVRVRGHLVRIDADNLNTFLETPVLLAKGETLPAYSRYCRLPTNIREIEATLCIPGRGFVLNAEGHPGNILRKDLTTLS

SEQ ID NO: 131564 - protein, 189 aa, Glycine max
  Coding DNA Sequence Number=SeqID_39879
ETLPAYFRYCRLPTDIKEIEAALCIPGRGVLSYSNLAPTSHTSNLTVDRARLIFGLVSQMDMNVGALISGQITSMAQSNSSRLGFPALITALCKSRGVASDSLVFERLSPVINLAYIRKNYWNPDDLTVTIRGARRARTRLAEAPSTSTAPPPARTLATPSAPASADFQRLEAILQSIHQGQIILLQSL

SEQ ID NO: 131565 - protein, 162 aa, Glycine max
  Coding DNA Sequence Number=SeqID_39880
  Subcellular localization annotation: CTP_CleavageSite=39; ConfidenceScore=5.07e-01
MTKARVLPKPVAALTLTSLKLQSRGMVATLTGVQNLKPECGRGRGGQGEGWCRGRRSEGERDRGWKSKRMWWDVGFMEKRAGTDNVQVEQHLGESDSRSNINLVRESLSDPTLNAFDIDNLVLNDNVKYHFSTKEELLDDGNKDDGGGGDIEDDLIRGLMNI

SEQ ID NO: 131566 - protein, 102 aa, Glycine max
  Coding DNA Sequence Number=SeqID_39881
MCFLISEVVIIKKGEIVEAKLLGESKVIQRCFDDNDDKKLKDQSKNNSSKSRRIQDSRRKFRVKNQDSRFKISRIKIQGSRSQESRSRFKIQDSRFKNQEKA

SEQ ID NO: 131567 - protein, 169 aa, Glycine max
  Coding DNA Sequence Number=SeqID_39882
  Gene Ontology: Mol. function=hydrolase activity; Cellular component =cytoplasm; Biological process=nucleotide metabolic process
  Homolog annotation: Hit_ID=A7NXS6; Match level="QueryCoverage=50%, HitCoverage=40%, E-value=3e-37, Identity=90%"; Hit description =Chromosome chr5 scaffold_2, whole genome shotgun sequence
  Pfam annotation: Domain name=Ham1p_like; Domain location=13-114; Score=-57.7; E_value=1.9e-05; Accession=PF01725.7; Description=Ham1 family
MAAARGLVLSRPVTFVTGNAKKLEEVRAILGNSIPFQSLKLDLPELQGEPEDISKEKARMAAVQVNGPVLVEDTCLCFNALKGLPGFMLRARIFGVCALHASSALDLAMFRQWLLKLENLQGLLLKFGIRNYEVATDMLMQHPRPFNAGKLIWTASARVEISSNRQDNA

SEQ ID NO: 131568 - protein, 271 aa, Glycine max
  Coding DNA Sequence Number=SeqID_39883
  Homolog annotation: Hit_ID=Q2HSV3; Match level="QueryCoverage=63%, HitCoverage=27%, E-value=2e-15, Identity=34%"; Hit description=IMP dehydrogenase/GMP reductase, putative
MSHNRQLGGYITLLQHFSSVADSTTDQEYDEDSPRACRWIAMKKTVKSIRTPTYRERLDRLRIPDVCWYGEHRSVRDFHIRSCYSDLLRWRPVAVYYRPERVVRQFGYTQTIPAPPVDSWVSYDDIHDRWMHYSDHIVPAGEVCVVPGQCSSDYMDWFFRISHPFMTPGHALDPLPHGHALQPRVVPQAPQTNIPHVPELGASLTSLEEPRHAEVCDDIAERLKRYLSQRVVTPSSSTHEVIEECLRLARSVTKDHLVYVRSRRRRRTNQT

SEQ ID NO: 131569 - protein, 134 aa, Glycine max
  Coding DNA Sequence Number=SeqID_39884
  Subcellular localization annotation: CTP_CleavageSite=46; ConfidenceScore=5.06e-01
MYVYEKGILVIRKQPSNFPIAVFAIAGNNGGKNKTRRRNLPRRRSRNAKKKQKRKEEANPHLPPNHGNNGDWGGSLGRRRRMKKMESRRRRRRLKKQKTPRKKKQNSEEEEAESRRRREREARGLFFKKKYSGA

SEQ ID NO: 131570 - protein, 104 aa, Glycine max
  Coding DNA Sequence Number=SeqID_39885
MGRVLQTETYTRRVFDQQKKMKNFLGILLSTVMDIGAEFLSKKACMNETSQCLTKRDFYLQAAGCRDRIKQTMTMANDDGACATIQTSRQSEEGDDQACGNILG

SEQ ID NO: 131571 - protein, 59 aa, Glycine max
  Coding DNA Sequence Number=SeqID_39886
MRGCCKVPFCGRRVTRGMRVPRKEYARSRHQHLFEENVGKIEGKPVKNENSQFGSSIYA

SEQ ID NO: 131572 - protein, 45 aa, Glycine max
  Coding DNA Sequence Number=SeqID_39887
MGSKIYPEVHENPQAFFNSSSPILLEPLAHGSVLALQTKLFIKLQ

SEQ ID NO: 131573 - protein, 280 aa, Glycine max
  Coding DNA Sequence Number=SeqID_39888
  Gene Ontology: Mol. function=UDP-glucose:glycoprotein glucosyltransfer ase activity; Cellular component=endoplasmic reticulum; Biological process=protein amino acid glycosylation
  Homolog annotation: Hit_ID=A7PYK4; Match level="QueryCoverage=21%, HitCoverage=5%, E-value=4e-22, Identity=63%"; Hit description =Chromosome chr12 scaffold_38, whole genome shotgun sequence
MLCCSQDSLKEQTIQGNIVPHSRDDILNTTIGRPEHLGRVCVAGTGVIISQYFGQASHGSNTSSASISQQQLVEIIGNLKEEGRKEVEEENKNLQEAWRRKLVALGRVYGSSSTIHNVPYADDVIRIKFVRQAIGTFVGWLTYLVKPISDEPIELSWDGTKFGIPNGSSLNSNFLKWASCFIGSNKSSIKAEKSPQVIFVDVDHVVRVYMGVLYDMDIRGKPLAYTPFCDNNKEMGGYRFWRQKFRETTAGDNLRVIYETLAKDPNSLANLDQMLNGSWV

SEQ ID NO: 131574 - protein, 334 aa, Glycine max
  Coding DNA Sequence Number=SeqID_39889
  Homolog annotation: Hit_ID=A5B5V0; Match level="QueryCoverage=65%, HitCoverage=48%, E-value=5e-09, Identity=24%"; Hit description =Putative uncharacterized protein
MEEPSKKRKGTSSRSQRHSGSQETPISSSIPSGSLFSSEEQRIRYTNLFFSCSIIDPKFIDMDFFSNESFECFQAFENSNLIPFMSLKLPVYSDLVKAFYSNIEIHEGTLMSEVYGIKMVIDQSLFYDLTQLPSEGVPFEGALIDDWKFDFSVHDARRLVCTNQADMTGRLLGGSLAFESRILHYIIVRILLPRSFNLAQVSEEDLIVMWAFHKGLQIDWAHLVRYCMHKALRLNAPLPYPHLVTLFLQHFNIPLDSEPYVGEEGRDGEDSSLLSKILDRFDGLQTFVGEKFDTLELQVNMSFNEMESRITKVEEDVSYIRSSFDLPPPPPPSS

SEQ ID NO: 131575 - protein, 78 aa, Glycine max
  Coding DNA Sequence Number=SeqID_39890
MCFHEENSSRGASVTHPRCFREQIHKDFPPFFTGLHPFFVLSSVFNRSKSSAFVDHPKRSLMVQHLNVSLLFKNQKIA

SEQ ID NO: 131576 - protein, 171 aa, Glycine max
  Coding DNA Sequence Number=SeqID_39891
MSCPVIITPTFLCRNVSWCMPPTRHPLDPDKSNRALGFPALITGLCYSFGVPVTPSKVTRPPITRAFIEKYCTPRQAQGDAPQAAHAPPPPHQADPVGSLGMERLSQQGLGFVPFACPTPDQFRTEVAWPGDWPKAQAEKTPAGAPDDAEEARMDEEMTDLLDFLGGSGAA

SEQ ID NO: 131577 - protein, 127 aa, Glycine max
  Coding DNA Sequence Number=SeqID_39892
  Gene Ontology: Mol. function=zinc ion binding; Cellular component =intracellular membrane-bound organelle; Biological process=positive regulation of abscisic acid mediated signaling
  Homolog annotation: Hit_ID=Q54SG5; Match level="QueryCoverage=70%, HitCoverage=30%, E-value=2e-16, Identity=40%"; Hit description =Putative uncharacterized protein
  Pfam annotation: Domain name=PHD; Domain location=81-125; Score=-5.4; E_value=0.056; Accession=PF00628.20; Description=PHD-finger
  Pfam annotation: Domain name=zf-C3HC4; Domain location=82-122; Score =47.0; E_value=6.6e-11; Accession=PF00097.16; Description=Zinc finger, C3HC4 type (RING finger)
  Pfam module annotation: Pfam domain module=PHD::zf-C3HC4; Domain location=81-125::82-122
MASISPVQRLDILEALEDSVGDFSDMGITDGIFNARRDFTDADYEMLLALDEGNHQHTGASSNLINSLPQSTIQTDNFTDACAICLETPVQGEIIRHLPCLHKFHKDCIDPWLQRKTSCPVCKSSIT

SEQ ID NO: 131578 - protein, 36 aa, Glycine max
  Coding DNA Sequence Number=SeqID_39893
MRKPKCALSAKALTKHKEAEGKDIKSQSYPKLGLIA

SEQ ID NO: 131579 - protein, 37 aa, Glycine max
  Coding DNA Sequence Number=SeqID_39894
MAVQKTKTEKTKGEKLQKKRNEQEDAEEVNLFFFGEF

SEQ ID NO: 131580 - protein, 240 aa, Glycine max
  Coding DNA Sequence Number=SeqID_39895
  Homolog annotation: Hit_ID=Q2HTA0; Match level="QueryCoverage=96%, HitCoverage=34%, E-value=1e-10, Identity=26%"; Hit description=IMP dehydrogenase/GMP reductase, related
HLDAFRDLAHCGSYAWGAVALVPMYDQLNEASQSTTRQIAGVHDCVTDDGYNETSPRACQWLTTKAYMKGLPASPYQTRIDALRITDVCWMPYGDHQGVRAFDFISCFQERVVRQFGYVQTILPLPISVTLSYEDIDDRWMHFSDHLALIGQICLVPRQVSRDYMEWFFLISYPFITPTQAVGPMVAKGGPSQASDPPRHAMDACEAIAERLERVLNLRMVTSDGNVYVRARRRRCTNHS

SEQ ID NO: 131581 - protein, 241 aa, Glycine max
  Coding DNA Sequence Number=SeqID_39896
  Homolog annotation: Hit_ID=Q2HTA0; Match level="QueryCoverage=78%, HitCoverage=40%, E-value=3e-25, Identity=42%"; Hit description=IMP dehydrogenase/GMP reductase, related
  Pfam annotation: Domain name=DUF1723; Domain location=16-65; Score =32.9; E_value=1.2e-06; Accession=PF08330.1; Description=Protein of unknown function (DUF1723)
MTVTGLSSFIACLLVTGDRGLLYAFAERWHEETSNFYLPIKELAIILDDVASLLHLPIIGCTLFANKSATHISVVFLDAFHDLNQFGGFSWEVAALVHMYKNLNAASKHLTKHLVGYITLLQDYHERKSHACRWKCRKALLVTTYRKYLDRLTPNVVYCVPYGDHYAFKEFELISLFSRHIKWDLSIIKHQPERVLRQFGYVQSIPPLPTTPSLSTKEIDYRWLQFSQYLAPVGEFCSFSG

SEQ ID NO: 131582 - protein, 211 aa, Glycine max
  Coding DNA Sequence Number=SeqID_39897
MKASEGTLTQAQPITLHLNTLGQHADLAQSHLYGLLHDHMPLVADTIEPTQPMVEERFKVVEGSNYGRTEAADLCLVLDVIIPLKQYNYNIDLTPDRFELQNMSKKECETFKESAETRVLSESSSESLRCVRERLRFSDYGKLNPLLDLPWSFNSGNWSDSKVLDSVGLSCCAITRNRGICGQGLIRTRLGYHEESGSSSPGDNIGTHEHC

SEQ ID NO: 131583 - protein, 87 aa, Glycine max
  Coding DNA Sequence Number=SeqID_39898
MKLEETLAKFMQLAERPSSSFSANIEKNPKEECKVVMTRSRMAIQADESRVEQKVEGYKQQLATKPALEPVSNLIKLEEVVEDEDDQ

SEQ ID NO: 131584 - protein, 110 aa, Glycine max
  Coding DNA Sequence Number=SeqID_39899
MMEAMMSIRRMMEVNRTIVVAVRGRSVGKCRQPPFCAGSEQAFLFNQVNRLASDMVGQGSEVLGSVGSPHFVQVQNKHSFPPYGLPPNYTPPNVVYAPDENVVKQVASIT

SEQ ID NO: 131585 - protein, 256 aa, Glycine max
  Coding DNA Sequence Number=SeqID_39900
MRGNIQKVEELRGHEGCERRGTSKIDPGSVLDNRGENNDDNADKHVEGSDSDTNGSMVVAKDNVEALEEKDDDTDVEYHGFDDLDYATNALKLFKFEVRFGFLDQCIIVNEGNLGIANWVVAFSFERREKGSGTSVRVCKALSLSIRVCMVFSMVLGFDGNDKHAMEGITTTNVIFYDTVSKAILYGTVLESIAVTIFCSSFSFSLDLSPSSSPLYPPSRTYSLCSGVRYRKSLPQAYEYEACWTCTLSSKHFSVL

SEQ ID NO: 131586 - protein, 344 aa, Glycine max
  Coding DNA Sequence Number=SeqID_39901
  Gene Ontology: Mol. function=ubiquitin thiolesterase activity; Cellular component=nucleus; Biological process=ubiquitin-dependent protein catabolic process
  Homolog annotation: Hit_ID=A7QNS3; Match level="QueryCoverage=48%, HitCoverage=16%, E-value=2e-78, Identity=80%"; Hit description =Chromosome undetermined scaffold_134, whole genome shotgun sequence
  Pfam annotation: Domain name=RNase_P_p30; Domain location=106-253; Score=-25.2; E_value=0.036; Accession=PF01876.7; Description=RNase P subunit p30
  Pfam annotation: Domain name=UCH; Domain location=164-342; Score= -68.8; E_value=0.0074; Accession=PF00443.20; Description=Ubiquitin carboxyl-terminal hydrolase
  Pfam module annotation: Pfam domain module=RNase_P_p30::UCH; Domain location=106-253::164-342
MRELAPQLLEGQGYFDLNIPYPEPSPANKAIEQGNRTGLAVKAMELGYIGIAYNRMIKGIMSDHHRCSISPLILSSFLNVLPSLSLSANLHHHLLHVPLSTPFRQYTRLTVCVDSASQAQALNLGNPILKTYDLVIVKPLNQIAFDLACERMEDDIVSIDFSVKLPFRLKQPVAVYHMPTTENDMPSRSIPLALQILFYKLQYSDTSVATKEFTKSFGWDTYDSFMQHDVQELNRVLYEKLEDKMKGTVVEGTIHKLFEGNHMNYIECINVDYKTTRKKSFYDLQLDVNGCPDVYASFDKYVEVERLEGDNKYHVEQYDLQIQLKRFEYDFMWDTMVKVSSPID

SEQ ID NO: 131587 - protein, 217 aa, Glycine max
  Coding DNA Sequence Number=SeqID_39902
  Gene Ontology: Mol. function=nucleotide binding; Cellular component =cytoplasm; Biological process=response to stress
  Homolog annotation: Hit_ID=A2Q3S0; Match level="QueryCoverage=50%, HitCoverage=18%, E-value=9e-28, Identity=56%"; Hit description=Heat shock protein Hsp70
  Subcellular localization annotation: CTP_CleavageSite=64; ConfidenceScore=5.20e-01
MKKKTKTKTTFLPTNTTTFRVKLPTRLTYSLKFNVDELASVYDFRIDKFQRQAILAFLRGFSVVVSAPTSSRKTLIGEATAECEYLLTTAFHAVLYFCSLGCSFTIDVNDLLSVSVEETTTGYRNEITITNDQKRLSAEEIIRMIHEAENYQVDDRKFMKKANTMNALDDYVYKMRNALNNKNISSKLCLQEREKIKSVISKVTDLLEGDNQPYEIE

SEQ ID NO: 131588 - protein, 268 aa, Glycine max
  Coding DNA Sequence Number=SeqID_39903
MVRTQGLRRALEEAPQCRRLTASGRTQWAAAAIAEDGDHVDHVANEVHKQPQEPIMDHVGANTEGFAGGPYDTSVLTSYVDHVATKVWAEEERIELKLASHGRKVEKFGRPVPEIEGIVATTRLSSLITCSLEIGDTCLSLEVWEGITSDDISWGSSIVKHQPERVVQQFGYVQTIPPLHCAPNYMEWFYRITHPFMSPTQLEDPPRHPPDACQKIAKSLEHMINMRMVTVGIDAYALTEHYLRLAKDVTEQRNVYVQSRQRRDTHDT

SEQ ID NO: 131589 - protein, 119 aa, Glycine max
  Coding DNA Sequence Number=SeqID_39904
MDKSLKVREDEWREKKRMSMKFYASNELRFIPLILDQVQDSPLSVLRCHEISEPNLGPWAHKSTLRFMRTLGPSSTVLAQSSWSLLVMAQVTGPFLWRIASTYSFFLNLHFLDQNSASH

SEQ ID NO: 131590 - protein, 56 aa, Glycine max
  Coding DNA Sequence Number=SeqID_39905
MDTPGLLHDKHTLRSSRILREMEVEEPWLGLWLPLNYRVDMGVVFAIGSVVDRLCG

SEQ ID NO: 131591 - protein, 482 aa, Glycine max
  Coding DNA Sequence Number=SeqID_39906
  Gene Ontology: Mol. function=chitin binding; Cellular component =extracellular region; Biological process=chitin metabolic process
  Homolog annotation: Hit_ID=UPI00006A17C9; Match level="QueryCoverage =36%, HitCoverage=100%, E-value=3e-11, Identity=25%"; Hit description= UPI00006A17C9 related cluster
MKTLLPFEDNPWVSPHATCLLIGQGSRTVFVRITAWGISACHLTHGSGLTDVVFVWITTWGISACHLTHGLGLTDVVFVRIITWVYPPATWIKRCCLCTDNHLGIFACHLTHGSGSADGLRPKESRPEDADIFGKGEDGKSHLGSRFMVSWDFGSKLVERLDMIYVRGSGLKHQFMHSSESILGVRKIPQHSPFKDYEQLGVFNRGLRNIVPARTCPGGLVPAGQPCIVGNPLAFEDELRWILEVVAVRLPPAVGRPQATVVPRPVIAWGRMVMLVRMIRTRLFAAARAKSCPGSSCMIASSSGCARTVGPPPESTGQRTLNSLKVRMWSPLKVRTRSPLKARACSPLKSRTCSPLKSRACRFLKSRACHPLKARTCGPLKVRAWCPPKLRTCGPLKLRKCSPLMVRACSPPKLTACGPLKPIPLKIIEATRSNRACSPLMARACSLMKVRTCSSLKVRMYSPVEARTCSPEGVQPYEKARD

SEQ ID NO: 131592 - protein, 169 aa, Glycine max
  Coding DNA Sequence Number=SeqID_39907
MGLFIVVGQNIVLAGLGKVFENSSIIHNVHYANDVVKVNVVRTYMPHTEVPIPTSEVRILEQVVGTFIAWPTHLVRKVTNEVVVGPDKSPSKSVGEPNRFTSVATDDPLGELVKKSYVVYTKPMELAWDGAKFGLPNSTNGFFITHADVTKIILGHIGNFLCCVHKRTL

SEQ ID NO: 131593 - protein, 63 aa, Glycine max
  Coding DNA Sequence Number=SeqID_39908
  Gene Ontology: Cellular component=integral to membrane; Biological process=vesicle-mediated transport
  Homolog annotation: Hit_ID=A7QTI2; Match level="QueryCoverage=98%, HitCoverage=28%, E-value=8e-26, Identity=85%"; Hit description =Chromosome undetermined scaffold_168, whole genome shotgun sequence
MGQQSLIYSFVARGTMILAEYSEFSGNFKTIASQCLQKLPSSNNRFTYNCDGHTFNYLVENGV

SEQ ID NO: 131594 - protein, 55 aa, Glycine max
  Coding DNA Sequence Number=SeqID_39909
MPPFNSTALQVCQTSIFGDVSPLDPRNSVMVLSSPPPPQKLPLEGHQLIHLSSPS

SEQ ID NO: 131595 - protein, 181 aa, Glycine max
  Coding DNA Sequence Number=SeqID_39910
  Homolog annotation: Hit_ID=A5AQM4; Match level="QueryCoverage=54%, HitCoverage=13%, E-value=2e-09, Identity=36%"; Hit description =Putative uncharacterized protein
  Pfam annotation: Domain name=RVT_2; Domain location=63-177; Score= -132.3; E_value=3.3e-06; Accession=PF07727.5; Description=Reverse transcriptase (RNA-dependent DNA pol
MVHVSTTHQHFHLVALVPAADPLTCCRKWSLGFCGNTPLVFIHCKDSHHKGRVLLQLKNRCAAVSSEVLHRGHLRSFNSTCLLLRALYGLKQAPRQWFERLQTTLLQFGFVATSYLSVELKILSLTAWFVRLLSWNRGEDTLADKSILLTQSKYIRDLLLKTSTAEAQSIASPMASSCRLT

SEQ ID NO: 131596 - protein, 129 aa, Glycine max
  Coding DNA Sequence Number=SeqID_39911
  Homolog annotation: Hit_ID=A5ADN4; Match level="QueryCoverage=87%, HitCoverage=61%, E-value=1e-08, Identity=30%"; Hit description =Putative uncharacterized protein
MASASQCFSSHSFPATIAEKLDDSNYLHWRQHVEPIIKSHKLQSLGSAGLNVACLTSIDTLDVCPFSRARLKSLLSGKTMDEYLHKIKGYVDELAGVGFLVRHEEHVGAILEGLPSDYAPVVSVIESKK

SEQ ID NO: 131597 - protein, 106 aa, Glycine max
  Coding DNA Sequence Number=SeqID_39912
MPLWWEFNSWVKEDRVLHCRPGDNFTPHFSLAASRASNRKWKIWWIAATVSIWNSRNDMIFKNQPFVISKLVDNAIFLTWSWLRGWEKDFAVPFQQWSSSMSLAFI

SEQ ID NO: 131598 - protein, 80 aa, Glycine max
  Coding DNA Sequence Number=SeqID_39913
MGKSGVVDLECTTLDLAKLTPGIVRGDTDELFCASAKEWPTHASGGKALLLVQPRLPKAAMTRGVNRGMLISSSGNSSQD

SEQ ID NO: 131599 - protein, 147 aa, Glycine max
  Coding DNA Sequence Number=SeqID_39914
MWVSLKALWETNGWRPRLDGEVNVWSHNLELAKSLVGHPYASQLTKDEKTIIVDMTKSMVKPRNILLTLTLCLDGAIKELKFPIPLFHCQPLTHAANALFRFSPLSHSLFPSQSLSHALPLSATVSRSQSLSHALILSATLSHCRRN

SEQ ID NO: 131600 - protein, 400 aa, Glycine max
  Coding DNA Sequence Number=SeqID_39915
  Homolog annotation: Hit_ID=Q5XM22; Match level="QueryCoverage=16%, HitCoverage=36%, E-value=4e-17, Identity=65%"; Hit description =Resistance-like protein HAAS-2
MVRTRGLGRAIDRDIGRALGREDNRDSDDVPQRRRPTTSVRRQQEVVVVVKDAPHVDDTVEEVFQHVEEAVDDVEGFLGGPRDPSVLTAYIDYVGVIVWNGEERSPSPLDDVASLLHLPIIGAFHNSDTLHVDEAVLMLVKLLEVTRDETRAETIQCPEAYACLSWLREIYHSKCEAGHWTVAARAYLLHLLGCTLFANKSATHVHVVFLDTFRDLNQSGSYASTKALPTSTYWKRLDRLTTDDTIPPHSLGSRLSFKDIDDKWMHFFEYLAPVDQICVVSGQCALDYIHRFYMISHPFMTPTQPRDPPRNPPIMQDETYVEPDMHEFSVAATTMEEAPAHAVACKAIAKRLERLLNLRIMTEGIEAHDVMQDCLRIARGVTVERNVFVRLRRRRHTNHA

SEQ ID NO: 131601 - protein, 266 aa, Glycine max
  Coding DNA Sequence Number=SeqID_39916
LSGCHRIKSSNCMFLRTGDRGLIFAFVERWHKETNSFHLSALHVDQVVDLLVDLLEVSLEEERVETLQCHGTYVARSLLTRVSHVYMWYSWMHFVTSAKQEATHGELLHSFICMRNLNDALKRSARQLAGYITLLQCWIYEHFPTVASSIVAEDYHERKSPYYIEWFHFISHPFMSPTQPRDPPRHPPVVHDDTFIEPNPPQQSVVAAAMVEPPAAAPVDEAYQAIAERLERLINLKVVTKGTKVYTVIEECIRIAKSVTAQGNVY

SEQ ID NO: 131602 - protein, 86 aa, Glycine max
  Coding DNA Sequence Number=SeqID_39917
MSEEVDMNEQNEDEASVNEEHVDCSDAFNTSLMMFCIELDLLLMKLDFGQYRYRKKDFVRRDTDNRKCGYPFKLRGKLVVEDQGCM

SEQ ID NO: 131603 - protein, 218 aa, Glycine max
  Coding DNA Sequence Number=SeqID_39918
MECHFILQPRPHLSHVRSEYGQGETDFTDGPVQLLSARIPCTYYNTMHRQRSGRIDGTRMIPRSHFRTRKAWAQGPMDASTFAPSSSTPTPAPAPPAPPLRAHHGLCLHGGFHGSGGLARSPSFSFGGGEAPIAQEPQPESEATLEATPEETPEDTPAATPSEAPEEGDGAADTDYVVDMAATQSSWDPWPIPAPDTSLPAPDAPSTPQDNPTPAQDG

SEQ ID NO: 131604 - protein, 141 aa, Glycine max
  Coding DNA Sequence Number=SeqID_39919
SKQLLDASAGGKIKLKTPEEAMELIENMVVSDHALLHDRTHVPTKRSLLELSSQDALLAQNKLLAKHLESLTETLSKLPTQLQATQPSHSTVMQVTSKVPILIRIKGSVGLILGINSTKTKEDHPTGLKIKGLAFMRGPPS

SEQ ID NO: 131605 - protein, 177 aa, Glycine max
  Coding DNA Sequence Number=SeqID_39920
  Subcellular localization annotation: CTP_CleavageSite=51; ConfidenceScore=5.15e-01
MALLLSNILPNNHNAISPCRSISWDRAHKTPSGPGKSNRALGFPALVTGLCQSYRVPVPPSKESLPQRHPVDPEKSNRAMGFPALGSRPQDTQWTRRSPTGSWSCQALITGLCQFYGVPVAPSKVIRPPTNRAFIKKYCVPRQAQGETPQQPEDGRQRATDAPPSPLEFTSAHPQKG

SEQ ID NO: 131606 - protein, 45 aa, Glycine max
  Coding DNA Sequence Number=SeqID_39921
DRDEDTTKDKDHEALEGPMTRGKLKQAQHVIETWLVICIAAIDDD

SEQ ID NO: 131607 - protein, 211 aa, Glycine max
  Coding DNA Sequence Number=SeqID_39922
  Homolog annotation: Hit_ID=UPI00016621D1; Match level="QueryCoverage =87%, HitCoverage=46%, E-value=1e-12, Identity=34%"; Hit description =UPI00016621D1 related cluster
LHALTFRGPHVLTFRGPHVLTFRGLHALAIRGLHVLTFRGLHALAIRGLHVLTFVGLHALTFRGPHVLTFRGLHALAIRGLHVLTFRGLHALTFRGLHVLANRGLHALTLRGHALTFRGLRILAIIELHSLAFKRRRVLNFRGLHALAFRGLRVLTFISGPPPDIGGGPTVRAQPEREAITQLLCILGQDFTCAAAKRRVRIMRTNMTTLT

SEQ ID NO: 131608 - protein, 160 aa, Glycine max
  Coding DNA Sequence Number=SeqID_39923
  Subcellular localization annotation: CTP_CleavageSite=41; ConfidenceScore=5.47e-01
MAILFTQGHRMQKVSCRTVGLVLRLMTTPPRFTPHSDIPLDAMSRRPRQSTRLRRLTVRTLDQPQPIVNVNPTIGRGSGPHKEKFHKTLKNLIWDDILGKFDIPEGDNAKKKVMPTVATRWRQFKSSLTTKYIYANSEGQAKDYPSVKYGIDATTWAEFC

SEQ ID NO: 131609 - protein, 79 aa, Glycine max
  Coding DNA Sequence Number=SeqID_39924
VLTIGSCVAYPTQTVFVWLVRPHSIPGLFVGDAGGFQSPTREPLNVGGLVPPHCSLKSVVSDDACPGACFVQRDATTLS

SEQ ID NO: 131610 - protein, 47 aa, Glycine max
  Coding DNA Sequence Number=SeqID_39925
MADQQVTKSKAKGRTLVAHDPGNFKIKQAQARKVVENTLDMHVEKIP

SEQ ID NO: 131611 - protein, 79 aa, Glycine max
  Coding DNA Sequence Number=SeqID_39926
LYQVTQVPQEFDTRFLLFYTTCAIRCTCQVQTSFWHRCQGTSFYLENFMTYQAGSKGDGYSMQQQETQFEKDYSFADYQ

SEQ ID NO: 131612 - protein, 70 aa, Glycine max
  Coding DNA Sequence Number=SeqID_39927
MVTSMLQLDSMNLFVKTRAWFNPITQGMAILIANTSTTFHRDERLENTHATHGKYAQKRNRGMHRVRQYP

SEQ ID NO: 131613 - protein, 114 aa, Glycine max
  Coding DNA Sequence Number=SeqID_39928
MWTTTAKIGEKIARPARPGEQGCFLQKQQPSGGIFWRAQVGLKLRKPTDCAKTPFFDFCHITEFHGSCKPASFLIFETSWDFIYWMSSSNNPRTKLGYDTCNYPKRRIKCNLNN

SEQ ID NO: 131614 - protein, 69 aa, Glycine max
  Coding DNA Sequence Number=SeqID_39929
MELYELRNDTCFLSVMSRNLTDYAIVPSLASEMLRNFTDYALTLPFDSRHVAELHGFPNNGVKYLEVVK

SEQ ID NO: 131615 - protein, 125 aa, Glycine max
  Coding DNA Sequence Number=SeqID_39930
MSICSFGFYGPNHVYSLHGKRPRCGQDIQRKGRSVDIVCECLAFVTSPHMETAIALHGEPIYASAHEKAGRQSPQCPFVIVGSLRWVLFAFNVSLDIEIPWLTVPFLFHLTTMCGSATTPELNVR

SEQ ID NO: 131616 - protein, 169 aa, Glycine max
  Coding DNA Sequence Number=SeqID_39931
MVMGDFISRLSFPGRRIVFHSRKKESICCSKSVGIFVSLLKHVCIFSEENTETLSSLTSYQELRRSEFLIGGYVGARASLLSTTPPFVAMTQELVARGDTLRLSAPRHSVTPSVIHEQRPIWSSAPFPEMSAFSDGDFSSLTSYQELRRSEFLIGGYVGARALLLSAAP

SEQ ID NO: 131617 - protein, 265 aa, Glycine max
  Coding DNA Sequence Number=SeqID_39932
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDLAQPADRILVLVLSVAVANHQTIISCKHHLKSTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131618 - protein, 146 aa, Glycine max
  Coding DNA Sequence Number=SeqID_39933
  Homolog annotation: Hit_ID=A5BP71; Match level="QueryCoverage=46%, HitCoverage=17%, E-value=1e-09, Identity=47%"; Hit description =Putative uncharacterized protein
MTTNFSECVNKYEKDCRNIPITALVKSTYSRCRKYFVDRGRLLKNFEKIKNKLVRTSSVSMISTRQDVVYTNEHILKAYSAQWWPLGNEATIPPSEDSWTLIPDPTTIRAKGRPKSTRIRNEMDWLEPSEHRQKCSRCGTEGHNRR

SEQ ID NO: 131619 - protein, 157 aa, Glycine max
  Coding DNA Sequence Number=SeqID_39934
  Subcellular localization annotation: CTP_CleavageSite=74; ConfidenceScore=5.66e-01
MGIAHKTPSGPGKVQQGPGVSNSSYGPLSVLQGARTPPGKGSRLQDTQWTRRSPTGSWSCQALIMGLCQFYGVPVTSSKGIRPPTNRAFIKKYCVSRQAQGETPQQPGDGWQRATDAPPSPLEFTSAHPQKGLSIAYTTWPTNRRPSPKPKDAPSCS

SEQ ID NO: 131620 - protein, 131 aa, Glycine max
  Coding DNA Sequence Number=SeqID_39935
  Homolog annotation: Hit_ID=A0ST23; Match level="QueryCoverage=26%, HitCoverage=71%, E-value=3e-08, Identity=77%"; Hit description =Putative reverse transcriptase
APVASVLSAVPPVQLLTGWCVTAKAPPDISAGKCSGRVPFAIQAAQLLGRAIGAGLFAITPAGERGMCCKAIKLGNAIGKPVVPAALMNRPTRGERRFAYWALAECILAYYVGTDEGVSEVLHVAGEKSCT

SEQ ID NO: 131621 - protein, 192 aa, Glycine max
  Coding DNA Sequence Number=SeqID_39936
GYTSSPPEDRLHALRGLHVLAFRGLHVLTFKGTDMSSAFRGLHSPRLHRATTPSPLETTRPRLHRASTPSPSEGTRPRLQKGRHVLAFRGLTRHHLREDYMPRLERATRPRLQGLHVLALRGATRLALRLHVLAFRGLHVLTFKLGYTLSLRGLHILAFRGLHVPRFRGLCPHLQRVARPPLQRATCPRLQR

SEQ ID NO: 131622 - protein, 139 aa, Glycine max
  Coding DNA Sequence Number=SeqID_39937
MGILRRLKTVVVCDDVINSMAFKDDGQPVSPVLELTRDYDGHGDSTVIDIILFYDGCLLRTIVEWSTILTRLPDNPVVEVTKDYDDHGDITVVDIILIYDGCLLRAVVEWSYYYNGVLLRTTVVRDGVNTTTVTIQHHR

SEQ ID NO: 131623 - protein, 38 aa, Glycine max
  Coding DNA Sequence Number=SeqID_39938
ENTRIMYEQTCRTKSMLNVYDDAMTHAKWECDNGQMQE

SEQ ID NO: 131624 - protein, 190 aa, Glycine max
  Coding DNA Sequence Number=SeqID_39939
  Pfam annotation: Domain name=G-patch; Domain location=118-162; Score =4.5; E_value=0.054; Accession=PF01585.14; Description=G-patch domain
  Subcellular localization annotation: CTP_CleavageSite=26; ConfidenceScore=5.26e-01
MAKVLIDNGSSLNVMPKNTLEKFPFNASHLRPSSMVVHAFRWQPPRGKGKDRPPSTDRASYLPSYIPSDGYQFGLQLSFGASMDPLSGSRPLHTPPKVEVCSGKTFGHSIRQPRLSDAAMMVAWVMLGHDYEPRMGLGKNNGGRTGLVSVRGNHGKSGLGYKPTQADVRKNISGRKNKGRGPQSGQQAQE

SEQ ID NO: 131625 - protein, 25 aa, Glycine max
  Coding DNA Sequence Number=SeqID_39940
MVEINQGKDDDRSRLVAYHFGSYLQ

SEQ ID NO: 131626 - protein, 127 aa, Glycine max
  Coding DNA Sequence Number=SeqID_39941
MGTNQTGKRFYQVKVKGLDTTRIKELGQLMEPLQMQAFRKTYGKILELTIAEVSIEAIASLTQYYDQPLRCFTFGDFQLGKKTIPFLRVSPLFEQNCNCGQGFSERFGPHKTDSKRHSGPTMEVPKR

SEQ ID NO: 131627 - protein, 437 aa, Glycine max
  Coding DNA Sequence Number=SeqID_39942
  Gene Ontology: Mol. function=sodium:dicarboxylate symporter activity; Cellular component=flagellin-based flagellum; Biological process =protein transport
  Homolog annotation: Hit_ID=Q56887; Match level="QueryCoverage=55%, HitCoverage=34%, E-value=1e-122, Identity=90%"; Hit description =Flagellar biosynthesis protein flhA
  Pfam annotation: Domain name=FHIPEP; Domain location=1-303; Score= -105.4; E_value=7.3e-15; Accession=PF00771.11; Description=FHIPEP family
  Pfam annotation: Domain name=FlhE; Domain location=305-437; Score =156.3; E_value=8.6e-44; Accession=PF06366.4; Description=Flagellar protein FlhE
  Pfam module annotation: Pfam domain module=FHIPEP::FlhE; Domain location=1-303::305-437
LEDPLGMEVGYRLIPMVDFQQNGELLGRIRGIRKKFAQDMGYLPPVVHIRDNLELPPASYRILMKGVEIGSGEAQPGRWLAINPGNAVGELAGDKTVDPAFGLEAVWIDSALREQAQIQGFTVVEASTVVATHLNHLIGQFASELFGRQETQQLLDRVSQEMPKLTEDFVPGVVSLTTLHKVLQNLLAERVSIRDMRTIVETLAEHAPAQSDPYELTTVVRVALGRAITQQWFPGNGEIQVIGRRRSGAGAGRSPAGAGAPGAAAARDAQRAAGAPAAARGTVQPRDQRRSPDSHDLDHRSRLMKRCLFVLCLLAPLTAGAVSGSWVAEGAGVTLEQGGMRDESAGLRPPNVLPDANARITRVSWRYRLLGPEPAGLQAQLCTVNRCIALGGGSGSSNGLQGEPANAELRFVYYVQSQGGLNPPLRVIGNQVIVNYQ

SEQ ID NO: 131628 - protein, 71 aa, Glycine max
  Coding DNA Sequence Number=SeqID_39943
MGNRKISVLRSLAHSVKGIQKAVRRNCERLRITGETRARRCRRATGRPGHTAIYCSCSGSPAPERYGRSAD

SEQ ID NO: 131629 - protein, 116 aa, Glycine max
  Coding DNA Sequence Number=SeqID_39944
MLRFTSDSPQISANQHQLDFAPYALGPYNAQWNAPGLLHDMYMLCSSRILGEMEVEEPWLALWLPLNYQVDNGASQHRTPKFGVNPTSFFAAKFLLFFAKGGVRHWKCGRQALWLI

SEQ ID NO: 131630 - protein, 228 aa, Glycine max
  Coding DNA Sequence Number=SeqID_39945
QEDGQPLVVKEKCKEVSVSYKRLAKKETHFTIKTNIKETFPLRQPPHFLFCKKTLASIATPLGLEFIPQVKKLLDEGLVRKSLNPCALLVPKIGIIRHQVPKIGGMMNVLSGATLFCKITRTPNIFMVCAHRDPLGSDQEVPMNPKRIKVILEWPTPPTLLIELVRNHVPSCEDAQEMGFQTLPYFNIPNTTKYIWALDRRLQVDCGRDPREDPRVLMSLRVDFEPMG

SEQ ID NO: 131631 - protein, 148 aa, Glycine max
  Coding DNA Sequence Number=SeqID_39946
MGEAEEVQEKMKAEMEAMKEQMATMMEAMMSMKKIMEANAVIVAATSTVAKVNPMLPSGLKQMNHPTSNMVGKDLGSTDDPMMCKFKTSMPSHHMACLPTIHHPMWHTLSMKISITPHPYSLRANNLNLIMHMSLDPWRRHMECPTTI

SEQ ID NO: 131632 - protein, 110 aa, Glycine max
  Coding DNA Sequence Number=SeqID_39947
MCQVLSDLQRPLLGGCAKKGIGHPEAKHCPPRVVSWGYEYLEQKLMVEKTKKKLEEATQSESIEGVIDPLSPIKRHVKWKMVHTKKTRQMTSEDSLEEQASQGSFVPHGR

SEQ ID NO: 131633 - protein, 140 aa, Glycine max
  Coding DNA Sequence Number=SeqID_39948
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEGVSLEVMRG

SEQ ID NO: 131634 - protein, 368 aa, Glycine max
  Coding DNA Sequence Number=SeqID_39949
  Gene Ontology: Mol. function=nucleoside diphosphate kinase activity; Cellular component=cytoplasm; Biological process=nucleotide metabolic process
  Homolog annotation: Hit_ID=Q7WHM7; Match level="QueryCoverage=31%, HitCoverage=81%, E-value=5e-54, Identity=93%"; Hit description =Nucleoside diphosphate kinase
  Pfam annotation: Domain name=NDK; Domain location=257-368; Score =179.4; E_value=9.1e-51; Accession=PF00334.10; Description=Nucleoside diphosphate kinase
VGHGRQQLGIPVDQALAAVDQALFMQAHEGLHHAARHAVVHGEVLARPVGRGAQPAHLAGDGVARLFLPLPHFFDEFLAAEVVAGNLLRVELSFNHDLRGDAGVIRPRNENGVVAQHAVVADQAIHDGLVERMAHVQGARHVGRRELDDVRLTFGPRFYVRPRGEVAALFPLGVPAGFEFGGFEALGEFRGVGRGGRGVRGSGLSHYRVPADRAPARGQPRDHSEGLAVSNPRLGTGGRDGPERAVNAVVPILMSVQRTLSIIKPDAVAKNVIGQIVARFEQAGLKVIAARLAQLSRADAERFYAVHKERPFFKDLVDFMVSGPVFVQVLEGEDAIQKNRDLMGATDPKKAAPGTIRADFADSIDANA

SEQ ID NO: 131635 - protein, 74 aa, Glycine max
  Coding DNA Sequence Number=SeqID_39950
MSNEELKLQDPRCRIQCPDILPENTGVVIFSEEDRSPPAQAVAAQKRKLLYNHGGCTSSVPSPGLKSYFVSFGT

SEQ ID NO: 131636 - protein, 43 aa, Glycine max
  Coding DNA Sequence Number=SeqID_39951
MASYGEAKDSIDEEDPRPTSSSWSYIKEEEEEKEKWSRGAAEL

SEQ ID NO: 131637 - protein, 116 aa, Glycine max
  Coding DNA Sequence Number=SeqID_39952
MEGLVDLAAIDAFLAFHHGKESLVVAILAMYDTFDRGCEKSSARIVCCALALYVGPSIRYKVTARASKGKGSQELPPLLAKAKAVADTYSAPEEIHGLLSYCQHMIDLMDHIIGNH

SEQ ID NO: 131638 - protein, 55 aa, Glycine max
  Coding DNA Sequence Number=SeqID_39953
MAFSSLNHIILRRYWRNLILKIVLWCKSKKRPIKQKFRSTKWDLQFDMLKDRDTG

SEQ ID NO: 131639 - protein, 165 aa, Glycine max
  Coding DNA Sequence Number=SeqID_39954
MIMRGQDIYSSQDEATTSPSSSKSEEAKGEESSEEIYLQEEGQPLMVKEECKEVSVSSKRLAKKERHFEIKTNIKEISLLRQPPHFLLCKKTLVSIATSLRLEFIPQVKELLDEGLVRKRLNPCALLVPKIGVPMNPKRIKVIPEWPAPPSVLREGAQSIKNLRI

SEQ ID NO: 131640 - protein, 308 aa, Glycine max
  Coding DNA Sequence Number=SeqID_39955
  Homolog annotation: Hit_ID=Q2HTA0; Match level="QueryCoverage=38%, HitCoverage=20%, E-value=4e-08, Identity=35%"; Hit description=IMP dehydrogenase/GMP reductase, related
  Pfam annotation: Domain name=DUF1723; Domain location=158-206; Score =17.3; E_value=0.0047; Accession=PF08330.1; Description=Protein of unknown function (DUF1723)
  Subcellular localization annotation: CTP_CleavageSite=55; ConfidenceScore=5.17e-01
MGLVNPVRHSKLASSTAITVRIRSLGRALSRVIGRVLGREDNRDSDEVLKRRRPTTSTRRQREVVVVAEDAHYMDNAAEEVFQQPEEAVFDAQGFLGEPRDTLVLTAYADHVAVIKCPELKLSSHERKVQKFGRSTAEIEGLVAPTGLSLLIACSFDIGDWRLISPFVEGWHKETSSFHLPVGEAIITLDDSMEMKPELRQYNVMGHMYDYHGYERFIITNHFPSIAETFTDEDYDERSPCACHWTSTKALPMLTYRKRLDQLTTADVCWMPYSDHRTFGLVQMIPPHSLGSRLCLEDIDDRWMHFFD

SEQ ID NO: 131641 - protein, 135 aa, Glycine max
  Coding DNA Sequence Number=SeqID_39956
MQSTEGSGVAKPKPLVIYFTKSAASQKPGHPLMAKPVPFPYQNSHAVPWRYTPPEKKEEEVTDVSSLSAKVTNITGLSGVTRSGRVFAPPDLPVQPADVKGKGKVVEEQDGEAPHASNKDMPAKGPPEKRDGRKE

SEQ ID NO: 131642 - protein, 205 aa, Glycine max
  Coding DNA Sequence Number=SeqID_39957
  Homolog annotation: Hit_ID=UPI00006A17C9; Match level="QueryCoverage =79%, HitCoverage=91%, E-value=9e-09, Identity=27%"; Hit description =UPI00006A17C9 related cluster
MLVRMIRTRLFAAARVKSCPGMHSSCVIASLSGCARTVGPPPISGVAQEPLKGNYLPLNRKGKSRTLKMRTRSPLKVRACSPLKARRCSPLEVRACSPLLARTCSPFKVRACNPLMVRTCSPLKARTCSPLNGEGRVVLSRRGRVVLSMVRVTSTQEVRACSPLMVRTCSPLKARTCSPLNGEGRVVLSRRGRVVLSTVRVTSTQ

SEQ ID NO: 131643 - protein, 195 aa, Glycine max
  Coding DNA Sequence Number=SeqID_39958
MQGLLNHNKEELYKRIVKSSLFILKPLSPREVCDDQIKMREKREQEKENSEAPQRNRKKKSDTPKGKSDTHKERVIHMRENLIILQRRVKPTYKSNPQETQRKDAHAKVEYVKRLYDQVKVQIAKKNESYAKQANQKRKEVVLEPGDDPRHLRANVFQEGGNDENPKTGQIQAKGPSGEGRRTKWRRTKPPNGEG

SEQ ID NO: 131644 - protein, 117 aa, Glycine max
  Coding DNA Sequence Number=SeqID_39959
MTDPPSPVRRHVKWKMAHMKKTEEMKTKAAKETVEKICPFAGERGEAHGCAFQRRKDARSRHQRLFVENIGKTEGNRSKRIFQVRELYLRLRKVDKSGALAPTYPPSKRKSDLRSSF

SEQ ID NO: 131645 - protein, 173 aa, Glycine max
  Coding DNA Sequence Number=SeqID_39960
NPSDLQPFDPEIDRTFHRLDRHHFIPFDHPEHSITGEFVHSAIGDFEHPDLEHYNFEHSDSEHSDFAHSENMAQPPPRERTLREMAAPDFTYESLCIQYPDEDVPYVLKTGLIHLLPKFHGLAGFSSFIRGSDKGLAVLPCSKIHQSWDDLKRVFLEKIFPASRTTAIRKDIS

SEQ ID NO: 131646 - protein, 315 aa, Glycine max
  Coding DNA Sequence Number=SeqID_39961
  Homolog annotation: Hit_ID=Q2JIC4; Match level="QueryCoverage=31%, HitCoverage=18%, E-value=5e-09, Identity=49%"; Hit description =ISSoc9, transposase
LHVLTFRGLHVVAFRGLHALAFRGLHILAFRGLDALAFRGLQVLAFKGLYALAFRGLHFLAFRGLHVLAFRGMHVLAFRGLHALAFKGLHVLAFRGLHICAFRGLKFLDHPLILEDDELWEHNQKGRLSCSYNALSRLALPVPRPPPARRVTNYASTTREGGYRTATMHTGARFHPTAARRRVSMHVAQLISDAIHYLHGSHPQDTQWTQRSPTGPWGFQLWLWASVSPTGCPSPQQGIAPIRHSMGPEKSNRVLGFPTLIKSLYQFYGVPVATSKGETPQQPGDGRQRATDTLPPPPEPLSSSTKVGALPTTRA

SEQ ID NO: 131647 - protein, 144 aa, Glycine max
  Coding DNA Sequence Number=SeqID_39962
MEVDDPLYLMTLTIPELFLRPYQVTWDVTVFGVFNPDFSLYIKHKDLSEIAHGGQCLSISVLQLWILHLIETSMQAGNSNLWIPRATVHSEQTLADDGHCAQRTPSCLPKSKAPMLGGLPSSIIDKKEVLSAATMSCTGCPPSF

SEQ ID NO: 131648 - protein, 180 aa, Glycine max
  Coding DNA Sequence Number=SeqID_39963
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=21%, HitCoverage=38%, E-value=9e-16, Identity=100%"; Hit description=LacZ protein
MTMITPSSKLTLTKGNKSCDYVNDEGNDDHSFDYDGVDDGDGGGVMTVMVMVVMMVMIMIVMVMMMVVSGRHRGGAPIRPIVSRITIHWPSFYNVVTGKTTGVTQLNRLAAHPPFASWRNSEEARTDRPSQQLRSLNGEWDAPCSGALSAAGVVVTRSVTATLASADVRRCFCRYAPPRQ

SEQ ID NO: 131649 - protein, 155 aa, Glycine max
  Coding DNA Sequence Number=SeqID_39964
MASMMEAMLGMRQLMEKNVATAAAVSSVAEADPTLLATAHHPPPNAIGRERNTLGHSSNPHLGYNRVAYPYGLPPNYTLPVMHDDEGHVLSPILEGEPPRQPDEGPRRSSRVCPRGCRFLPPDPCRGAGTQHIASAQPHCTTNILVHRRTTPSAE

SEQ ID NO: 131650 - protein, 139 aa, Glycine max
  Coding DNA Sequence Number=SeqID_39965
MERQHGMYYTPATFSEYPSQMCQYPFAGHHTDTSETSHSFGGVAETQPHFSWPTITPSQQHDAPIATPNAPFGPQWNVPGAIPDMGDLLGVDLRQEFSAEAEQAEAGRQRGGRRNPDRQARRWDRPCDTSSRHHGHHND

SEQ ID NO: 131651 - protein, 204 aa, Glycine max
  Coding DNA Sequence Number=SeqID_39966
  Gene Ontology: Mol. function=kinase activity
  Homolog annotation: Hit_ID=A4W9L8; Match level="QueryCoverage=94%, HitCoverage=67%, E-value=8e-95, Identity=87%"; Hit description =Fructosamine kinase
  Pfam annotation: Domain name=APH; Domain location=26-196; Score=-2.4; E_value=0.0091; Accession=PF01636.14; Description=Phosphotransferase enzyme family
  Pfam annotation: Domain name=Fructosamin_kin; Domain location=6-203; Score=314.5; E_value=1.9e-91; Accession=PF03881.5; Description =Fructosamine kinase
  Pfam module annotation: Pfam domain module=APH::Fructosamin_kin; Domain location=26-196::6-203
MGRDSMWQAISNLLSEQHTDGAEIELRNELPGGEIHAAWHLRFGGKDYFVKCDERELLPIFTAEADQLELLSRCKTVSVPQVFAVGSDRDYSFLVMEYLPPRPLDAHNAFLLGQQIAHLHQWSDQPQFGLDFDNDLSTTPQPNAWQRRWSTFFAEQRIGWQLELAAEKGLHFGDIDNIVESVQQRLSSHQPQPSLLHGGWGSGK

SEQ ID NO: 131652 - protein, 274 aa, Glycine max
  Coding DNA Sequence Number=SeqID_39967
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDCLEEKEGLAVWKTQVWQEDEWAGDRGRKAAQAQGASRGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131653 - protein, 45 aa, Glycine max
  Coding DNA Sequence Number=SeqID_39968
MGLSGLKEHSKSMTPKAYTPKSPSGPLPPDSGPTPKIILAHRHIS

SEQ ID NO: 131654 - protein, 155 aa, Glycine max
  Coding DNA Sequence Number=SeqID_39969
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-23, Identity=98%"; Hit description=LacZ protein
MMKLHKPRGGPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPPSVAEQEGQLIETEATGAPQKHHHTLNQ

SEQ ID NO: 131655 - protein, 62 aa, Glycine max
  Coding DNA Sequence Number=SeqID_39970
MKMLLISNDRNGERERERRRHFKEKMSLEEAHHHRRPWIRAWRKNEMNEGRGREEHEILCSK

SEQ ID NO: 131656 - protein, 73 aa, Glycine max
  Coding DNA Sequence Number=SeqID_39971
MTSKELNEEPYEVKISCTFRKGTGAGYHETKDFLSKEIRFGTTICPRSNMERISEVFLDFVRVNKQFEMPRLF

SEQ ID NO: 131657 - protein, 93 aa, Glycine max
  Coding DNA Sequence Number=SeqID_39972
MGRIKRILRLCRFEFFDKGEGRHKRISGDKRDTKRIQAVSPLANSFWQRGEENEKMNSTSFQGLETQKPSESFWYKEEEEVQRDSRLVKDCMK

SEQ ID NO: 131658 - protein, 115 aa, Glycine max
  Coding DNA Sequence Number=SeqID_39973
  Homolog annotation: Hit_ID=A0PAV3; Match level="QueryCoverage=24%, HitCoverage=14%, E-value=6e-07, Identity=89%"; Hit description =Restriction endonuclease
WNSYVPINVSFSPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTL

SEQ ID NO: 131659 - protein, 122 aa, Glycine max
  Coding DNA Sequence Number=SeqID_39974
MGLPSNSYVGVSGGMINGLVICEALVAFFLPTDVKQPPYWGNPLTHFPLPVRGVLYIYLKDMDRSTAAGEENRWEIISSIKERKNKKSKLDVQKTEDPWEVGGVACLSMNSDHKVIPDEEKH

SEQ ID NO: 131660 - protein, 252 aa, Glycine max
  Coding DNA Sequence Number=SeqID_39975
MGSSQKPSLKKRFYQVKIKSLEYYDQPLRCFTFEDFQLVSTVKELKKSWDAHWEEGSHIFSLGSIPPRQELPRPWQIKANGLSFIDILAVLIFGVVLFPNMEGLVDLAAIDAFLAFHHGKESPVVAILAMYDTFDRGCEKSGARIVCCAPTLGYPMRGAPLDESITPFIARGFSDHNARDKELRGSSNGSIGGYHKWLRVRTQGLDWLPNLKIVRDDEVKASEESDEVQALKADLERAWVVEEKFKSIAIKV

SEQ ID NO: 131661 - protein, 333 aa, Glycine max
  Coding DNA Sequence Number=SeqID_39976
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINKALWACSRVAMAIPHYLQSQSRVQGIGSLHMCCSFSHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 131662 - protein, 284 aa, Glycine max
  Coding DNA Sequence Number=SeqID_39977
MLAIIAKYQEELGLATAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMMEAMLGMKQLMEKNAATACRCQFGCRSRPNSLGNYAPSSLKHKPPQQPEEVHKDPQDYARRDVEFYPPIPEGPAPSTLPQPNIATQPRVLSTEGPFPAPEERRKLDLLEERLRAVEGFGDYPFADMTDLCLVPDVVIPPKFKVPDFD

SEQ ID NO: 131663 - protein, 65 aa, Glycine max
  Coding DNA Sequence Number=SeqID_39978
MATIALSSRYGSKLAYDTGIWGGLRHWNNDIVGFGGKIGRIGMAVTAWIYFDPFTGEDQIRKALR

SEQ ID NO: 131664 - protein, 166 aa, Glycine max
  Coding DNA Sequence Number=SeqID_39979
RGLHVLAIRGLHALTFRGLHVLALRGLHALTLVTLTVRGLHALTLKGLHVLAGRGLHALISRGLHLLALRGLHALTFRGTTCPHFHSFLLTVPGPPPDIGGGPTVRAQPEREAITQLLCIPGQDFIRAAVKRRVATRPRHQRAARPHLQRTTRPRLERATRPHLEY

SEQ ID NO: 131665 - protein, 161 aa, Glycine max
  Coding DNA Sequence Number=SeqID_39980
  Gene Ontology: Biological process=transposition, DNA-mediated
  Homolog annotation: Hit_ID=Q1J7G7; Match level="QueryCoverage=25%, HitCoverage=71%, E-value=3e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMFHLTGEPLGRWRDP

SEQ ID NO: 131666 - protein, 125 aa, Glycine max
  Coding DNA Sequence Number=SeqID_39981
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=41%, E-value=4e-17, Identity=97%"; Hit description=LacZ protein
MKHFTDTLISANISGRHRGGAPIRPIVSRITIHWPSFYNVVTGENTGVTQLNRLAAHPPFASWRNSEEARTDRPSQQLRSLNGEWDAPCSGALSAAGVVVTRSVTATLASADVRRCFCRYAPPRQ

SEQ ID NO: 131667 - protein, 121 aa, Glycine max
  Coding DNA Sequence Number=SeqID_39982
  Homolog annotation: Hit_ID=Q6UUU1; Match level="QueryCoverage=58%, HitCoverage=46%, E-value=4e-19, Identity=71%"; Hit description =Putative uncharacterized protein
MGLRKRVRIRIALRSTARFPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 131668 - protein, 208 aa, Glycine max
  Coding DNA Sequence Number=SeqID_39983
  Gene Ontology: Mol. function=oxidoreductase activity, acting on the CH-OH group of donors, NAD or NADP as acceptor; Cellular component =phagocytic vesicle; Biological process=metabolic process
  Homolog annotation: Hit_ID=A7MR93; Match level="QueryCoverage=100%, HitCoverage=50%, E-value=1e-101, Identity=89%"; Hit description =Putative uncharacterized protein
  Pfam annotation: Domain name=2-Hacid_dh_C; Domain location=1-92; Score=43.1; E_value=2.8e-13; Accession=PF02826.10; Description=D -isomer specific 2-hydroxyacid dehydr
  Pfam annotation: Domain name=ACT; Domain location=138-202; Score =49.3; E_value=1.3e-11; Accession=PF01842.16; Description=ACT domain
  Pfam module annotation: Pfam domain module=2-Hacid_dh_C::ACT; Domain location=1-92::138-202
MSDVVSLHVPETPSTQNMIGSEELALMKPGALLINAARGTVIDIPALCNALASKHLAGAAIDVFPVEPATNSDPFNSPLCEFDNVILTPHIGGSTQEAQENIGLEVSGKLAKYSDNGSTLSAVNFPEVSLPMHAASASRLLHIHENRPGVLTAINQIFAEQGINIAAQYLQTSPVMGYVVIDIDAEEDVAEKALQLMKAIPGTMRARL

SEQ ID NO: 131669 - protein, 131 aa, Glycine max
  Coding DNA Sequence Number=SeqID_39984
MNNGFEAFSPHGQDHLGLPSGVETKHERQKPIKVLKNGCKWGWGHGRPIVAPSLRETSRECRCKAAPYPLYFAAFFYYLFVLKSKISNQHLNSNLSKFKLGKMLIHEKGGDMVSSPGRAGLAWASHPCTKL

SEQ ID NO: 131670 - protein, 15 aa, Glycine max
  Coding DNA Sequence Number=SeqID_39985
MADQQATKSRAKGCT

SEQ ID NO: 131671 - protein, 165 aa, Glycine max
  Coding DNA Sequence Number=SeqID_39986
MAPTRHPLDPYKSNRALRFPALITGLCQSFGVPVTPNKVIRPPITRAFIEKYYTQRQVQGDAPQAADVSPPHQAGPAGSFDTEQYLRHLVRQQAANHRAHGFTSFPCPTPDQFRAEVAWPRDWPEAQAGEAPAGAPAEAPDEADEAREDEEMTDLLDFLGGSGAT

SEQ ID NO: 131672 - protein, 56 aa, Glycine max
  Coding DNA Sequence Number=SeqID_39987
PLIELVRNHVPSWEDAQQMGVEGRIPGYEEPRDLRSNSFQGGGNATPQGHWVEDSK

SEQ ID NO: 131673 - protein, 82 aa, Glycine max
  Coding DNA Sequence Number=SeqID_39988
MSRWHELAGGDGHPVGLTEARNQSWKPQGPVGLLRSGHVGAHDPHSSLCSGTASLSGCARTVGRPPISGGGPGTKKRKLLVP

SEQ ID NO: 131674 - protein, 98 aa, Glycine max
  Coding DNA Sequence Number=SeqID_39989
MTSRDQDWSFCTHDTRRYLMVIRTLLSSRGGGPDDKQRPKTKFGHSAPMIRGDTLRLFAPFCHPEAAGPMTSRDQVWSFCTLVSSRGGGPDDTRKYPS

SEQ ID NO: 131675 - protein, 309 aa, Glycine max
  Coding DNA Sequence Number=SeqID_39990
  Homolog annotation: Hit_ID=Q6WAY6; Match level="QueryCoverage=28%, HitCoverage=15%, E-value=3e-07, Identity=35%"; Hit description =Putative uncharacterized protein
KVHVVAILVDLFDTFDRSAINWFPRWKEGKEGVLFSCGDYPNVPLIGTRGCINYNPTLAIIQLRYPKRGALTEGSLSPFLVKDLGAQGLKFILSIHKAWRSPLRKDKELRGIRNGVIGRYHGWLRVHTRGLDWLSKLKVIDEENFEAPEEDEEEKFKSAATHIRKECTELQEENAATGRALEQETKRARKQEHGREKFQGALWGSNNELKLRREERDRSRVSLAQHLEATEQSMLAIIGQYKEELNQSVTHEQKLAEDFAQVYAEKEARGRVINALHQEATMWMDRFALTLNGSQDLPRLLAKAKAMAE

SEQ ID NO: 131676 - protein, 330 aa, Glycine max
  Coding DNA Sequence Number=SeqID_39991
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=62%, E-value=2e-88, Identity=84%"; Hit description =Photosystem I P700 chlorophyll a apoprotein A1
  Pfam annotation: Domain name=PsaA_PsaB; Domain location=1-326; Score =286.0; E_value=7.6e-83; Accession=PF00223.10; Description =Photosystem I psaApsaB protein
LDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNWGVLFARSSRLIPDKANLGFRFPCDGPGRGGTCQSDVWGSISDQGIVNHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGGIATTWAFFLARIIA

SEQ ID NO: 131677 - protein, 58 aa, Glycine max
  Coding DNA Sequence Number=SeqID_39992
MSPFEGEGVHPLKARACSPLKVRASNPLEARTYSPPKGRTCSPLKTVIDYTILVIDYQ

SEQ ID NO: 131678 - protein, 211 aa, Glycine max
  Coding DNA Sequence Number=SeqID_39993
  Homolog annotation: Hit_ID=Q6WAY4; Match level="QueryCoverage=85%, HitCoverage=35%, E-value=1e-20, Identity=32%"; Hit description =Putative uncharacterized protein
MGTNQNGKGFYQVKIKGLHITSIKELGRLMGPLQMQAFHKAYGKILDLTIAEISTEAIASLTQYYDQPLRCFTFGDFQLVSTIKEFEEILGCPLGGRKPYLFSGFLPSLSKIAIVVRDSARGLDRVKQTQNGIVGLPRKYLEGKARDMVNQEDWVPFMDVLALLIFGVVLFPNVDGLVDLAAIDAFLTYHHSKESPGGSYLGGLIQHISPK

SEQ ID NO: 131679 - protein, 165 aa, Glycine max
  Coding DNA Sequence Number=SeqID_39994
MAYPPNYTPPTMHLPNENVHHVVPISFEGQQPLSVGGAREEPRKHAQGDFNPYPTFTAKGLVCNDMPKPNTAGAPQPRPLQPLHFSVGGPPLAMEVREKLDLIEERLRVVEGFGDYPFAEMTELCLVPDVVIPPKFKVPDFDKYKGTTCPKKSPKDVLPKNGGIP

SEQ ID NO: 131680 - protein, 334 aa, Glycine max
  Coding DNA Sequence Number=SeqID_39995
STLEDPRVEHQQCFEAIKGWSFHREKRVQLRDDEYIDFQEEIARQRWTSLVTPMAKFDPDIVLEFYANAWPTQEGVRDIRSWVRGQWIPFDADALSQFLGYPLVLEEGQECEYGQRRNRADGFDEEAIAQLLCIPGQDFAQTAAGRRVRIMRTNITTLTQTWMTLLLSNILPSNHNSDLPLPKCQLVYAILTRMSVHVAQLIADAIYLFAGMPPTRHPLDPNKSNRALGFAELIMGLCQSFGVPVTPSKAANHRAHVQTHDCLYQLSLSLQSQGFSSFPCPTLDQFRVEVAWPGDWPEAQAGEAPAEAPSEADQARMDEEMTDLLDFLGGSGAT

SEQ ID NO: 131681 - protein, 188 aa, Glycine max
  Coding DNA Sequence Number=SeqID_39996
MKDSKALSSKAKRKEKEEKDSRKKIVKKDNHFATKGDIKRALLLKQSFYLLLSRETSLSTAIPFELEVIPQVKELLDEGLVRKSLNPCALLVPKIGIIRHQIPMIGGMMNVLSGATLFCKITHAPNIFMICVHRDSLGRNNQHENKEKGIFYSITFLKSLNSDQGLPMDPKRIKVLRKESMSFKNLWN

SEQ ID NO: 131682 - protein, 116 aa, Glycine max
  Coding DNA Sequence Number=SeqID_39997
MPPRKLSTKRSRKDAAAEGISATPEFDSHRFRSAEHQQRFEAIKGWSLHRERRVQLRDDEYTDFQEEIARRRWTSLVTPRAKFDPDIVLEFYAKAWPTEEGMRDMWSWVKGQWIPF

SEQ ID NO: 131683 - protein, 53 aa, Glycine max
  Coding DNA Sequence Number=SeqID_39998
MGALITNDGSRDSKPAKQIRSNKIHNNPSIVSSGINEALGLNLELGLDLKRAD

SEQ ID NO: 131684 - protein, 335 aa, Glycine max
  Coding DNA Sequence Number=SeqID_39999
MALPRKNESSSIPSFNNIEDTSQAFPEDWFIPGKWVNFQSLKEEGFDVKGLFDRVGRTSFLENFNTWHYGPYALFWETARQDGVNIKGTFVRTQVVISLTTIIVVSACALDGLTMSKDWEKEITLETMDKLLYGKPHPDRNGNKALNTFLRIANLTYLCRMIHNVLFNTVMPRLHSRHYVSDRDHFCICKIMVGEKTQEELAKPSQPRHKLPTKRKDHPPSSNPKPPTSAKKPRTQPPSNPKKRTAHHFWAKHNISALNAIEEYGRPSISRPCAKHEICLQSAAVVFSQAQRMTGANSNPLTHAKHEENSRVHHSAYFEKRALEAARGATFAKRP

SEQ ID NO: 131685 - protein, 186 aa, Glycine max
  Coding DNA Sequence Number=SeqID_40000
LDDTLSEEDDEEANIWMMADITFEGFELYQKDEVNFDDPKSLRKAYHELLSYSYIVSKAYKNLRRDFKNLSQEHKKSMSFLNNELLKYQELKGQPQDVVKLHEEIRTLKSTLSKFFNGRKNLNKLLGYYRSSLDEFGNGYDGKALDLLHKWSPLLLEINGSGMEKEERKLEAPLQGEDKSRTSSPP

SEQ ID NO: 131686 - protein, 68 aa, Glycine max
  Coding DNA Sequence Number=SeqID_40001
DCHHQKGGDCGSNVFQGYFDDAKESKVKQSFKQRFKNQVSSSKIQDSRKIKIKIQDSRFKNQEKTQSR

SEQ ID NO: 131687 - protein, 266 aa, Glycine max
  Coding DNA Sequence Number=SeqID_40002
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDDDALRDELVKSRKAACRKANKLPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131688 - protein, 159 aa, Glycine max
  Coding DNA Sequence Number=SeqID_40003
  Homolog annotation: Hit_ID=A5AK77; Match level="QueryCoverage=55%, HitCoverage=11%, E-value=3e-11, Identity=39%"; Hit description =Putative uncharacterized protein
MTRGNPGDLQPFDPEIDRTFHILVRHSVHPGHFEHFEHSVAGDSEYSDFEHSTNNFHTENMAQPPPRERTLREMAAPDFTYESLCIQYPDEGVPYVLKTGLIHLLPKFHGLAGEDPHKHLKEFHIVCYTMKPPDVQEDHIFLKAFPHSLEGLAKDWLYY

SEQ ID NO: 131689 - protein, 60 aa, Glycine max
  Coding DNA Sequence Number=SeqID_40004
  Homolog annotation: Hit_ID=A7NSI9; Match level="QueryCoverage=81%, HitCoverage=20%, E-value=1e-13, Identity=71%"; Hit description =Chromosome chr18 scaffold_1, whole genome shotgun sequence
HKVDFKDNRSVDPERYTFSLTGTKPISLEDKRKLGEGYSPLLQTSIPEKMETLTSHFHTE

SEQ ID NO: 131690 - protein, 30 aa, Glycine max
  Coding DNA Sequence Number=SeqID_40005
SPSFWHGKGLCGIDEQGQKGIFKWRDEESV

SEQ ID NO: 131691 - protein, 62 aa, Glycine max
  Coding DNA Sequence Number=SeqID_40006
  Gene Ontology: Mol. function=catalase activity; Biological process =response to oxidative stress
  Homolog annotation: Hit_ID=Q1GY50; Match level="QueryCoverage=93%, HitCoverage=17%, E-value=1e-14, Identity=67%"; Hit description =Catalase-like protein
MADDKPVTEQLVDTLTTLSGGPHAGFRANHAKGIMVEGTFTPTVQAASVSKAAHFQKATPVL

SEQ ID NO: 131692 - protein, 410 aa, Glycine max
  Coding DNA Sequence Number=SeqID_40007
  Gene Ontology: Mol. function=signal transducer activity; Cellular component=membrane; Biological process=signal transduction
  Homolog annotation: Hit_ID=A1TV44; Match level="QueryCoverage=95%, HitCoverage=54%, E-value=9e-50, Identity=30%"; Hit description =Diguanylate cyclase/phosphodiesterase precursor
  Pfam annotation: Domain name=GGDEF; Domain location=287-410; Score =45.6; E_value=1.7e-10; Accession=PF00990.12; Description=GGDEF domain
  Pfam annotation: Domain name=HAMP; Domain location=213-282; Score =60.7; E_value=5.1e-15; Accession=PF00672.16; Description=HAMP domain
  Pfam module annotation: Pfam domain module=GGDEF::HAMP; Domain location=287-410::213-282
LIPLKYALVKHANTLAEDQIDVGQRVFVSLLQHNTQSLKQATQVLAADFAFREAVATNDAETIESALESYQGRIRAQIAFYISSDENLIVGTSDAKAILNSVDAREDSRQAIIQSNAGTLKFDIVDGKPYQLITVPVKAPETIGWIVMGFAVDSQLASQIKQLTHLDVTFVQKPHAQDWQLRCMKRDDEALLVVLQGSVAPFTQDLNILFKVMIFLTFVGVVIFAVLIWYVSRKTTEPIAALVKDADKMAMGDYETEIQVNSTDEVGFLAKAMNNMREAVLQRSLRIQRLAFNDELTGLSNRLAFNQGVHQAILTHADRQQKLSVIVINIHRFKPINKTLGRDFGDDLLRHVGQVLKQNCLGEQDMVARLDADEFAVLLQHTDQAKATQYANKVQQIFERPVNVQGQAID

SEQ ID NO: 131693 - protein, 219 aa, Glycine max
  Coding DNA Sequence Number=SeqID_40008
MVVISPGKIYQPPFPKWYDPDATCAYHGKTPGHSTERCLALKYKDQPNMKTNPLANHGGGVVNVVKSGRPRIVQAFEGRDDPQESVDEGSFGKPKPLVVYFTRDAAPQTPRYPSVVKPISFSYQNSHAVPWRYVPPSERKEEATDISSLSAKVTNITGLSGVTRSGRVFAPPDLPTQPANVKGKAKIAEEQNDKMIPTPNENIPVKGLSEKKDGCGKKE

SEQ ID NO: 131694 - protein, 133 aa, Glycine max
  Coding DNA Sequence Number=SeqID_40009
  Homolog annotation: Hit_ID=UPI0000ECBAF8; Match level="QueryCoverage =29%, HitCoverage=48%, E-value=8e-13, Identity=90%"; Hit description =UPI0000ECBAF8 related cluster
MNCVFVHASSTPEFGAMRSDFLVQLSILNSFLEPHELRFGYGPLNRAHKTPSRLGGVQQGPGVSSSGYGPLLVLGILQSRPAGMQAWHWPSFYNVVTGKTLALPNLIALQHIPPSMVIAKRPAPIALPNSCAA

SEQ ID NO: 131695 - protein, 97 aa, Glycine max
  Coding DNA Sequence Number=SeqID_40010
MVTQFVKFHNATETKRKYCCAIRPLGPSRFFLQKAIASRGSNLARLGELGGKLLPYFAINRGRSEEERGSAFLTLRILLKLLRKIVSVKKIQAETLP

SEQ ID NO: 131696 - protein, 73 aa, Glycine max
  Coding DNA Sequence Number=SeqID_40011
  Subcellular localization annotation: CTP_CleavageSite=49; ConfidenceScore=5.14e-01
MKMKANKTRNELKVSDSNTYRLKTKERMKNGQRTVKNGGKSSRICSRKRLGSVTEAPRLGFSSRKHVFFTQNS

SEQ ID NO: 131697 - protein, 96 aa, Glycine max
  Coding DNA Sequence Number=SeqID_40012
TPSGPEEGQQGLGVASSNYGPLSVLQSVRHPQQGHQAPTNRAFIKKHCALRQVQGETPQQPGDGRLRAIDAPPPPSEPLSSFTKRLEYCLRHMADQ

SEQ ID NO: 131698 - protein, 123 aa, Glycine max
  Coding DNA Sequence Number=SeqID_40013
MDNEEGVQEQMKADLSALKDQMASITEVVLKLQKTIEDNSMTAASNTAREAEPVLQPAINLGRDRNMTVLGRRYSPQAYPYDLPSDFTPRTAPDDLSQAPTFVGQLPPYADYPFQKMMKEMPI

SEQ ID NO: 131699 - protein, 132 aa, Glycine max
  Coding DNA Sequence Number=SeqID_40014
MGEVEEIQEKMKADMEAMKEQMATMMAMMSMRKIMEANAVTIAATSTVAKVNPMPPSGLNQMNHPTLDMVGKDLGSRGGPHYAQNKHAFPPYGLPPNYMPPNVAYTPNKNVNNSTPIPIESQQPQTDHAHVS

SEQ ID NO: 131700 - protein, 159 aa, Glycine max
  Coding DNA Sequence Number=SeqID_40015
MTQSLAFSKGWTLGGLHALTFRGLHALAFRGLHVLAFRGLHVLHLRRPHVLAIRGLNILAFRGLHILAFRGLHAFAFRELHALTFKGLHALNFRGLHVFALRTTCPHLQTTICPHTKRATRPRLLRTTRPRLEEYTSTPSEGCTPSPSEGFTPSPSKDY

SEQ ID NO: 131701 - protein, 92 aa, Glycine max
  Coding DNA Sequence Number=SeqID_40016
MATFSHMQSQFESQMQSQGLALPPEPLVGPSGPQVSTKESCVDPSANDPKTGDSDRCDLYIEANPTILVALGRVYEGSTVAHNTPLLPGQVK

SEQ ID NO: 131702 - protein, 87 aa, Glycine max
  Coding DNA Sequence Number=SeqID_40017
  Gene Ontology: Mol. function=nucleic acid binding; Biological process= DNA integration
  Homolog annotation: Hit_ID=A5B8B4; Match level="QueryCoverage=44%, HitCoverage=6%, E-value=2e-09, Identity=74%"; Hit description =Putative uncharacterized protein
  Pfam annotation: Domain name=RVT_2; Domain location=1-85; Score= -182.5; E_value=0.012; Accession=PF07727.5; Description=Reverse transcriptase (RNA-dependent DNA pol
MDGYVDRYKARLVAKGYTQQAGIDFSNTFSPVAKLTTAGCEATMESAFPDSDVVEWRLVVKGTDDLGLDGFALGEHHLSIVKVPEVS

SEQ ID NO: 131703 - protein, 104 aa, Glycine max
  Coding DNA Sequence Number=SeqID_40018
MVGQKVLLYNSRLGFMSVEIKSDSTNKSFKVNGLDLSRFIASRTLFNVEDLSTCEQCESRKLHLLATPTLMPRNLCYSMRCLMSGLTNVSNGWKPSPSRTNEFC

SEQ ID NO: 131704 - protein, 118 aa, Glycine max
  Coding DNA Sequence Number=SeqID_40019
MEEQMRCLLYSFSTERTSHNRPDNYLKGIINSAIKGLDDAPQPKSKAPARWIVVKCNRQKGTTECGYYVMHWMSTIILGSFRNNWEAYFNDPRPLEPERLKALRIQWAQFYLRVRDQA

SEQ ID NO: 131705 - protein, 243 aa, Glycine max
  Coding DNA Sequence Number=SeqID_40020
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDVICPYRFVQAIFHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131706 - protein, 95 aa, Glycine max; identical to SEQ ID NO: 109893
  Coding DNA Sequence Number=SeqID_40021
  Homolog annotation: Hit_ID=A0PAV3; Match level="QueryCoverage=40%, HitCoverage=17%, E-value=5e-07, Identity=76%"; Hit description =Restriction endonuclease

SEQ ID NO: 131707 - protein, 38 aa, Glycine max
  Coding DNA Sequence Number=SeqID_40022
KWVYDPNMENARMSKHENKWYAILQIKKFVERLCMMMP

SEQ ID NO: 131708 - protein, 220 aa, Glycine max
  Coding DNA Sequence Number=SeqID_40023
  Homolog annotation: Hit_ID=P0ADS0; Match level="QueryCoverage=100%, HitCoverage=48%, E-value=1e-112, Identity=90%"; Hit description =Uncharacterized protein ygdH
  Pfam annotation: Domain name=Lysine_decarbox; Domain location=1-98; Score=79.0; E_value=1.5e-20; Accession=PF03641.5; Description=Lysine decarboxylase family
MPDIEKRLEAFVRIAHGIIIFPGGVGTAEELLYLLGILMNPANKDQVLPLILTGPKESADYFRVLDEFIVHTLGETARRHYRIIIDDAAEVARQMKKAMPLVKENRRDTGDAYSFNWSIRIAPDLQIPFEPTHENMANLKLYPDQPVEVLAADLRRAFSGIVAGNVKEMGIRAIEQYGPYKIHGDREMMRRMDDMLQGFVAQHRMKLPGSAYIPCYEICT

SEQ ID NO: 131709 - protein, 278 aa, Glycine max
  Coding DNA Sequence Number=SeqID_40024
  Gene Ontology: Mol. function=motor activity; Cellular component=cell projection
  Homolog annotation: Hit_ID=UPI00016621D1; Match level="QueryCoverage =64%, HitCoverage=41%, E-value=1e-14, Identity=32%"; Hit description =UPI00016621D1 related cluster
  Subcellular localization annotation: CTP_CleavageSite=70; ConfidenceScore=5.75e-01
MPTRPRLRRAARPHLQRTTRPRLQRTTRPPLQRARRPHSQRTTRPRLQRATRPRLQRTTRPPLKWATPLRLQRATCPHFQRTTRPCLRGLHVVSFKGVHALAFIGLYVLTFRGLHVLTIRGLHVVALRGLRVLPFRGLHALALRGQHVLAFKGLQVLTFRRLHVLTLRGLHALAIRGLHVLGFRVLHALTFRGLHVIPFRGLHVLVFTGLHALILRGLHVLVFRGLHDLTFRGVHVLAFRGLHAFTFRGQHVLPLRGLHAVAFKGLHVLIFRGHTSLL

SEQ ID NO: 131710 - protein, 260 aa, Glycine max
  Coding DNA Sequence Number=SeqID_40025
LGGMPRLKGPVPLPSLTAIVPPSAKHQQRFEAIKGWLFHRERRVQLRDDEYADFQEEIARRRRAGHAVMGKGPVDPFDADALSQFLGDPLVLEEGRDFAPTAAGRRVRIMRTSMTTLTQMWITLLLSNILPSDHNSDLPLPKCHLVYAILTRMSVHVAQLIADAIYLFTGMPPTRHPLDPDKSNKALGFPALITGLCYIERLDKRRVMHRRPQTHRHHLIRLVQLGHLAWSGIYSTWFASRRPTTGGRAEVAWPRDWPEA

SEQ ID NO: 131711 - protein, 44 aa, Glycine max
  Coding DNA Sequence Number=SeqID_40026
GADNRKVSPRVIWPAASGCPPPLDDKDYGCGRQKQGSCSAVILQ

SEQ ID NO: 131712 - protein, 149 aa, Glycine max
  Coding DNA Sequence Number=SeqID_40027
MGIAPTKTPSEPEEVQQGPGVSSSGYGPLSVLQGARTPPARSRHHRDRDCKTPSGPEEVQQGLGIFYGVPVTSSKGIRPPTNRAFIKKYCAPDRRRAKHHSSIGMVGSGEIDAPPSPLGVHLCSSTKRFEVLPTPHGRPIGGPSPKAKR

SEQ ID NO: 131713 - protein, 309 aa, Glycine max
  Coding DNA Sequence Number=SeqID_40028
  Homolog annotation: Hit_ID=Q2HW90; Match level="QueryCoverage=41%, HitCoverage=25%, E-value=2e-14, Identity=37%"; Hit description =Putative uncharacterized protein
MHEYHIPFCLCSVNIVILCTFPHCVFCIGIAYGFFLIPTVNKPTEGPCRLLKNVRWGILLPLDVVSKKGTNSPDPRIPRLHLCHMHSIMHSSIPPMRYRSFDLHQLLSHFSKHGNKSNRQEVLPSQGQKPRYHQHQGIRAVDGTPPNASLPQDLRKDLRVDHSRGVHRSHCITYPILRPALRCFTFGDFQLVPTIEEFEEILGCPLGGRKPYLSSGCLPSLSRIATVVKDSARGLDRIKQTRNGIAGLPQKYLEDKARGMANQGDWVPFMDVLALLIFGVVLFPNVDGLVDLAAIDAFLAYHHSKESPV

SEQ ID NO: 131714 - protein, 82 aa, Glycine max
  Coding DNA Sequence Number=SeqID_40029
LEVNTQERRSLEQTDQWLALENPDESLETSNNNLAPYASEPYNAQWNAPGLLRDKHTLRSSRILGEMEVVFVIGSAVDRLCG

SEQ ID NO: 131715 - protein, 147 aa, Glycine max
  Coding DNA Sequence Number=SeqID_40030
MRGAPLEEELAPIIARGFNKTNVEVLQKVRKAWEMVQKKDKELIGNNNGLIGSYRRWLKAHFQDLDWLPSLRTTKGVEVEAPEEDEEVQALRAELEQAQSVKERFKSAALKIRKENAELRDVNKATTKALERETKRARRKEYGRNKF

SEQ ID NO: 131716 - protein, 241 aa, Glycine max
  Coding DNA Sequence Number=SeqID_40031
  Homolog annotation: Hit_ID=A7UQU7; Match level="QueryCoverage=53%, HitCoverage=21%, E-value=6e-18, Identity=38%"; Hit description=IMP dehydrogenase/GMP reductase, putative
ACRTTTRQLAGYLTLLQCWIYEHFPSVHQCVTDDTYQETSPRASRWLTSKAHMKGITGAPYRARCDGLIVTDVSWLPYTEHRGVRAFQEISSFQGQLRWGPMIVTVRPERVVRQFGYIQSIPPPPVSARLSQDQIDDRYLRITLSGFFRISHPFMTPTQAADQQRDAPATDPEDYIQPPSPQVPVAFDPPPHVDDYEGYEAIAQRLERVLNLRIVTAGTELYDIMQDCLTIARGGPSADGT

SEQ ID NO: 131717 - protein, 97 aa, Glycine max
  Coding DNA Sequence Number=SeqID_40032
MEQYLRHVVRQEAANHRAHVRTNETLYQLSLSMQSQGFASFSCPTPDQFRAEVAWPGDWPEAQVGEAPPEAPDDGEEAHEDEEMADLLDFLGGSGAT

SEQ ID NO: 131718 - protein, 75 aa, Glycine max
  Coding DNA Sequence Number=SeqID_40033
  Gene Ontology: Mol. function=2-dehydropantoate 2-reductase activity; Cellular component=cytoplasm; Biological process=pantothenate biosynthetic process
  Homolog annotation: Hit_ID=A6T5F9; Match level="QueryCoverage=100%, HitCoverage=24%, E-value=1e-34, Identity=90%"; Hit description=2 -dehydropantoate 2-reductase
MKVTVLGCGALGQLWLTALYKNGHEVQGWLRVPQPFCSVNLIETDGSNFNESMTANDPDFLATSDLLLVTLKAWQ

SEQ ID NO: 131719 - protein, 158 aa, Glycine max
  Coding DNA Sequence Number=SeqID_40034
  Homolog annotation: Hit_ID=A5BKB8; Match level="QueryCoverage=84%, HitCoverage=39%, E-value=1e-38, Identity=65%"; Hit description =Putative uncharacterized protein
MGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPNSNLLSATPGGPETVSRGSRHDTTFTYMTLGTDISALASMKN

SEQ ID NO: 131720 - protein, 79 aa, Glycine max
  Coding DNA Sequence Number=SeqID_40035
MAYTHIPVKVENPGFYTRFSSNFSQHQLDLAPYTSEPYNAQWNAPGLLCDKHTLRSSRILGEMEVDEPWLGLWLPLNYQ

SEQ ID NO: 131721 - protein, 127 aa, Glycine max
  Coding DNA Sequence Number=SeqID_40036
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=41%, E-value=5e-18, Identity=100%"; Hit description=LacZ protein
MKHFTDTLISANISGRHRGGAPIRPIVSRITIHWPSFYNVVTGENPGVTQLNRLAAHPPFASWRNSEEARTDRPSQQLRSLNGEWDAPCSGALSAAGCGGYAQRDRYTLPALMSGGAFAVTHHPVSS

SEQ ID NO: 131722 - protein, 132 aa, Glycine max
  Coding DNA Sequence Number=SeqID_40037
MVLKEELAACSRSKRNLSQRLCETEISMLAIVNKYQEELNLAMAHEHKVADEYAQEYMEKEARGRVIDSLHQEATMWMDRYALTLNRSHELPRLLPKAKAMANTYSSPEEIHGLLSYCQHMIDLMTHIIRNR

SEQ ID NO: 131723 - protein, 216 aa, Glycine max
  Coding DNA Sequence Number=SeqID_40038
  Gene Ontology: Biological process=transposition, DNA-mediated
  Homolog annotation: Hit_ID=Q6UUU1; Match level="QueryCoverage=27%, HitCoverage=40%, E-value=2e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131724 - protein, 249 aa, Glycine max
  Coding DNA Sequence Number=SeqID_40039
GASTKESLSPFLVRDLGAQSLKVIQRVHKAWRSPLRKDKELRGIRNGVIGGYHGWLRVHTRGLDWLSKLKVINEENFEAPEENVEVRALKLELFVRQDSPRRSSNQSLHTSGKSAPSYKRKTRPLQEPLNKKPKGPTKRNMAERNFEEHCGSLAACARSKRSLAQHLEATEQSMLAIIGQYKEELNQSVTHEQKLVEDFAQVYAEKEARGRVIDALHQEATMWMDRFALTLNGSQDLPRLLAKAKAMAE

SEQ ID NO: 131725 - protein, 143 aa, Glycine max
  Coding DNA Sequence Number=SeqID_40040
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=2e-24, Identity=70%"; Hit description=LacZ protein
MEPSWKTLCRILSWRTSPISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131726 - protein, 147 aa, Glycine max
  Coding DNA Sequence Number=SeqID_40041
MGEVEEVQEQMATMMEAMMSMKKIMDANAVAVAATSVVAKVNPMPPFDLNHMNHPTSNMVGQDLGSTGSPHDVQIQNEYVFPPYGLPPNYTPPNVAYTPDEDVNNSALILIESRQRHHAHVSQPMGETYEIPHHNLADFEPCLGYAT

SEQ ID NO: 131727 - protein, 116 aa, Glycine max
  Coding DNA Sequence Number=SeqID_40042
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=47%, HitCoverage=70%, E-value=4e-11, Identity=55%"; Hit description=LacZ protein
MDGGEKGVRVWVGIVVNALLALSKRSEVVSYKSQSNSCSPGDPLVLERPPPRWSSNSPYTHPPFASWRNSEEARTDRPSQQLRSLNGEWDAPCSGALSAAGVVVTRSVTATLASAD

SEQ ID NO: 131728 - protein, 71 aa, Glycine max
  Coding DNA Sequence Number=SeqID_40043
MAEINQGKTMTGHDRPRIFVSYLHVHRDGSSGARVTTDRSLPLPGAKQTENVAARQPSILCSRIFFYYCLF

SEQ ID NO: 131729 - protein, 137 aa, Glycine max
  Coding DNA Sequence Number=SeqID_40044
MDNEEGVQEQMKADMSALKDQMASITEAMLKIQKSIEDNATTTASNTAREAEPVLQPAINLGRDRNTTGFNRRYSPQAYPYGLPPDFTPRTAPDDLSQAPTFEGQLPPHADYPLQEDDEGDAHLGPLLPLKEPPPPP

SEQ ID NO: 131730 - protein, 59 aa, Glycine max
  Coding DNA Sequence Number=SeqID_40045
MTNKAKGKGKEVAGKGSAGKRKGAFDDDKTGGDRKRNKRGRVECTVSPVIFFGFVDVQT

SEQ ID NO: 131731 - protein, 125 aa, Glycine max
  Coding DNA Sequence Number=SeqID_40046
MTKGCGITRKVSPAYHPGPPPLDDTRVQNDQTWSPACHRAPPPLDDTNFIPLDLTRVAASKDQTWSHVIKQVPPGRQIRVMTLRYPPRMTESGAHEISAMMTPGEQGCRMTKLWSLHAIGPVRLG

SEQ ID NO: 131732 - protein, 58 aa, Glycine max
  Coding DNA Sequence Number=SeqID_40047
MSPVESPTVATCPSRASEGEAHGCAFQRRKDARSCHQRRQKQGFCSYVPSFGEEIKPT

SEQ ID NO: 131733 - protein, 46 aa, Glycine max
  Coding DNA Sequence Number=SeqID_40048
MYVRHGLSHTRRHLSQPGRIRVEFAHWALKGYYRIALETSVVFGMQ

SEQ ID NO: 131734 - protein, 120 aa, Glycine max
  Coding DNA Sequence Number=SeqID_40049
  Subcellular localization annotation: CTP_CleavageSite=44; ConfidenceScore=5.48e-01
MAPQLNQAQSQNSDKLPSQTMQNLKNVSAITLRSSNQIPVPPPVAAPAPEPVKLHSTPEKEDEIVAQKRKLPNKNFHQPPIALPFPPRAIPNKKMEEAEKEILETFRKVEVNIPLLDAIK

SEQ ID NO: 131735 - protein, 147 aa, Glycine max
  Coding DNA Sequence Number=SeqID_40050
MGKVEEVQEQMKADIEAVMSIKEIMEVNAAAIVVTSTIVEVDLTPPPPIWPQPNKSSNLIYGRQRFRRYGWPLFSAKNEHAFPPYGLPPNYTPPNVAYTPSEDVNNSAPILIENLKLIMHISLDPWGRYTKCPTKSSRLRALPQICH

SEQ ID NO: 131736 - protein, 159 aa, Glycine max
  Coding DNA Sequence Number=SeqID_40051
MNMFIDRLRPQTKQLLDVTIEGKIKLKTPKEAIELIENMLQVVPSVVRLMKQANVFPLKKTLKKFIIWEINSGKVMTTKDDDKGDEQKPQRSKNKSSESKNISSESRTSQEFKNQEEFKTQEENLESRIKIQDSRSQESRSRFKTQDSRMKKRLNQDKY

SEQ ID NO: 131737 - protein, 143 aa, Glycine max
  Coding DNA Sequence Number=SeqID_40052
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=3e-24, Identity=69%"; Hit description=LacZ protein
  Subcellular localization annotation: CTP_CleavageSite=37; ConfidenceScore=5.04e-01
MKHFTDTLISANIPHQSCLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131738 - protein, 107 aa, Glycine max
  Coding DNA Sequence Number=SeqID_40053
MIKEVHEGSFGTHANGYAIARKILRAGVATYPSAGGRRETRGMRVPRKEYARSRHQRLFEENVGKTGKDAIYELLSERFGSCIYARGRVFPFAPTYSSIWDEKIRPT

SEQ ID NO: 131739 - protein, 424 aa, Glycine max
  Coding DNA Sequence Number=SeqID_40054
  Gene Ontology: Mol. function=nucleoside-triphosphatase activity; Cellular component=chloroplast
  Homolog annotation: Hit_ID=Q2PMM5; Match level="QueryCoverage=98%, HitCoverage=22%, E-value=1e-143, Identity=89%"; Hit description =Protein ycf2
MESIPTYIPWFLTSTGYKYLNFIFLDTFSDLLPILSSSQKFVSIFHDIMHGSDILWRIRQIPLCLPQWNLISEIWNLISEIPGNCLHNLLLSEEIIHRNNELLLISTHLRSLNVQEFFYSILFLLLVAGYLVRTHLLFVSRVYSELQTEFEKVKSLMIPSYMIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPKRRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSL

SEQ ID NO: 131740 - protein, 194 aa, Glycine max
  Coding DNA Sequence Number=SeqID_40055
  Gene Ontology: Mol. function=nucleic acid binding
  Homolog annotation: Hit_ID=Q2AA09; Match level="QueryCoverage=73%, HitCoverage=50%, E-value=3e-09, Identity=32%"; Hit description =Retrotransposon gag protein
MERSMIDAASGGALGDMTPAEARNLIEKMASNSQQFSARNDAIVIRGVHEVATSPSASSETKKLEGKLDALVNLVTQLALNQKSVPVARVCDLCPSMQQPGAIVQPKAYAANIYNRPPQPQQNNYDLSSNRYNPGWRNHPNLKWSSPQQQQQQPAPSFQNAAGPSRPYIPPPIQQQPQKQPTVEAPPQPSLEEL

SEQ ID NO: 131741 - protein, 135 aa, Glycine max
  Coding DNA Sequence Number=SeqID_40056
MAPEELEQLTQQIGTMWRSRSQKNQMQSQLQAQIHALPLEPEVGPSAARASTKGSCVDPLVTDPDTGDSDKCGGSQHPLLHGQVKVSVEEVKDADALILVPTDEAAVSPAKPIDRSDHEVDDPLYLMTLNIPQLF

SEQ ID NO: 131742 - protein, 26 aa, Glycine max
  Coding DNA Sequence Number=SeqID_40057
MENWRTALGNDIHGAPNNKRGNMGLS

SEQ ID NO: 131743 - protein, 137 aa, Glycine max
  Coding DNA Sequence Number=SeqID_40058
MLNGTPRGFSMTSTRCVRVVFSEKWRLRKPSRVYGYHCIIEWIWEQVSIGHRNLGEFYRNGSHSTSFSFILTLFICPSFLIRPSRMTKFASFQTHIDPFTGKDQIRKALKVPLELPGLSTFGRILLKDSCHLFAHVL

SEQ ID NO: 131744 - protein, 60 aa, Glycine max
  Coding DNA Sequence Number=SeqID_40059
  Subcellular localization annotation: CTP_CleavageSite=41; ConfidenceScore=5.30e-01
MVLVAAIAATLTSIISFMLIMASIIVAIFSFKAFVSAFICSCTSSTSPITLALSRVRRSS

SEQ ID NO: 131745 - protein, 172 aa, Glycine max
  Coding DNA Sequence Number=SeqID_40060
MASRKRARTEDIPSSSNPFPSTTTMEPDAQQAHSLIPMLQSLFRGQLMIVYNQQELAHNRPIISMEQFLEKVAWPEAHLPLERSHEVVPPELVLARIVVSPGPVPTRTEPTSAEPQSPVIDPPVSLGLEILSPLAPPLIIIPNDSTDEAHAPPNSPSCNIDDGSDFSSWMDC

SEQ ID NO: 131746 - protein, 101 aa, Glycine max
  Coding DNA Sequence Number=SeqID_40061
MVKQLRGKEIPLVKVVWGSASGEDATWELEGHKFPLYKPNVNLEQHFGKHILFLSSFLTHKNPNRATRGGALESTRDATIANREYLSDYIEVRDELLTLGD

SEQ ID NO: 131747 - protein, 236 aa, Glycine max
  Coding DNA Sequence Number=SeqID_40062
MVIDQSLFYDLTQLPSEGVPFKGTLIDDWKFDFSVHDARRLVCTNQADMTGRLLAGSLAFESRILHYLIVSEEDLIVMWAFHKGLQIDWAHLVRYRMHKALRLNAPLPYPHLVTLFLQHFNIPFDSEPYVPIKRSFLIGASVIASFGYQKEHDDSWVKKGAHVDEEGHGGEDSSLLQKILDRFDGLQTFVGERFDTLELQKDMCFNEMESRITKVEEDVSYIRSSFDLPPPLPPSS

SEQ ID NO: 131748 - protein, 142 aa, Glycine max
  Coding DNA Sequence Number=SeqID_40063
MTDRLLAGSLTIDNRIMHYIIVRILLPRSSNLAQASEEDLILMWAFLTGRQIDWAHLVRYRMHKALRANAPLPYPQLVTLFLHHFQIPLDDESFVQVKRSFAIGAGAVTSFGYRMDIRLTQLEEDVGYIHQSFNLPPPPPPS

SEQ ID NO: 131749 - protein, 71 aa, Glycine max
  Coding DNA Sequence Number=SeqID_40064
MELASGIITQDNNIVTARLTGALSKGGNMRGVATNEGISTSYVDKSGAFAPMYPPLERKSDLRSSFLCVNQ

SEQ ID NO: 131750 - protein, 40 aa, Glycine max
  Coding DNA Sequence Number=SeqID_40065
MVRMIHTGLLAAARVKSCPVGRPLISGGGPGTDKRKLLAP

SEQ ID NO: 131751 - protein, 208 aa, Glycine max
  Coding DNA Sequence Number=SeqID_40066
MASRKRKAPSTPTQAKFDRSRFTSQEAWGDTLTLWCLTLVVVEDGETLCAYSRFTLLRPDPQELAAKLCIPGRRFELNADGQPLKILRKNKTTLAQTWSVLSFSNLILTSHTSDVTLDRAKLIYGIIMKMDMNVGYLISHQISLIAQHDTSRQGFPAVITALCTARGVQSDSRSLESQSPAINLAYIKKNYWNLNDPTVTFRGPRMAK

SEQ ID NO: 131752 - protein, 355 aa, Glycine max
  Coding DNA Sequence Number=SeqID_40067
  Gene Ontology: Mol. function=motor activity; Cellular component=cell projection
  Homolog annotation: Hit_ID=P15305; Match level="QueryCoverage=99%, HitCoverage=96%, E-value=1e-22, Identity=22%"; Hit description =Dynein heavy chain
GLYILTFKGLHVLAFRGLQVLTFRGLHALTFRGLHVLAFGGLHVLAFRGLHVLTFRGLHVLAFKGLHTLTFRGLHVHAFRGLHALTLRGLHVLAIRGLRVLAFKGLQALTFKGLNFLAFRGLHALAFKGLHILTFRGLHDLAFRGLHVLAFRGLHALTLRGLHALNFRELHVLAFRGLHVLAFRGLHILAFRGLQTLTFRGQHVVAFRGLHVLAFRGLHVLPSRGLQVLTFRGLHVLAFRGLHALTFRGLHVLAFRGLYVLTFKGLHVLPSRGLHVLSFRGLHVLAFRGLHALTFRGLHVLAFRGLYVLTFKGLHVLAFRGLQVLTFRGLHALTFRGLHVLAFRGLHVLAFRGLH

SEQ ID NO: 131753 - protein, 273 aa, Glycine max
  Coding DNA Sequence Number=SeqID_40068
  Gene Ontology: Mol. function=transferase activity, transferring phosphorus-containing groups; Cellular component=membrane; Biological process=protein-chromophore linkage via peptidyl-cysteine
  Homolog annotation: Hit_ID=A5P3T1; Match level="QueryCoverage=98%, HitCoverage=38%, E-value=3e-70, Identity=53%"; Hit description =Sensor protein
  Pfam annotation: Domain name=HisKA; Domain location=185-253; Score =47.0; E_value=6.7e-11; Accession=PF00512.16; Description=His Kinase A (phosphoacceptor) domain
  Pfam annotation: Domain name=Phytochrome; Domain location=1-170; Score=62.8; E_value=1.2e-15; Accession=PF00360.11; Description =Phytochrome region
  Pfam module annotation: Pfam domain module=HisKA::Phytochrome; Domain location=185-253::1-170
MAGDEDFMAALRDDEASLLSLTGAAGAVIVHKGDCLRVGQCPSASDVLALANWLATQQAGQETYCTDHLAADWSPAAHLADVASGVLAVSISQLHDSYLMWFRPEVVRTVRWGGDPRKEAAPGVALSPRNSFEAWKETVQQRSLPWSDADCDAAHEMRTAIVDIVLRKAEEMAELNEQLLRINKELEAFSYSVSHDLRAPFRHIVGYSELLGSSAGERLNDTERRFLDTIVESAKSAGTLVDDLLSFSQMGRSTLGRVRMDMTELVEDVRWIL

SEQ ID NO: 131754 - protein, 187 aa, Glycine max
  Coding DNA Sequence Number=SeqID_40069
MRVRGHLIMFDEDTLNTFLKTPVVVEKGETLCAYSRFALLMPDPQELAAKLCIPGRGFELNADGQPLKILRKNMTILAQTWSVLSFSNLIPTSHTSDVTLDKAKLIYGIIMKMDMNVGGPRKARGKRSEVPTTSAPKTPVPSSSTASLPPTQIPIIPPVPLQIPLTAPLSAGPSDFIFTPQLLHSML

SEQ ID NO: 131755 - protein, 92 aa, Glycine max
  Coding DNA Sequence Number=SeqID_40070
MSWFLLYRIFSLRKKLAASLRYILLSLLEASCGYSLSSMYHLILKYQGLPSCSSSIKQKYAGLPRHLNSMYGKSPCGVNWNMDARVARASSI

SEQ ID NO: 131756 - protein, 65 aa, Glycine max
  Coding DNA Sequence Number=SeqID_40071
MKADAILPRKGPVTRAMSKRLQEDWARVDKEGLRVLMNLRLSSSFSRKLLKEVSLVFRWVCVAKL

SEQ ID NO: 131757 - protein, 44 aa, Glycine max
  Coding DNA Sequence Number=SeqID_40072
MGEALTSVSRIHEFHGVSNYEAKMQGRCVLRDLHATLKAFDSSS

SEQ ID NO: 131758 - protein, 61 aa, Glycine max
  Coding DNA Sequence Number=SeqID_40073
MLHHQLQMKDDHLLSQDEQALNEAKEAVAHVPATIVPPIARNKLTITRAKQRKVADKDDAV

SEQ ID NO: 131759 - protein, 210 aa, Glycine max
  Coding DNA Sequence Number=SeqID_40074
  Homolog annotation: Hit_ID=Q2HW90; Match level="QueryCoverage=91%, HitCoverage=38%, E-value=2e-21, Identity=35%"; Hit description =Putative uncharacterized protein
MGTNQNGKRFYQVKIKGLDVTNLRELGRLMGPLQRQAFRKMYGKILDLTTTEVFMEAVVSLAQYYDQPLRCFTFGDFQIVPIVEKFEEILGCPLGGRKLYLFSGFLSSLSKIAAVVGDSTKELDRMKQTRNGVVGLPRKYLEGKARGMANQEEWVPFVDILALLIFGVVLFPNVDGLVDLAAIDAFLAYHHSKESPVVAILADLFNTFDR

SEQ ID NO: 131760 - protein, 191 aa, Glycine max
  Coding DNA Sequence Number=SeqID_40075
MLSFSQMQSQFQSQRQSQGLALPPEPEVGPSVACVSIKESCVDPLGNDLDTGRVYEGSTTIHNIPLLHDQVKFGIEEVKDADAPIPIPTEEVKLVGHALNTFLAWPTNLVKRLSEQGAVGPTKSADRPDHEVDDPLYLMTLIIQQLFLKPLQVMWDATVFGVFNEDFPLYIKHEDLSEIAHSGQCLSISVI

SEQ ID NO: 131761 - protein, 65 aa, Glycine max
  Coding DNA Sequence Number=SeqID_40076
MGMNEVAEDAHAGVEPPRHAVEDCQAIAERLERLLNLRIVTKGIETYDILEDCLQIARGVIADHN

SEQ ID NO: 131762 - protein, 197 aa, Glycine max
  Coding DNA Sequence Number=SeqID_40077
MDIIPDKYPLSVQNIKFGSKLYVNADITEIHEFRQSLSAPFYFGGIINDKDGSQSQSSQIDEIIIDAPWSYDSCPNCTTTLDPSKGGSACHSCRTSVIDTVPRMEHNGDKGNFLLWNATCIKLFGKTAEECRDELIAVGDDIKVFPTCVDEILSKTWAVRFKFRSQLRQSFVLDVSKELHHIQSLIATLGLKVMGIL

SEQ ID NO: 131763 - protein, 144 aa, Glycine max
  Coding DNA Sequence Number=SeqID_40078
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=1e-24, Identity=55%"; Hit description =Putative uncharacterized protein
  Subcellular localization annotation: CTP_CleavageSite=38; ConfidenceScore=5.37e-01
MTMITPSSKLTLTKGNKSWASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 131764 - protein, 146 aa, Glycine max
  Coding DNA Sequence Number=SeqID_40079
MPRLASCVAWVRVQEAVGLLCPPGRGNPQSPDPWSPMTPPDSSLRLPRRERNIVLYVTEYDEFRRELERRCWHKSLTRQMDGHIDVALELSKTFFQHLTVGILKITTFDLLLGENGALSAIPTKEGIALSAPRCAKPNSNQRGNCA

SEQ ID NO: 131765 - protein, 75 aa, Glycine max
  Coding DNA Sequence Number=SeqID_40080
MEYDSLSRCLGGEMVDTRDSKSRAKERGGSSPPSRHNIRDLLFGMWNKLAARLSEILVDPLRVLFLKSPYLPGII

SEQ ID NO: 131766 - protein, 182 aa, Glycine max
  Coding DNA Sequence Number=SeqID_40081
  Homolog annotation: Hit_ID=Q2HTA0; Match level="QueryCoverage=52%, HitCoverage=14%, E-value=3e-13, Identity=43%"; Hit description=IMP dehydrogenase/GMP reductase, related
  Pfam annotation: Domain name=DUF1723; Domain location=101-150; Score =57.3; E_value=5.1e-14; Accession=PF08330.1; Description=Protein of unknown function (DUF1723)
MVRTRGLGHALGHVTGRAHDEPVVPAPDVEADVFPDDPMTPADVEDITADIPANTGAEAAEDEHEGFSGGPSDPTHPPVPAIEGLVAGTRLSPLIACSVDTDDRGLLSPLVERWHRETSSFHLPVGELTITLDDISSLLHLPVVGNLHAFQPLHVDDAVQMLVDLLMVSAESVRAEIAQCRG

SEQ ID NO: 131767 - protein, 189 aa, Glycine max
  Coding DNA Sequence Number=SeqID_40082
  Subcellular localization annotation: CTP_CleavageSite=42; ConfidenceScore=5.60e-01
MPKVKCFRNPQKSAPQPQCPSPSDSTQAPEVPTGNVPLSHVSTSEVPAMNPEISSPPSDSTQAPEVPTGNVPLSHVSTSEVPQEDETTRRHVGRESTHWWTVEAIDSEETIKKIKVKVRGVNSLPRELSIIVNFDDQGQAIGEAQALLAGFLGTLVADCKLFPMDYDRWSGPSGVPKAYFDDCFETILK

SEQ ID NO: 131768 - protein, 67 aa, Glycine max
  Coding DNA Sequence Number=SeqID_40083
MNLRGRQVEIADPLCPFYNNLDEDAAHLFFNCSKIEYLGHIVSGEGVAMDATKVQAVLEWPTPLNIK

SEQ ID NO: 131769 - protein, 126 aa, Glycine max
  Coding DNA Sequence Number=SeqID_40084
LPSLVTDAWGANTFPVRKYNSRTFHLEFVDHVFSEINVGGNSACIPFSEHAPASHTSPSHLREFLDDIADSLEDTHNEERNLKRKRDEENKDDHNDTAQENDNLPKEWKTSRNHPLDNIIGDISKG

SEQ ID NO: 131770 - protein, 98 aa, Glycine max
  Coding DNA Sequence Number=SeqID_40085
MVIDQSLLFELTQLSNDGVPFEGTLDDEWKFNFSIFDARRMVCTNQVDMTGRLLAGSLAFECRIMHYLIVRILLPRSSNLAQVSEEDLIIMWVFLTGR

SEQ ID NO: 131771 - protein, 67 aa, Glycine max
  Coding DNA Sequence Number=SeqID_40086
MDKFDIFVPHPLVITSLLPLECGCKPLVCLLERHALLSVDFQDHSIRNYSFARWWGCRKTTSKVQNK

SEQ ID NO: 131772 - protein, 56 aa, Glycine max
  Coding DNA Sequence Number=SeqID_40087
MNGRNQSRYLRTDASGDGVTANRSLPLLCAKRAENVAARQPRILCILQLSFTICLF

SEQ ID NO: 131773 - protein, 84 aa, Glycine max
  Coding DNA Sequence Number=SeqID_40088
MTKARQKGVRKVNEMKIKVRETSGDDQGRVERFCSSLLSLFIGKRGRSLPPSSPRRARLLPPEGLEELLGRPKWAWLLFAPPVY

SEQ ID NO: 131774 - protein, 72 aa, Glycine max
  Coding DNA Sequence Number=SeqID_40089
MQRLKCLNKKCSREWELRAYSIHLLKNPNGKIVDKCLVKLHTKFGEDPTVNKGWAAFLPRQLHVASSRSFIK

SEQ ID NO: 131775 - protein, 132 aa, Glycine max
  Coding DNA Sequence Number=SeqID_40090
MTIRGIGLNGPDDIYSPHGERPRGRQDIQRMQRGIDIVRECLTFVAFPYMDTTITFHGKPHARWRAFQTSPHGLPRSCDSPPWHPRTAGVSCRGFSYTAYQTLPPLLGNNVWVCHDTKIQCMADPRAALAGT

SEQ ID NO: 131776 - protein, 132 aa, Glycine max
  Coding DNA Sequence Number=SeqID_40091
  Homolog annotation: Hit_ID=A2Q1D6; Match level="QueryCoverage=69%, HitCoverage=16%, E-value=4e-10, Identity=38%"; Hit description =Ovarian tumour, otubain, related
MDEDQWRYDFAMSQEVHMDYDYDNQEECGVNEPHVDCSNAFNTSQVFATRDDVLQWARTVAHENGFVAVIMRSDTETGSRGRSSFVLIGCERSGTYKCRNKEFVRKDTGSRKCGCPLQASWETQCVEGKVGW

SEQ ID NO: 131777 - protein, 160 aa, Glycine max
  Coding DNA Sequence Number=SeqID_40092
FASKAFAFQHGKESPVVAILAMYDTFDRGCEKSGARIVCCTPALYVWLVSHLFLQEGRLVYPLQGRKNQDSIFMRKISKYSLNGNKGKDRELRGSSNGIIGGYHKWLRVRTQGLDWLPNLKIVRDDEVKASKESDEVQALKAELERARVVKEKFKSIAIK

SEQ ID NO: 131778 - protein, 150 aa, Glycine max
  Coding DNA Sequence Number=SeqID_40093
LGGVDGDLVLRGTRIRATWGYVSSVEGGQLGMVGSCLICGCGRVDFAPSPDRHLVPHMTVVPGDMSRGVRRLGDVRRAPDSQQIKGTKTTKQGGLCGGWPAVNLEAKMVSGNRLPRLQKGNWKTMEASGNRLPDCVIDYTEEWVTGNRLP

SEQ ID NO: 131779 - protein, 274 aa, Glycine max
  Coding DNA Sequence Number=SeqID_40094
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.12e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGIRSPQRSRKNIWRSWVAHHHTTNSRWTIPLKRLAPDPSDSENDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131780 - protein, 101 aa, Glycine max
  Coding DNA Sequence Number=SeqID_40095
  Subcellular localization annotation: CTP_CleavageSite=38; ConfidenceScore=5.08e-01
MPISPCGSISWSVPSRHRDRACKTPSGPGGAQQGPGVSGSGYGPLLVLQGACSPQQGIAPARHPVDPKKSNRVLELPALITGLCQFYRVLVTPSKVIRPPL

SEQ ID NO: 131781 - protein, 68 aa, Glycine max
  Coding DNA Sequence Number=SeqID_40096
MKEIGKEKLPKSWWKRSKLKCLAKISYKAPVESYMTKKRSHLSHARGGIAQAERHPPIGKSAERAVNV

SEQ ID NO: 131782 - protein, 196 aa, Glycine max
  Coding DNA Sequence Number=SeqID_40097
  Subcellular localization annotation: CTP_CleavageSite=18; ConfidenceScore=5.07e-01
MRRPSPSCYVYRGKDFARTAAGRRVQIMRTNMTTLTQIWMTLLSATSSPAIIILTSPCRSVWRLPGTLWTQISPTGPWDFPPLITGLCQSFGVPVAPSKAADALPPHQAGPAGSFDTEQYLRHLVRQQAANHRAHGFTSFPCPTLDQFRAEVAWPGDWPEARAGEAPAEAPDEADEAREDEEMADLLDFLGGSGAT

SEQ ID NO: 131783 - protein, 149 aa, Glycine max
  Coding DNA Sequence Number=SeqID_40098
MIMRGQDIYSSQEETTSSPSFSGSEDEVRGEKSSEEVYPHEEGDLLMKKKDSKALSSKAKGKEKEEKDSSKKIVKKDNHFATKCDIKRALLLKQSFYLLLSRETSLSTAIPLRLEFIPQVKELLDEGFVRKSLNPCALLVSKIVIKGFP

SEQ ID NO: 131784 - protein, 152 aa, Glycine max
  Coding DNA Sequence Number=SeqID_40099
  Gene Ontology: Mol. function=sodium channel activity; Cellular component=integral to membrane; Biological process=sodium ion transport
  Homolog annotation: Hit_ID=A9ZLE9; Match level="QueryCoverage=34%, HitCoverage=100%, E-value=4e-15, Identity=75%"; Hit description =Putative uncharacterized protein
MVVTGDGEIRVRFREREPEKRLPHPRKAAGAQNYPILTRGVKKLVVGPWVGSIGPPPVCTGRLVPSAGDALLSLTGRVVPPHGITPQDSDPIVLAFGIGVMINRDSRGHSYFIVRGEILGFMKDEQLRKHLPRMFSLIKNESWGLEDDQIPS

SEQ ID NO: 131785 - protein, 117 aa, Glycine max
  Coding DNA Sequence Number=SeqID_40100
MGPYPRSSQHWVPINLSKLPQHPSNTTSNHPELSKPRKQDRGRKLCPKTQTNIDEDMTKSKGKDPLEGLGGPMTRARARKAKEALQQVLSILFEYKPKFQGEKSKVVSCIMAQMEED

SEQ ID NO: 131786 - protein, 166 aa, Glycine max
  Coding DNA Sequence Number=SeqID_40101
  Homolog annotation: Hit_ID=A2Q3G4; Match level="QueryCoverage=44%, HitCoverage=16%, E-value=6e-09, Identity=45%"; Hit description =Ovarian tumour, otubain
MGRLTKDEKIVVVDMTKSMVKPRNILLTLKDHNTNSYTTVKQIYNGRHAYRSFIRSNTEMQQLMMLLDRDQCKVQNPGCSKECTGLCDGGLGSLVDCPCESSFDEYLKNFEMTCSPWPMFVDYVCQTWVILHKEKFVKARTNKVMHLGNTTTNRVESAHRSLKRLL

SEQ ID NO: 131787 - protein, 163 aa, Glycine max
  Coding DNA Sequence Number=SeqID_40102
  Gene Ontology: Mol. function=nucleic acid binding; Biological process= DNA integration
  Homolog annotation: Hit_ID=A5BW26; Match level="QueryCoverage=44%, HitCoverage=5%, E-value=2e-13, Identity=38%"; Hit description =Putative uncharacterized protein
MAYRGQLARCLTAVSIGPPSSRMHGEFVALVSLVREQAAHFYGDSKCLNNPYFMGPFPISFGFVYIPLDVDYVSKWVEAKPTRTDDAKVVVDFPNRKGWSTRLDDALWAHKTAYKAPIGLMEACLWSSMEAGSLSSMRSSMVILHHGDAAEDKGEEVRGGAIH

SEQ ID NO: 131788 - protein, 273 aa, Glycine max
  Coding DNA Sequence Number=SeqID_40103
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPISQPSINLNIAKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131789 - protein, 140 aa, Glycine max
  Coding DNA Sequence Number=SeqID_40104
ETKFGHSAPLYHPEVAGPMIRGDTLRLSAPFCHPEAAGPMTSRDQVWSFCTLVSSRGGGPDDTRRYLTVIRTLLSSRGGGPDDKQRPKAAGPMTSRDQIWSFCTLVSSRGGGPDDTRRYLTVIRTLLSSRGGGPDDKQRP

SEQ ID NO: 131790 - protein, 141 aa, Glycine max
  Coding DNA Sequence Number=SeqID_40105
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIRQGGRGEDEQRVGKSIEFGSWALDHGPGAWKILNVFL

SEQ ID NO: 131791 - protein, 243 aa, Glycine max
  Coding DNA Sequence Number=SeqID_40106
EVADLDIGGVHKFDEAPDGYNKMQTYMGMLLDPVRNLRNRLGVGGLTEKEKMLVYLITYILTPRSSNHAQATDDDLQIVYGLKSGIKMNWVLLIEDIMLKCHLLLDYEFPYVVLASRFIDYFKVDISYEIVNFTKAFSEITERHLKKLGMRFIDHEWIMVGEPEAGNIDEMEEDVEVKAPQKHVHQWSPFEFLMIPKMDAMLPLHQEHSAKFHSSADNIITRLENFETRLTLSNLLNPNKDET

SEQ ID NO: 131792 - protein, 16 aa, Glycine max
  Coding DNA Sequence Number=SeqID_40107
MAPKTCSLSASAPDRT

SEQ ID NO: 131793 - protein, 156 aa, Glycine max
  Coding DNA Sequence Number=SeqID_40108
NWRCGMNRKLGYGAQLRANLDPTKGVGRLRQQDGGHGSRNPLRSGAAVAAKPRARARAERVVGADLGGSSKYSNENFEGRRGERFHVNGTCTWGIGLKFLNRDVAADGNVRESGDVGGGPGKSYLFLFNSLPTLETAQPGGRVQRAGRAPHVAWCP

SEQ ID NO: 131794 - protein, 276 aa, Glycine max
  Coding DNA Sequence Number=SeqID_40109
  Homolog annotation: Hit_ID=Q2HW90; Match level="QueryCoverage=62%, HitCoverage=34%, E-value=6e-16, Identity=30%"; Hit description =Putative uncharacterized protein
MEPIASLAQYYDQPLRCFIFRDFQLSPMVEEFEEILGCPLGGKKPYLFSGFYPSLARISKDSPNLGAGIRHRKQVENRVVGIPRKCLEARARILAGKGEWALFIDILALLIFGGVLFPNVDGLVDLAVIDAFLAYHDHKESPVVAMLADLYDTFDRRREKSSTRIVCCTPALYLWGCINYNPVLAIRQLGYPMKGAPLEEELAPVISRGFNETNMETLQKVRKAWEVSYPNFVRGLLLDDMQPLIGRFEILGILCCTICEVPRHAGNQKDAGLRDP

SEQ ID NO: 131795 - protein, 35 aa, Glycine max
  Coding DNA Sequence Number=SeqID_40110
MRLHYHQASQRPSMTTDSPPLLMAHIDPGIRPNIS

SEQ ID NO: 131796 - protein, 132 aa, Glycine max
  Coding DNA Sequence Number=SeqID_40111
  Gene Ontology: Mol. function=helicase activity; Biological process =viral genome replication
  Homolog annotation: Hit_ID=Q2A9I1; Match level="QueryCoverage=94%, HitCoverage=8%, E-value=2e-22, Identity=43%"; Hit description =Putative uncharacterized protein
MNKLEQVWDQTWHWMADDIVYNYKKSSTSPALQLDDRTLQNLVLLEIEQLLQANQRSLTDYPSMPYPEDANCPTYLDNSLILAELNYNNEELISKFEHLFSQMTDEQTSIYNQIIEVVNKDEGGMFFLYGYE

SEQ ID NO: 131797 - protein, 306 aa, Glycine max
  Coding DNA Sequence Number=SeqID_40112
  Homolog annotation: Hit_ID=Q6UUU1; Match level="QueryCoverage=19%, HitCoverage=40%, E-value=4e-18, Identity=78%"; Hit description =Putative uncharacterized protein
  Subcellular localization annotation: CTP_CleavageSite=47; ConfidenceScore=5.47e-01
AFPVSTGTPGLFILRSDLPSQWLLFLSAVPSCSATDGVVRNGKSTVRTSALASVAAAQLLGRAIGAGLFAITPAGERGMCCKAIKLGNARVFPVTTLNSMPENIPLNVVYEDDDIIVINKEVGMVVHPGAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKAVRSKLDCMHEPPVQSDRCALSGNYRLESNPEKTCKSTTGSRPL

SEQ ID NO: 131798 - protein, 152 aa, Glycine max
  Coding DNA Sequence Number=SeqID_40113
  Homolog annotation: Hit_ID=Q6UUU1; Match level="QueryCoverage=66%, HitCoverage=69%, E-value=6e-24, Identity=63%"; Hit description =Putative uncharacterized protein
MRSENSGKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAKPFFHSSAPLTSITKSDAQIS

SEQ ID NO: 131799 - protein, 118 aa, Glycine max
  Coding DNA Sequence Number=SeqID_40114
GQDHLELPSGVRTKHEQQKPTKERMQVGMRSRPTDRCLFSALNKQRTSLQGSPVSSPGRAELAWASHPVATYPSAGGRRETRGMRVPRKESARSRHQRLFEENVGKTGKDAVYELFSE

SEQ ID NO: 131800 - protein, 71 aa, Glycine max
  Coding DNA Sequence Number=SeqID_40115
MSVKNLVGRLGVHDKTNHTISRSQYFARMLQPYGINIGLKEHSNRVTPKAYTPKSLSGPLPPDSGPTQKIF

SEQ ID NO: 131801 - protein, 171 aa, Glycine max
  Coding DNA Sequence Number=SeqID_40116
MTTLTWMTLLFSNILPSDHNANLPLQMDRAHKTPSGPGEVQQGPGEWHPQDTQWTRRSPIEPWGFQLWLRASVRCLFPPARSCHRDIGSHPQRHQVDPEKSNRALGFPVLVTGLCSPTGCPFPPASSTEFLSPPSRASGPILIELSSRSTASPGRRGAKHHSSLRMADSGQ

SEQ ID NO: 131802 - protein, 198 aa, Glycine max
  Coding DNA Sequence Number=SeqID_40117
MSCLVIITLISIYRSVNWCMPTTRHPLDPDKSNRALGFLALITGLCQSFGVLVTTSKVIRTPIAQAFIEKYCTPRQAQGDAPQAADAPLPPHQADPAGSLGMERYLQHLVRQQAANHRGQLQIHECLYQLSLSQQGQGFAPFACPTPENFRAEVAWPRDWPKAQAGEAPAGSPDDAEETHMDEEMMDLIGFLGGSGAT

SEQ ID NO: 131803 - protein, 15 aa, Glycine max
  Coding DNA Sequence Number=SeqID_40118
MAHQPVFEKMCIHLK

SEQ ID NO: 131804 - protein, 52 aa, Glycine max
  Coding DNA Sequence Number=SeqID_40119
MLQPCGIGTSLKEHSNRVTPKAYTPKSPSGPLPPDSDTAHELYNTQDLTLVF

SEQ ID NO: 131805 - protein, 84 aa, Glycine max
  Coding DNA Sequence Number=SeqID_40120
MVSSRTKKKNAPQGEAPPPVEVAQEEEEEESTHAASRGRTEGGRRRSSKVAEEEEKPRGKEEEMARWVHWFFLKITRGICDFSH

SEQ ID NO: 131806 - protein, 35 aa, Glycine max
  Coding DNA Sequence Number=SeqID_40121
MEKFNQKMNGSGMEKEEKEETPLQGEDESRRSSPP

SEQ ID NO: 131807 - protein, 416 aa, Glycine max
  Coding DNA Sequence Number=SeqID_40122
  Gene Ontology: Cellular component=chloroplast inner membrane
  Homolog annotation: Hit_ID=A7PNU9; Match level="QueryCoverage=92%, HitCoverage=86%, E-value=5e-99, Identity=52%"; Hit description =Chromosome chr8 scaffold_23, whole genome shotgun sequence
  Subcellular localization annotation: CTP_CleavageSite=22; ConfidenceScore=5.18e-01
MAGCSSNFAVAGCANVRKEIVLGNQKTNLIRLSFRGVLNEATFQVLRGSKCSRSCVPIQKKAMFFVMSMSQPSAEAELESAVSSIGLSEGGGDSVLRKDQETRDSESDSKIDRDDDNGVVLDGSGGNGSFGSGGAGDGSGGGGSNDDGNDNEEEEFGPILKYDEVMRETEARGATLPLDMIEAAKSVGIRKVLLLRYLDLQGSFWPLGFFMKSCSMLRNRMLADPAFLFKIGSEIVIDTCCATFAEIQKRGKDFWAEFELYLADLLVGLVVNVALVGMLAPYARLGKPSISSGFLGRMQKAYAALPSSVFEAERPGCRFSVQQRLGTYFYKGIMYGAVGFACGIIGQGIANMIMTAKRSIKKSEEDIPVPPLVKSAALWGMKAALIAVVPICGLFVAALIATSRVVFSPTSTIDIA

SEQ ID NO: 131808 - protein, 78 aa, Glycine max
  Coding DNA Sequence Number=SeqID_40123
MSTSHPSLVAMCAHGILVTLGVDECSFPLGRRTRASKLVGLQFSEFLLMESLNLRNTGLELLKSVIACHGCWGRIGSL

SEQ ID NO: 131809 - protein, 147 aa, Glycine max
  Coding DNA Sequence Number=SeqID_40124
  Subcellular localization annotation: CTP_CleavageSite=80; ConfidenceScore=5.29e-01
MGDLRILPAHPISHFWQHSGNIKGSKAKSVEPVLYLASLFSTPTLLPAALTSSSTSWVTPPTSSLSPPCKGGASPLSSSCPMMVKCKCEVPAIIFTSRSVNHLGEVGGNNVFVEGCELIHYVHENEELKLKLGSLMEEAKANAKEIA

SEQ ID NO: 131810 - protein, 94 aa, Glycine max
  Coding DNA Sequence Number=SeqID_40125
MTPQLNESSHLNVEPTIDIHVAQSQSNEMSHDYHAQNGLPDEVVGDFSDDEDKILVNSNNINDNNDNGIQFPFQPTSTENVYCPYPNSIDVGDN

SEQ ID NO: 131811 - protein, 239 aa, Glycine max
  Coding DNA Sequence Number=SeqID_40126
  Homolog annotation: Hit_ID=A7QAF8; Match level="QueryCoverage=44%, HitCoverage=22%, E-value=9e-30, Identity=60%"; Hit description =Chromosome undetermined scaffold_71, whole genome shotgun sequence
MWAEWQQHVIRLGDVVPPWGRATMSSCTFTIHPNVATAWAATGRVCTKWRLHLLDSARRNAELVEPQSYTRGHKSSSDHITSSPIAAGGLRSWVQLRKAKEDGCQGQQEGWQRQVLETPILIVAKNGVTEMVEKIIDSFLVAVHDMDAKKKNIVLLTVENRQTYLYNFLLNKKNLKKSNIFGKVDNKGNSALHLAAKLGDYKPWLIPGEALQMHWEIKWYLGIHTRVISEMEAMQLMVK

SEQ ID NO: 131812 - protein, 212 aa, Glycine max
  Coding DNA Sequence Number=SeqID_40127
MVVSIAEKPSVIEGRTLSLISGQASASELLPFISSDHPSFSDTIYDVPSPSTHGPTLPRAAARLVPAFVGEKNHGPTNAEKAIGYEHGLVVPEVPILGYVLGTDDDGVGVGVNLKHVFCELNGDDVGAAAHAAKVEAFDITAELVLVDDHGGEGRGAVEEAAVDDKDADVFGVDKGEARRREREQLSLGAKVVSLSYPRIRPFHWLTSSREV

SEQ ID NO: 131813 - protein, 172 aa, Glycine max
  Coding DNA Sequence Number=SeqID_40128
MEEKKHTRKLKNKGKGSTLEEKLRNLGEEKLCNFEIKRMLNVQKRSKATFKNHMQTLQTLVPTTLKPTLEHCNPKTLGKPCKPCLANGIGVTLQLNTSRQCSWRIQRGRFSPVPLAAPSSSTVFLPSSMVAPSHVSSFLATGDGGTTFSSVLLAASLQEQTLFANCLKKDPL

SEQ ID NO: 131814 - protein, 111 aa, Glycine max
  Coding DNA Sequence Number=SeqID_40129
MPLILGNTGSGSTSQVKKWNMNSTRWEGYIKQKGNRNEEKEGVLKQAQPNTRAKRAKKTGAKRGVELEDVESVTCAKPQLRAKHAIQQKHRLSLQGALSARSERAKREVSR

SEQ ID NO: 131815 - protein, 102 aa, Glycine max
  Coding DNA Sequence Number=SeqID_40130
  Gene Ontology: Mol. function=protein serine/threonine kinase activity; Cellular component=nucleus; Biological process=protein amino acid phosphorylation
  Homolog annotation: Hit_ID=Q8LG64; Match level="QueryCoverage=70%, HitCoverage=20%, E-value=4e-17, Identity=67%"; Hit description =Cyclin-dependent kinase B2-2
MEILTLWYRAPEVLLGATHYSTVNKWSVGYIFGKNMRIQGSSAELVTKQPLFLGDTELRQLLRIFSAMPTPKEMSAHQFFTTWQLQQYTHKVEYINLLANFE

SEQ ID NO: 131816 - protein, 50 aa, Glycine max
  Coding DNA Sequence Number=SeqID_40131
MACPSEVAVSLAQAHPETPMNYKKRSRKRRPPVVTSVVIKGVALLKREVA

SEQ ID NO: 131817 - protein, 73 aa, Glycine max
  Coding DNA Sequence Number=SeqID_40132
MAVRWVPLVTVAGHVLNRREVREGGAADGICGTGWCRQCCLRYRVVPPILLAGHLQLAVPPLELAGQASHALT

SEQ ID NO: 131818 - protein, 157 aa, Glycine max
  Coding DNA Sequence Number=SeqID_40133
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=A7P0M4; Match level="QueryCoverage=33%, HitCoverage=9%, E-value=3e-16, Identity=82%"; Hit description =Chromosome chr19 scaffold_4, whole genome shotgun sequence
  Pfam annotation: Domain name=His_biosynth; Domain location=24-140; Score=-118.7; E_value=0.035; Accession=PF00977.12; Description =Histidine biosynthesis protein
MMHVLETWWEAWVHGYFASGIGGILWASLAGGNGEIRVSPTGMAEHLQTDPLKKMFEIISPLEYIGRERDKEKFTKLDKTKFGQGKGFNVDLIKLISDAVSIPVIASSGAGAPQHFSEVFYKTNETVALAAGIFFTGKRYCFRFGNFLMLMGMILIC

SEQ ID NO: 131819 - protein, 77 aa, Glycine max
  Coding DNA Sequence Number=SeqID_40134
  Subcellular localization annotation: CTP_CleavageSite=45; ConfidenceScore=5.35e-01
MAPPPLAPSTGTSHVAVEAPFPLARPLLLSQTPSPRLQRCRLACRVAQGGAIGGCDLQEGGAIGSCDLPENANVDGV

SEQ ID NO: 131820 - protein, 250 aa, Glycine max
  Coding DNA Sequence Number=SeqID_40135
MLRKKDFALRNLYQTHAKARIMSDIEQVYVQMKVDMEDMKEHMTTMMAAMISIRKMMEVNAATVVATSTATERDSVHPSRFNQENCPVSDVVESFFPPYGLPPNYTPPTIVYAIGENIGNSAPVFIENQQPQPDHTHAHVSQPMGETHEAPQDHTLTGFKAYLGYTTKRHAFSGVPVPDAPEDPQYRPPPQPVEAKLHCESKMMTKVMNKKLKDQSKNNSSESKNISNESRTSQEFKIRIKKNSRLNKKV

SEQ ID NO: 131821 - protein, 239 aa, Glycine max
  Coding DNA Sequence Number=SeqID_40136
MQSQGLILTPELEVGPSVARVNTKESCVDPSGNDLDTGDSEKCGLYVEENPPCLVALGILYEGSTTVHNIPLCHDQDKLVLRKLEMQMLPFLYPLKRFRVVEPTKPAHRPDHHVDDPLYLMTLTIPQLFLKPLQVMWDATVFGVFNDNFSLYVKHENLFDIAHGGQCLRMSIIHLWIFAHWKMVVILPKENVVIWFCSLHNSPDNYLKEIINRQKGSIEYGYYVMHLMLTTILGSFKNN

SEQ ID NO: 131822 - protein, 159 aa, Glycine max
  Coding DNA Sequence Number=SeqID_40137
  Subcellular localization annotation: CTP_CleavageSite=14; ConfidenceScore=5.30e-01
MPTPLPFSTAPPCPASMQPSLPPLSGLLPRPSLHLPAFSHVHAAIPISDNLFSAILHCDPNTAPHAKQGEHRDIALFELGPGFFGTIMVSQKSIPVVFAPHHLEDKVLLDGLENDTNGNKGAAGSKGFARSKKREAQKEGNNKDLIMWSMVSYDPCSMQ

SEQ ID NO: 131823 - protein, 402 aa, Glycine max
  Coding DNA Sequence Number=SeqID_40138
  Homolog annotation: Hit_ID=A7PNW8; Match level="QueryCoverage=100%, HitCoverage=100%, E-value=1e-63, Identity=41%"; Hit description =Chromosome chr8 scaffold_23, whole genome shotgun sequence
MAENLDDGEFWLPPQFLADDDVLPTPFEAKFPSLPDDTVLFPSEWPYGSPVDSTVGGSSETESDEEEQLVAELTRRLTRSSLQSDTKSAGRFVSSSPQSTLCAFGSGCGCGKGSSQGSPDGVCKLSSAKTTWDLLHAAAGEVERMRLKQEGYAFNHQNGNLIPQRKPSPVIPLPSKTTTSTPNPDMGGFYTQQHSLSHQRLQIAQFQMLRQQQLAKQQNSVWNLQKQCGGVYSQRQQQNNQMDHNRGRNNDVNNSVGGRNVRPLGLSASAWPPLQHAKQQNQNYGSGMRAVFLGNPSGRRECAGTGVFLPRRVDTPEPRKKQACSTVLVPTRVAQALNLNLDDMMAGQPQHLQRFNASSNMENGAAVSRQRSNYVLSQQQKRNLKSQPAVYHEIRLPQEWTY

SEQ ID NO: 131824 - protein, 109 aa, Glycine max
  Coding DNA Sequence Number=SeqID_40139
RFNTFQLNFNVFKSTSTFSCENKTEGKGFYREEGRARGPTTSGRAWQATTSGRAWGPTTTGRAWGPTTTGSAWQATTSGRACQATTSTPVSSSCPVTPRVTFWWNAPLR

SEQ ID NO: 131825 - protein, 265 aa, Glycine max
  Coding DNA Sequence Number=SeqID_40140
  Gene Ontology: Mol. function=isomerase activity; Cellular component =endoplasmic reticulum; Biological process=cell redox homeostasis
  Homolog annotation: Hit_ID=P38661; Match level="QueryCoverage=41%, HitCoverage=30%, E-value=7e-46, Identity=82%"; Hit description =Probable protein disulfide-isomerase A6 precursor
  Pfam annotation: Domain name=ERp29; Domain location=186-258; Score =58.2; E_value=2.9e-14; Accession=PF07749.3; Description=Endoplasmic reticulum protein ERp29, C-termi
  Pfam annotation: Domain name=Thioredoxin; Domain location=104-170; Score=-23.3; E_value=0.016; Accession=PF00085.11; Description =Thioredoxin
  Pfam module annotation: Pfam domain module=ERp29::Thioredoxin; Domain location=186-258::104-170
MVNTCSMSCAEADWESSHSLLCTGESSDSTRREAPLKFIKHANAISSTMLKYHNLKAVSLEKQMKHHTSYVSNHCNLSILLEAWKPILMGHKRRWWDCIALPNDVDSSDEASFRLQIKMLAFEVRFFRMHRRYDVSGFPTLKFFPKGNKAGEEYGGGTDLDDFVAFINEKSRTSQDVKGQFTSQAGIVESLDVLVKEFVAASDEEKKSVFTRMEEEVEKLKGSASRHGKIYLKVAKNYLEKKTNETYAEFLCLLQKFIHNRIYVK

SEQ ID NO: 131826 - protein, 203 aa, Glycine max
  Coding DNA Sequence Number=SeqID_40141
MGKHRKLNIIQNDGQSQAKEQSIESSTEVNQNNNSILEENAQFEGEQHIQEDSHVQSHTSLESASESSTKGKKRTRGYTHMLDVWNLPDGEFILVEVDHWGNPMGWEGKTLLNAIGSLVMRHQCAPINFLSWKDMPKDYITDMEFRSSIKLYKCCFILLLKINNINQRSRSKYEDLHCMGTNNLPRRIHEMTTKAKGVQPSRA

SEQ ID NO: 131827 - protein, 174 aa, Glycine max
  Coding DNA Sequence Number=SeqID_40142
  Gene Ontology: Mol. function=nucleic acid binding; Biological process= DNA integration
  Homolog annotation: Hit_ID=A5AV98; Match level="QueryCoverage=95%, HitCoverage=26%, E-value=1e-32, Identity=39%"; Hit description =Putative uncharacterized protein
MPIFYGLNFSDWNEQVQFHLGVLDFDLAILEEKHATITDASSNEEKITLPKTDSAKEFMGLVGERFQTIDKSLAGTLMSTLITMKFDGLFTMHKHVIEMTNITARLKTLGMTMNENFLVSFDMLVKEETRLKNQGSYLVHYVSHQGNQGAGKKFVRKHEKGKRPLKINDDSLQI

SEQ ID NO: 131828 - protein, 64 aa, Glycine max
  Coding DNA Sequence Number=SeqID_40143
MGRPVRVTLFCKNAPTIWDRHRLKGALKPGVFTPKAYTPKSPSEPLPPDSGPTPKIIFACRHYS

SEQ ID NO: 131829 - protein, 126 aa, Glycine max
  Coding DNA Sequence Number=SeqID_40144
MFGVYNDNFPLYIKHEDLSKIAHGGQCLSISVIKLWIMHMIKASMQAGNANVYGFLEPQSIQRSGQSNINILIVQYACLFLLNNALKGFDDSLQSKFEPVARWIVVKYFNDPRPLEPKRIKALRIQ

SEQ ID NO: 131830 - protein, 88 aa, Glycine max
  Coding DNA Sequence Number=SeqID_40145
  Subcellular localization annotation: CTP_CleavageSite=59; ConfidenceScore=5.09e-01
MSFVLQVSSLVLLTKITLKVDMQSPGAHFGHVHLDVSQLQVLASCGGSGSGGGMVVMVVAMTTTITNHLASVPNVQVVKTRKSECRFP

SEQ ID NO: 131831 - protein, 115 aa, Glycine max
  Coding DNA Sequence Number=SeqID_40146
MDVINIEQDPGLRSMMWEFPFDQRDEIRRVYLKVGPYQPKDTSFVVQVEGTSTWVVVTENKRGYISCGSVLVEGTSTRLFKENKGGYIPCGSLLVKNFTRLKRNLKDRRSLGDWM

SEQ ID NO: 131832 - protein, 350 aa, Glycine max
  Coding DNA Sequence Number=SeqID_40147
  Gene Ontology: Mol. function=nucleotide binding; Cellular component =cytoplasm; Biological process=response to stress
  Homolog annotation: Hit_ID=P27322; Match level="QueryCoverage=29%, HitCoverage=17%, E-value=2e-29, Identity=60%"; Hit description=Heat shock cognate 70 kDa protein 2
MAASHGCLYPYSGHAITHHSQPPLQEPSLPSQHPPSLYVHPAQSLGIDFKSTQIRLLALCDTRIRPPFPSSVHLPPPQPAPPCPHMPPPPFTSHSHVPPQLYPQEWGNLNFPMLPMIPYSHVPPLLPMPLVIPCPAPRQQCPTPIPTPLPMAGKGDSLTIGIDSGTTYFPVSVQQHHHVKIITTDQRNKTTPSHVAFTERLIGDATKDQVTMNPVNTIFDVDASIRSDMQLWPSKAIPGHPEKPTIVVNYKGKSSVLESLAGINLPRGQGICTKVPLDIRLWNHLLPTPELVQNKTKFTELLKYHPTESGDVMTSLKVYVTSIHEVPNDIYYITGESMNLVANFPISILC

SEQ ID NO: 131833 - protein, 126 aa, Glycine max
  Coding DNA Sequence Number=SeqID_40148
MHQASDVKRALTGSDALSVPYEFQFLKIKGRGTLGVTFAPKPLHLPNLEHLRIFFFLCTVSLHLHCFISRTIQLKGVKTPVVLSRNRDERAKRACALSLFIAIVKILDFQMNALSGPCRAKRVHPC

SEQ ID NO: 131834 - protein, 206 aa, Glycine max
  Coding DNA Sequence Number=SeqID_40149
MKTTYRPEYKRIGCLSSGRVVNIRFSLQRKMSRKLILGNKEKRFGRDSLGGASSATVVSSLLLLIVQGATTDDDMHNPLVLGLGRGRGTSHDGLENAMALLGFFHAFECQETPQCVDKSVRYRRRQAEGGDTIWRTRSLQSQLKENIKDHLKRCNLLSTSDRKWESVSMDFITTLPRTPVSSSIMSDRDLRFILRFWKSLLQGALS

SEQ ID NO: 131835 - protein, 95 aa, Glycine max
  Coding DNA Sequence Number=SeqID_40150
MVILSVGFCVWISESDASSIGACRPRIFFINGFLCFLEDEWQRNGERERERRRHFKEKMSLEEAHHHRRPWIRAWRKKEKNEGRGREEHEILCSK

SEQ ID NO: 131836 - protein, 371 aa, Glycine max
  Coding DNA Sequence Number=SeqID_40151
  Gene Ontology: Mol. function=protein binding; Cellular component =parasitophorous vacuole
  Homolog annotation: Hit_ID=A7QPI8; Match level="QueryCoverage=46%, HitCoverage=25%, E-value=1e-36, Identity=49%"; Hit description =Chromosome chr18 scaffold_137, whole genome shotgun sequence
  Pfam annotation: Domain name=S-antigen; Domain location=1-256; Score=- 250.7; E_value=0.031; Accession=PF05756.2; Description=S-antigen protein
MNLESEAKPSNDVVEREAEPSNDAVESEAEPSQGAVDSEAEPSNGAVESEAKPSQGAVESEVEPSQDVVESEGELSNGAVNREAEITSGAVESEAKTSSGAVKTEVKPSHGVVESEANLQMTKNDVVNSEAETSSGALQSEKESCVVSEMKNNKVESEAQPSVDVNHKKTNAVDSETELLVKGGLSIESEGSNQGDEDSRPASDALDGHNVGTKAICKDFDQKFRAAIATHRAARDLLKSKCQEIDSVQSIINILNNVIFVGDIDGKIRSMEHMIEHETLPLNKEKQLIREIKQLKQNCEELSSNMKKQDQSQQSVDNKDDNIEEHFKLLKKEMEVLRNNVLKSDTKTKATKKKYNDECDTLNKFPFYYTH

SEQ ID NO: 131837 - protein, 166 aa, Glycine max
  Coding DNA Sequence Number=SeqID_40152
  Gene Ontology: Mol. function=translation initiation factor activity; Biological process=translational initiation
  Homolog annotation: Hit_ID=Q9AXQ5; Match level="QueryCoverage=25%, HitCoverage=26%, E-value=6e-12, Identity=80%"; Hit description =Eukaryotic translation initiation factor 5A-2
MSDEEHHFESKADASDSKTYPQQASTIHKNDYIVIKGRPYKLWKFRLPKLESTITLSAILLELIFSLPRNLRILCPLLTTVISKTRKTQQVNTAEQEPKDLRGSAMCLRPRESAAPHHHIDHEITSSIQPLSKPSFTTLHDQEYIYTLKGSLRNKGYTLVPKPIQL

SEQ ID NO: 131838 - protein, 216 aa, Glycine max
  Coding DNA Sequence Number=SeqID_40153
  Subcellular localization annotation: CTP_CleavageSite=41; ConfidenceScore=5.43e-01
MAEASKKQKGSSSTTTAAGHCCQGTSGDPSAPVLPSLSSPRSSILFSSDDQRQRYYSQFCNKVILDPKYLHLEFFDEETFDCYQVFQNYGLIDFMSLKLSYFPELVKVFYNNLKIQDGILYSEVHNIPIVIDQSLFFSLTKLPSQVRLPPLVTERMLMVSGFASKTCLRLFLTSVPHLLNHKGVIPLLFWLKSSQNYADFELLWVNDLKQWILILM

SEQ ID NO: 131839 - protein, 43 aa, Glycine max
  Coding DNA Sequence Number=SeqID_40154
MERGRKERPKEVKSYFSHFPRKSKYTGEKLLWRKIQVFLWRKQ

SEQ ID NO: 131840 - protein, 89 aa, Glycine max
  Coding DNA Sequence Number=SeqID_40155
MAHHLVSDFYAKNGSEFESGSNFLGAVPLDVDFLESECTNHVARSTYTSDLLYEPPPTPELKPLPATLKYVYMEDKDKFPVIISDLPCC

SEQ ID NO: 131841 - protein, 175 aa, Glycine max
  Coding DNA Sequence Number=SeqID_40156
MWVRKEENFSHPAWTNEKTGANEEGEDEGDTHAVTAILIWPSFPPTQQCHYSANNNPSPYPPPNYPQRSSLNQPQSLSTTQPMLNTTFSTNRYTNQKGILQQKACRIHPKFRCHMLNLLSYLLDNSMVAITPTRFPQPPFFRGYDLYATCVYHGGYLGHSIEHCMTLKHKVQSLN

SEQ ID NO: 131842 - protein, 99 aa, Glycine max
  Coding DNA Sequence Number=SeqID_40157
MENAPWPQQQGPSLYDRTTKLEETLAQFIQVAGCVICGGAHDSGYCIPTEDTTHEVNYMGNQPRPNFNAGGYSGFSHGQQYNKQQGQWRTHPGNQFNKD

SEQ ID NO: 131843 - protein, 61 aa, Glycine max
  Coding DNA Sequence Number=SeqID_40158
MSEVERKHCCTIRKVLQHSRATRPTWAFQGLPTEGGAFWWKKPSSPGRAGRQPPPSFFRIK

SEQ ID NO: 131844 - protein, 195 aa, Glycine max
  Coding DNA Sequence Number=SeqID_40159
  Gene Ontology: Mol. function=oxidoreductase activity, acting on CH-OH group of donors; Cellular component=peripheral to membrane of membrane fraction; Biological process=lactate metabolic process
  Homolog annotation: Hit_ID=Q7VS08; Match level="QueryCoverage=100%, HitCoverage=33%, E-value=5e-69, Identity=68%"; Hit description=D -lactate dehydrogenase
  Pfam annotation: Domain name=Lact-deh-memb; Domain location=106-195; Score=-95.7; E_value=1.3e-10; Accession=PF09330.2; Description=D -lactate dehydrogenase, membrane bind
MAVFAQLGQDGKLSLVNHLGISLGETPEEILRRLDDGTYRPDDIRDGGRGSDQDYARHVRDVDADSPARFNADPKRLYEASGSAGKLILFAGAPGHGFRRETQTDVFYIGTERIPRELTDIRRYLLTALPALPIAGEYMHRDAFDIADVYGKDTFLAIRRLGTARLPTFFALKARVDNFCARFSFLPRNMSDRLL

SEQ ID NO: 131845 - protein, 62 aa, Glycine max
  Coding DNA Sequence Number=SeqID_40160
  Gene Ontology: Mol. function=cysteine desulfurase activity; Cellular component=mitochondrion; Biological process=cysteine metabolic process
  Homolog annotation: Hit_ID=A7QZH5; Match level="QueryCoverage=62%, HitCoverage=52%, E-value=7e-11, Identity=84%"; Hit description =Chromosome chr7 scaffold_275, whole genome shotgun sequence
MSLSSSSNAYNVPWVEKYRPIKMICSMVELTVQQVEKLREMSPLYEFVKEGINIKDIQWAQH

SEQ ID NO: 131846 - protein, 155 aa, Glycine max
  Coding DNA Sequence Number=SeqID_40161
  Homolog annotation: Hit_ID=Q6WAY4; Match level="QueryCoverage=87%, HitCoverage=24%, E-value=2e-13, Identity=36%"; Hit description =Putative uncharacterized protein
MGTNQNGKRFYQVKVKSLDVTSLKELGRLMGPLQRQTFCKVYGKILDLTAAEVFTEAVVSLAQYYDQPLRCFTFGDFQMVPTIEEFEEILGCPFGGRKPYLFSGFLPSLSKIAAMVGDSAKEMDRMKQTWNGVVGLPRKYLEGKARDMASQEKWG

SEQ ID NO: 131847 - protein, 192 aa, Glycine max
  Coding DNA Sequence Number=SeqID_40162
MTSRDQVWSFCTLVSSRGGGPDDTRRYLTVIRTLFVTSYPELRRAGARGITLRLSAPRHSVTPGDDEQRPMWSSAPFPEMLAFSDGDFSSLTSYPELRHETCTLVSSRGGGPDDTRRYLTVIRTLLSSRGGGPDDKQRPKAAGPMTSRDQVWSFCTLVSSRGGGPDDTRRYLTVIRTLLSSRGGGPDDKQRP

SEQ ID NO: 131848 - protein, 67 aa, Glycine max
  Coding DNA Sequence Number=SeqID_40163
MAPRKLSSKRSRKDKVAEGTSSAPEYDSHRFRSAKHQQRFEAIKGWSFLRERRVQLRATSILTSRKR

SEQ ID NO: 131849 - protein, 306 aa, Glycine max
  Coding DNA Sequence Number=SeqID_40164
GCINYNPALAIRQLGYPMRGAPMEESMSPFLVRDFGAQNFKAIQAIHKAWETPLKKDQELRGIRNGIIGGYHEWLKVHIRGLDWLTKLKVVSEGSFEAPEEDEEVQALKSELGKAKLAKEKFKLAATRIRKECAGLREENTTTARALEQETKRARKEEYGRNKFRGALWGSNSELKLRREERDQSRAHSMVLKEELVACSRSKRSLSQRLCETETNMLAIIAKYQEELGLATAHERWVADEYAQVYVEKEARGRVIDSLHQEATMWMDRFALTLNGSQELPRLLVKAKAMAGTYSAPEEIHGLLGY

SEQ ID NO: 131850 - protein, 259 aa, Glycine max
  Coding DNA Sequence Number=SeqID_40165
  Gene Ontology: Mol. function=chitin binding; Cellular component =extracellular region; Biological process=chitin metabolic process
  Homolog annotation: Hit_ID=UPI00006A17C9; Match level="QueryCoverage =74%, HitCoverage=100%, E-value=3e-29, Identity=34%"; Hit description= UPI00006A17C9 related cluster
MLVRMIHTRLFAAAQVKSCPGMHSSYVIASLSGCARTVGPPPISGEDLKFSQVWKWSTLKMRHSPLKVRACNPLKARMYSPLEVRACSPLKVRACSPLLARTCSPLKVKACSPLLARTCSPLKVRACSPTKVRTCSPLMARACSPLKVRTCGPLKVRACSPTKVRACSPLMVRTCSPLKARTCSPLEVRACSPLMVRTCSPLKARTFSPLKVRTCSPLKARMCSPLKVRACSPTKARAGSPLKVRTCSPLEVRACSPLM

SEQ ID NO: 131851 - protein, 365 aa, Glycine max
  Coding DNA Sequence Number=SeqID_40166
VVAEHQEGGVERNEATVQGQAIGNGGHAELAHAVVHVVGVSVVAGNGLAALPQGQVGVRQVGRAADDFRQQRGIGFDGQLRGLARGDRRAFSRHLGDVGIGLGNEVGRQFAVRTTGQFGGLARVLAGVLVEQLFPLGLAQGAGAIGAPAVVDRLRDLERTILPAQLLAGGFQFVLAQRCAVAGFLARLVRRTKTNGGAAADQGRLVALRQRGLDAGLDAFRVVAIDVTDHVPAIGFETLRGVVGEPALDVAVDGDVVVVPEADQLVQAPGTGQRRRFMRHAFHQAAIAHEHPGAVVDHFQLRAVEALCQQLLGQGEAHSVGETLAQRAGGGFHARGLMAFRVAGGVAAQLAEQLQLLDRQVVTAQ

SEQ ID NO: 131852 - protein, 210 aa, Glycine max
  Coding DNA Sequence Number=SeqID_40167
LKLGKARLAKEKFKSAATHIQKECTELQEENAATARALEQETKRARKEEHGREKFRGALWGSNNELKLRREERDQSRVHGMILKEELVACARSKRSLAQHLEATEQSMLAIIGQYKEELNQSMAHEQKLVEDFAQVYAEKEARGRVIDATEATMWIDRFALTLNGSQDLPRLLAKAKAMAEVCTAPEEIHGLINYCQHMIDLMAHIIRNR

SEQ ID NO: 131853 - protein, 92 aa, Glycine max
  Coding DNA Sequence Number=SeqID_40168
  Subcellular localization annotation: CTP_CleavageSite=40; ConfidenceScore=5.36e-01
MGSLARDSSSPSQGLGLSFIGRTKVSPLRRKRVVETQEVAATSEPSEPVVDKASIQQAADPSTPEDQTTPILSPNTSPPTTPVLHLTHEEDV

SEQ ID NO: 131854 - protein, 183 aa, Glycine max
  Coding DNA Sequence Number=SeqID_40169
DSPQISASPHQLDLAPYALGSYNAQWNAPGPLHDKHMLHSSRILRNIEVEEPWLGLFHYKIYFLVGIAFVDDWVVSKEKGRYWLSDDIVGLVGSLAIPASILLLTKTKSAKLEVPLYLAKSGTLNLGGVMILGTRNNSSRGVVVGDTKGLPKCFAGVYHQLLALQWHIRSKAGSRLDYGGAFH

SEQ ID NO: 131855 - protein, 247 aa, Glycine max
  Coding DNA Sequence Number=SeqID_40170
  Homolog annotation: Hit_ID=Q5CDC4; Match level="QueryCoverage=17%, HitCoverage=32%, E-value=2e-15, Identity=100%"; Hit description =LacOPZ-alpha peptide from pUC9
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDPAGRRSCATRRPRPIRLRDRHARLVSRACSRRSRRQDILTTSVPSRALDGNGLVGVRQRSRADQAYRYRRPRGGARYQLLFPLVRVNFELGVIMVIAVSCVKLLSAHNSTQHTSRKHKV

SEQ ID NO: 131856 - protein, 90 aa, Glycine max
  Coding DNA Sequence Number=SeqID_40171
MAPPLTSSLCLPLHLHGGKSPLKDLIEAQRSSLHRSPTSKLPSEPSYAWNVPLPKGTLKIIPILYWRIPMNPSFPNKGSPPIEGIPLKAK

SEQ ID NO: 131857 - protein, 22 aa, Glycine max
  Coding DNA Sequence Number=SeqID_40172
MNAQRQILRPFSYGDSSAGRGD

SEQ ID NO: 131858 - protein, 322 aa, Glycine max
  Coding DNA Sequence Number=SeqID_40173
MAKFDPEIVLEFYANAWPTEEGVRDMRSWVRGQWIPFDADAIGQLLGYPLVLEEGQECEYVQRRNRSDGFDEEAIAQLLCIPGQDFARTAAGRRLRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAHRSQARPHPLIRLARLGHLTWSSIYGIWFASRRPTTEHIARASLLFSCPTPDQFRAEVAWPGDWPEAQAGEAPPEAPGDGEEAHEDEEMADLLDFLGGSGDT

SEQ ID NO: 131859 - protein, 53 aa, Glycine max
  Coding DNA Sequence Number=SeqID_40174
MQLARQVPDWKAGSERNAINETAMTMITPSSKLTLTKGNKSWYRAPPRGRRYR

SEQ ID NO: 131860 - protein, 272 aa, Glycine max
  Coding DNA Sequence Number=SeqID_40175
WIPFDADAIGQLLGYPLVLEEGQECEYGQRRNRSNGFDEEAIAHLLCILGQDFARTAAGRQVRIMRTNMTTLTQIWMTLLLSNIQPSDHNSDLPLPKCQLVYAILTRMSIHVAQLIADVVYLFAGMAPTRHPLDPDKSNRALGFPTLIIGLCQSFGVPVAPCKAGPAESFDTEQYLQHLVRQQASNHRAHVQTHDCLYHMSLSLQSQGFTSFPCPTPDQFRAEVAWPGDWPEARAGEAPAKAPAEAPNEADEAREDEEMTDLLDFLGGSGAT

SEQ ID NO: 131861 - protein, 123 aa, Glycine max
  Coding DNA Sequence Number=SeqID_40176
MVKVGTSYVPDQRLIFAKSWAQGFPGINRDTRIYLFCEHRRTSALASVAVTLRVTTTPAALNAPLQGASHSPFRLRNCWEGRSVRASSLLRQLAKGGCAARRLSWVTPGFSQSRRCKTTASEL

SEQ ID NO: 131862 - protein, 72 aa, Glycine max
  Coding DNA Sequence Number=SeqID_40177
MRDLRMKLRLNFMEWRRKRERKRDFKEKMSLEEAHHHKRPWVRAWRKKQMNEGRGRGREEHEILCSKRVLKS

SEQ ID NO: 131863 - protein, 177 aa, Glycine max
  Coding DNA Sequence Number=SeqID_40178
MALCSIFLNLHLLLFVCLTIEALGVAKPSVASYLSQEILAEQEVDRVHGLPAQPPVKFKNMVVISLSMKLKEEHCSIGFSRPLTNQNKNPFSYGSMELFHKLPSFFLPLPPKLLSSFASASAAPFPFLSFPFKRMFLHVGLNQQVVIAKHKGYVSGSLSDEGKVGLGGDSEPTRGYW

SEQ ID NO: 131864 - protein, 96 aa, Glycine max
  Coding DNA Sequence Number=SeqID_40179
  Subcellular localization annotation: CTP_CleavageSite=30; ConfidenceScore=5.08e-01
MASTSGDAPPPSSNTARLMAKMFKLGDQIRRMSYENEERMERMRRSEEERTDNLILLMEKMKGVKRMKEEGGIRGKGREEIIEDMEVGKERKGLRQ

SEQ ID NO: 131865 - protein, 257 aa, Glycine max
  Coding DNA Sequence Number=SeqID_40180
DDMESMKDQMAAMMEAMLSMKKIMESNAAAVSTTSATAEMDPTHPSSINQMNHPVPNMVGQGGEALRSIGGPHVVQSKNSFPLYGLPPNYAPPNVVHVSDENTDHFALVLFESQQPQLGHAHFAQPMRGHVRNPEIMLWSNSNLTLDIPLRGLHLVACPSLTPLGRLPPAMEERKKFDLIEEKLRAIEGIGDYPFANMAELCLVLDIGCANSNQTHLGLPGGSNRRRCLPVEATQLAWASWAATTSLFSPINRGKRA

SEQ ID NO: 131866 - protein, 55 aa, Glycine max
  Coding DNA Sequence Number=SeqID_40181
MARTKKIGEMTTAAAKEITEKIDSFKEQATQESFVPRGRQDVLTVAIERPEHPRH

SEQ ID NO: 131867 - protein, 67 aa, Glycine max
  Coding DNA Sequence Number=SeqID_40182
  Homolog annotation: Hit_ID=Q7PDL8; Match level="QueryCoverage=88%, HitCoverage=8%, E-value=6e-07, Identity=35%"; Hit description =ERYTHROCYTE MEMBRANE PROTEIN PFEMP3
  Subcellular localization annotation: CTP_CleavageSite=46; ConfidenceScore=5.27e-01
MRTCSPVKARVCSPLKVRKCSPLKARTCSPLKARACRPLKVRVCIPLKARACYPLKATILVPNSPPL

SEQ ID NO: 131868 - protein, 82 aa, Glycine max
  Coding DNA Sequence Number=SeqID_40183
  Subcellular localization annotation: CTP_CleavageSite=56; ConfidenceScore=5.40e-01
MSPPPLGTHNRSQTHLKLSGQLPLPALVSTNLHTTNSLKLSGTWTFLSLELSYYAEASRKGQTPLRSLILALNRWLCSCSCA

SEQ ID NO: 131869 - protein, 122 aa, Glycine max
  Coding DNA Sequence Number=SeqID_40184
GYTPSPWVLVTLTSERTTCPRHQRAARPHLQRTTRPRLERGLHVLTLGTSYPHRSEDTRPRLKDYMSSPWDTLPSEGLHALAFRGLRVLTFRWAPYPHLKIIWSSSLRYVLNRDLHSRLRDQ

SEQ ID NO: 131870 - protein, 84 aa, Glycine max
  Coding DNA Sequence Number=SeqID_40185
  Gene Ontology: Mol. function=electron carrier activity; Cellular component=integral to thylakoid membrane; Biological process =electron transport
  Homolog annotation: Hit_ID=P49161; Match level="QueryCoverage=89%, HitCoverage=23%, E-value=1e-34, Identity=100%"; Hit description =Apocytochrome f precursor
  Pfam annotation: Domain name=Apocytochr_F_C; Domain location=1-84; Score=153.1; E_value=7.8e-43; Accession=PF01333.10; Description =Apocytochrome F, C-terminal
MCIMLQQRDPELLVSEGESIKLDQPLTSNPNVGGFGQGDAEIVLQDPLRVQGLLFFFASIILAQIFLVLKKKQFEKVQLSEMNF

SEQ ID NO: 131871 - protein, 168 aa, Glycine max
  Coding DNA Sequence Number=SeqID_40186
PVHPGLFVGDAGGFQSPTREPLNVGGLVPPHCSLKSVVSDDACPGACFVQRDATTLMAYHGVTVTENRVRFRRGSLRTATTSKEGSRRANYPILTRGVKKLVVGPWVGSIGPASGVHRSARPFCRRCAPVLNWPGRASGADSDPIVLAFGIGVMINRDSRGHSYFIVR

SEQ ID NO: 131872 - protein, 98 aa, Glycine max
  Coding DNA Sequence Number=SeqID_40187
AQPGIICMGWILNSGCSWFEGALVDDGDDGTEGEPGDEVSFGEVAMEKQSFWSVVNVLLMLSETFEHVQIEVAAIIPLADKCPACPSVFQTDLHPMPL

SEQ ID NO: 131873 - protein, 24 aa, Glycine max
  Coding DNA Sequence Number=SeqID_40188
HSVLHFSRVPCLATVSVLCFAVND

SEQ ID NO: 131874 - protein, 73 aa, Glycine max
  Coding DNA Sequence Number=SeqID_40189
MACGIFLLSVKCLFANGVKDLTWHANGRNCDGMLRHTIPEWKKIEVLCIRFRKRGPKKLFSRLATVEESIWSV

SEQ ID NO: 131875 - protein, 134 aa, Glycine max
  Coding DNA Sequence Number=SeqID_40190
  Subcellular localization annotation: CTP_CleavageSite=28; ConfidenceScore=5.30e-01
MATQLNQAQSQNSDKLPSQTVHNPKNVSAITLRPRNQIQVPPPVAAPEPIKLHSTPEKDDEIVEQKRKLPNKNFHAGGPSSSNSDLQQPPIPLPFPPRAIPNKKMEEAEKEILETFRKVEVNIPLLDAIKQIPR

SEQ ID NO: 131876 - protein, 187 aa, Glycine max
  Coding DNA Sequence Number=SeqID_40191
  Gene Ontology: Mol. function=RNA-directed DNA polymerase activity; Biological process=RNA-dependent DNA replication
  Homolog annotation: Hit_ID=Q0ZCD0; Match level="QueryCoverage=96%, HitCoverage=16%, E-value=1e-11, Identity=27%"; Hit description =Integrase
MDRSMIDAASGGALGDMTPTEARNLIEKMASNSQQFSARNDVIVLRGVHEVATDSSSSTENKKLEGKLDALVNLVTQLAMNQKSAPVARVYDLCSSADHHTDLCPSLQQSGVNEQLEAHAANIYNRPPQQQNQQQENNYDLSSNRYNSGWRNHPNLRWASPPQQQQPVPIFQNAAGPSKPYVPPPIH

SEQ ID NO: 131877 - protein, 106 aa, Glycine max
  Coding DNA Sequence Number=SeqID_40192
MGEAHEIPHHNLADFEPCLGYATKGQAVVDIPLQNTLEGPQYHPQSHLLHSTMGKNPHDMAEMGKLDHLKERLKAIEGGEDYAFANLEELFLVPEHGYSQVQGVGL

SEQ ID NO: 131878 - protein, 93 aa, Glycine max
  Coding DNA Sequence Number=SeqID_40193
VPPVQLLTGWCVTAKAPPDISAGKCSGHAARRVPFAIQAAQLLGRAIGAGLFAITPAGERGMCCKAIKLGNARVFPEFDIKVCHVALPPALRQ

SEQ ID NO: 131879 - protein, 178 aa, Glycine max
  Coding DNA Sequence Number=SeqID_40194
MAPRKLASKRSRKDKAAEGTSSAPKYDSHRFRSAVHQQRFEAIKGWSFLRERPVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGEASANHAHQHDHPDPDMDDVAPQQHPAHRS

SEQ ID NO: 131880 - protein, 76 aa, Glycine max
  Coding DNA Sequence Number=SeqID_40195
MAPKKLSTKRSRRDAAVEGTSVAPEFDSHRFRSAEHQQCFEAIKGWLFHRERRIPTQDNEYTDFQEEIARRHWTSL

SEQ ID NO: 131881 - protein, 95 aa, Glycine max
  Coding DNA Sequence Number=SeqID_40196
MHLKRSTAWPIQIARGSTTRVIIREAISLKPKVKVKGSILGTTSTRTKEMDQLVKQLVEKSTRNIVENTEKNPKEECKVVLTKSKGKERLKKKES

SEQ ID NO: 131882 - protein, 69 aa, Glycine max
  Coding DNA Sequence Number=SeqID_40197
MEDCLEGPHLGNHETQLQTRKWRTHEQRLEITFMGLRKRLRMEDFLEVPQLGNHETQLQSRKWSTHEQF

SEQ ID NO: 131883 - protein, 133 aa, Glycine max
  Coding DNA Sequence Number=SeqID_40198
MVVVAGETEGPPKCFQRVYHQLLALQWHIRAKARSQLDCGVGILCVSPMLGASHMMGRRACFELHSMGRPYFLIFAYQYFEVSRMIHLLEAGWGRRVHLEAINAGSGNLQPHWLPLSSSRSWHGLHHCGHVSL

SEQ ID NO: 131884 - protein, 31 aa, Glycine max
  Coding DNA Sequence Number=SeqID_40199
VDLLVLVPITFRGLHVLTIRGLHALTSRGVI

SEQ ID NO: 131885 - protein, 153 aa, Glycine max
  Coding DNA Sequence Number=SeqID_40200
  Homolog annotation: Hit_ID=A7Q8B9; Match level="QueryCoverage=26%, HitCoverage=13%, E-value=2e-12, Identity=73%"; Hit description =Chromosome chr14 scaffold_63, whole genome shotgun sequence
KTDLTPSCMLHSARGDIAQLVELRSCNWVVAITEDRNMPLKDSTETKTGCQERRGEDQAGPCEQLDALSPFNPLSEMWQKEKESMDRPHRLHPVGTTRSPQGRLRHPGGRGTDHRNPVQKAERISYPLSGGRGKLSVPGSPVAGSSGTTRILS

SEQ ID NO: 131886 - protein, 347 aa, Glycine max
  Coding DNA Sequence Number=SeqID_40201
  Gene Ontology: Mol. function=transporter activity; Cellular component= integral to membrane; Biological process=transport
  Homolog annotation: Hit_ID=A4W5S2; Match level="QueryCoverage=96%, HitCoverage=78%, E-value=1e-149, Identity=82%"; Hit description =Major facilitator superfamily MFS_1
  Pfam annotation: Domain name=MFS_1; Domain location=3-340; Score =61.7; E_value=2.4e-15; Accession=PF07690.7; Description=Major Facilitator Superfamily
  Pfam annotation: Domain name=Sugar_tr; Domain location=1-347; Score= -15.4; E_value=2.2e-08; Accession=PF00083.15; Description=Sugar (and other) transporter
  Pfam module annotation: Pfam domain module=MFS_1::Sugar_tr; Domain location=3-340::1-347
MATVIARNFFQLEGEAGLTSLILTWASFAIAFFFRPLGAVVFGRIGDRIGRKPTLIIVLVLMTLATTAIGLVPVYASIGIAAPLIVTLLRILQGLFAGGEYGGAVSLMTEFAPRGKRGLYGAWQSFTVALGLLAGAGIVALLSALLTPEALHDWGWRIPFFLALPMGAVALWLRVSMEETPSFVRQKEKPVVAQASTSATLKTILMGICRVMVWSAAGYTYLVIMPTYLQSALHTGFNQALLIAVISNIGFALTIIPSGILSDKIGRRTVMMIATALLLLLALPLLKMLQAESATLAVKAMVVLIAGGLVGMLAGPGPAMLSEMFPTRVRYTGLGAGVFPVKRDLLG

SEQ ID NO: 131887 - protein, 52 aa, Glycine max
  Coding DNA Sequence Number=SeqID_40202
RAVPCVATYPLAGGLRGARGCVFQERNTRRVATKRLFEENVEKTGKDVIYKL

SEQ ID NO: 131888 - protein, 69 aa, Glycine max
  Coding DNA Sequence Number=SeqID_40203
MGEEEKKPEENKMEEKKANEEEKKEEEKKPEESKDDKKSKEESAPPKIMQSTTFAMHGYFKNDFWHLLS

SEQ ID NO: 131889 - protein, 73 aa, Glycine max
  Coding DNA Sequence Number=SeqID_40204
MLLSSNIIHICVRVVMLVRMTRTRLFAAARVKSCLGMHSSYVIASLSGSARTVGLAPISGGGPGTDKRKLLAP

SEQ ID NO: 131890 - protein, 137 aa, Glycine max
  Coding DNA Sequence Number=SeqID_40205
MYNYHEKGRAPDLESVLADFMTYQASSKGDCYSMQQLGTQFEKDYSFADYQWESEWKPYYHYEAEGLSNLDDLLMQFKVMVRREEEYAEFKTHQESILQVNTIHHQLITKEEKDEVSSILEYPCMATTGYVVGKDKG

SEQ ID NO: 131891 - protein, 64 aa, Glycine max
  Coding DNA Sequence Number=SeqID_40206
MDTSRYSVGKLAFLLAMIFLIASGMCMESKTITGTLPKECSRDMDCRPYGCEILTPCGCLKKMY

SEQ ID NO: 131892 - protein, 181 aa, Glycine max
  Coding DNA Sequence Number=SeqID_40207
  Homolog annotation: Hit_ID=Q2HTA0; Match level="QueryCoverage=49%, HitCoverage=14%, E-value=3e-12, Identity=48%"; Hit description=IMP dehydrogenase/GMP reductase, related
  Pfam annotation: Domain name=DUF1723; Domain location=30-79; Score =54.2; E_value=4.5e-13; Accession=PF08330.1; Description=Protein of unknown function (DUF1723)
MHNLGRPIPAIDDMVAGTGLSPLIACSIDTSDRGLISSFVERWHRETSSFHLPVGEVSITLDDVMSLLYLPIVGAFHDFQPLRTDEVVVLGDHGRDRRMWWTIFTPVVVARRIPVQMSDVALDSCRSRLSSTSFGAAGLIHMYDQLNDANLSTSRQLAGYITLLQHFPLVAECNANPDYDK

SEQ ID NO: 131893 - protein, 132 aa, Glycine max
  Coding DNA Sequence Number=SeqID_40208
  Subcellular localization annotation: CTP_CleavageSite=46; ConfidenceScore=5.18e-01
MVKVGTSYVPINVSFSPKVGPGLPAVPPVQLLTGWCVTAKAPPDISAGKCSGHAARRVPFSIQAAQLLGRAIGAGLFAITPAGERGMCCKAIKLGNARVFPVRTLANWSSTAVAAALELVDPPGRRNSIQYT

SEQ ID NO: 131894 - protein, 158 aa, Glycine max
  Coding DNA Sequence Number=SeqID_40209
  Gene Ontology: Cellular component=mitochondrion
  Homolog annotation: Hit_ID=A7QD19; Match level="QueryCoverage=41%, HitCoverage=51%, E-value=1e-12, Identity=57%"; Hit description =Chromosome undetermined scaffold_79, whole genome shotgun sequence
MKRGERGQLTTAKSQTTSTLCMIENCRCVLPGACSELRLENNKQGIELSKALSPYSNKANALYLTKAFSDRGSLAVVWVELKPPLIPINRSSGGLPSTHLSIYKNPSPEESRSSRMRMNPGHTHPDPPWNFRNLQKHSRRGLVMIFSQDHKVLKWQAG

SEQ ID NO: 131895 - protein, 149 aa, Glycine max
  Coding DNA Sequence Number=SeqID_40210
MSRGSGDLGDVRRAPGSQQIKGTKTTKRGGLWWLASCESCVIYGLWPLVVEASGNRLPVCVIDYTEEWVTGNRLPGFHVLKLCDSSLASGNRLPRLCNRLPEMKSLKIPLLLACNGYEKYCVAAWLDSCERVYPFLFFLVDRDGGAANP

SEQ ID NO: 131896 - protein, 46 aa, Glycine max
  Coding DNA Sequence Number=SeqID_40211
SGNWNEYNLNPFNEDPLEGKSGASSRVKKLVVGPWVGSIGPPPVCT

SEQ ID NO: 131897 - protein, 20 aa, Glycine max
  Coding DNA Sequence Number=SeqID_40212
MGLTASAQIVILKELLASFF

SEQ ID NO: 131898 - protein, 22 aa, Glycine max
  Coding DNA Sequence Number=SeqID_40213
MKNERVCVWVGFDPLKVEDDEQ

SEQ ID NO: 131899 - protein, 200 aa, Glycine max
  Coding DNA Sequence Number=SeqID_40214
  Homolog annotation: Hit_ID=Q6WAY6; Match level="QueryCoverage=94%, HitCoverage=30%, E-value=1e-18, Identity=34%"; Hit description =Putative uncharacterized protein
MDGLVDLAAIDAFLAYHDHKESPVVAMLADLYDTFDRRCEKSSTRIVCCTPALYVWLVSHLFRQEVRHACPLESHRSCTEKGGANWDQLLASKEGASVNWFPRWKEGRTRVLISCEGFPNVPLMGTRGCISYNPILAIRQLGYPMRGAPLEDELAPVISRGFNKTNVETLQKVHKAWEVLQKKEKELGGSNNGTIGGYRK

SEQ ID NO: 131900 - protein, 67 aa, Glycine max
  Coding DNA Sequence Number=SeqID_40215
GLVGACALSATLARLAHISEFRLSACLLAQRMDSSGALSGMIPRSANMHSSSFFQILPRAQPKEWCA

SEQ ID NO: 131901 - protein, 345 aa, Glycine max
  Coding DNA Sequence Number=SeqID_40216
YYRLPTDFREIEAALCIPGRGFILNSEGHPRKILKKDLTTLAQVWSVLLYSNLAPTSHTSDLTVDRARLIFGLVSHLDMNIGALISGQMTSIAHSNTSRLGFPALITALCRAKGVVSDSLTFEHLSPVINLAYIRNNCWNPDDLTVSIRGARRARARPAELPSTFAAPTPASTSAAPSVLVQTDFQCFEAMLQSIHQGQIILLQSLQMVAPPDSIPSVEQFNEMVAWPGTQPSLHREDEGPTAQVPQHMKDESSEATIPEPFDIGEEANETQMRQVAATTPERSLEATSEPSAPVVNLPSPQPAADPSTLLLEMPEDPTTPVLAVDTSPPTTPVLPLIDEKDGQT

SEQ ID NO: 131902 - protein, 88 aa, Glycine max
  Coding DNA Sequence Number=SeqID_40217
MESSFTDVDVYLLCQDETDVGHQAYRYRRPRGGAREKKGCTGASAEYVIQGYIPLPRSLTRYARSFDCGERKWLTNGRRFPGRCQEDT

SEQ ID NO: 131903 - protein, 253 aa, Glycine max
  Coding DNA Sequence Number=SeqID_40218
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131904 - protein, 225 aa, Glycine max
  Coding DNA Sequence Number=SeqID_40219
MPTDIREIEVALCILGRGFVLNAEGHPGKILRKDLTTLAQVWSVLSYSNLAPTSHTSDLTLDRARSKGVASDSLVFKHLSSVINLAYIRKNYWNLDDLTVTIRGARRVSASSAEAPSTSAAPPPARTLAAPSTLPSIDFHLLEAMLRSIHQGQIVLLQSSLAQDSASPSQGRRRSHRSGSRPLTPKDQTTPVLSPNTSPPATPVLRLTDKEDVQTQDTQDRSQDF

SEQ ID NO: 131905 - protein, 223 aa, Glycine max
  Coding DNA Sequence Number=SeqID_40220
  Homolog annotation: Hit_ID=Q6UUU1; Match level="QueryCoverage=26%, HitCoverage=40%, E-value=2e-18, Identity=78%"; Hit description =Putative uncharacterized protein
  Subcellular localization annotation: CTP_CleavageSite=42; ConfidenceScore=5.16e-01
WTSYVPINVSFSPKVGPGLPAVPPVQLLTGWCVTAKAPPDISAGKCSGHAARRVPFAIQAAQLLGRAIGAGLFAITPAGERGMCCKAIKLGNARTTLGASRDSVTFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131906 - protein, 158 aa, Glycine max
  Coding DNA Sequence Number=SeqID_40221
  Subcellular localization annotation: CTP_CleavageSite=42; ConfidenceScore=5.17e-01
MNCVFVHASSTHEFGVMRSDCLVQFSILNPSFRSPMNCVFVHASSTHEFGDMRSDCLVQFSILYFFSESPMNCVFVHAPSTHEFRAMRSDCLVQFSVLYFFLEPHEIAFFVDASSSHEFGDMRSDCLLQFSIIYPSIRSPMKCVFVSCVLHPRVWSHA

SEQ ID NO: 131907 - protein, 268 aa, Glycine max
  Coding DNA Sequence Number=SeqID_40222
PTEESLSPFLVRNLGAQSLKVIQRVHKAWRSPLRKDKELRGIRNGVIGGYHGWLRIHMRGLDCLSKLKVIDEESFEAPEEDEEVRALKLELGKTRLAKDKFKSAATHIRKECTELQEENAATAKALEQETKRARKEEYGREKFRGALWGSNNELKLRREERDRSKRSLAQHLEATEQRMLAIIGQYKEELNQSVAHEQKLVEDFAQVYAEKEARGRVIDALHQEAAMWMDRFALTLNGSQDLQRLLAKAKAMAEVCTAAEEISWANQL

SEQ ID NO: 131908 - protein, 150 aa, Glycine max
  Coding DNA Sequence Number=SeqID_40223
MKFASTQSLQLVAPPDSIPMVEQFNEWVAWPRTQPPLHREDEDPTAQVPHQPEDESSESSTPEPLIRKRRVVVTQEAATTSEKSLEATPEPLAPVADITSPQQVANPSTPEDQTTPVQSLNASPIATHVLHLSEEEEVQTQDTQNQSQDF

SEQ ID NO: 131909 - protein, 75 aa, Glycine max
  Coding DNA Sequence Number=SeqID_40224
MSLHGQDHLGLPSGVETKHEQQKPIKVLKDGCKWGWGHDRPIVAPSLCENKQRMSLQGSPVSFCILQLSFTICLF

SEQ ID NO: 131910 - protein, 114 aa, Glycine max
  Coding DNA Sequence Number=SeqID_40225
MDKSLKVGEDEWREKERRNTKFYASNELSFSPLIQDQVKDSPLSVLRCREAYKWAHTYPMGPKSTLRLMRILGPSPTSLAQPSWSLLSNALGGVGLHHSLPLEKDLTSNPKVLE

SEQ ID NO: 131911 - protein, 145 aa, Glycine max
  Coding DNA Sequence Number=SeqID_40226
AIEGGEDYAFANLKELFLEPNIITPPKFKVLYFDKYKETTCPKNHLKIVSIMFSDRMQLQNMCKKGALIVQKNTPKGGETWQLKWHLNDGEKMITMIVDTLPVFYYEKMVDYTPSSFDDMVFTDERIKGENEGEAHAVTAIPIQP

SEQ ID NO: 131912 - protein, 117 aa, Glycine max
  Coding DNA Sequence Number=SeqID_40227
  Subcellular localization annotation: CTP_CleavageSite=69; ConfidenceScore=5.24e-01
MRGIMHEPQVNIGADQRTCRLWRTRLPRLQRTRLPNLQRTRRPPVQRTTRPCFVGRTPSPSEDYMSSPSEDYTSSISKNYTSYPSEGFTSLPARGCSSLAFRGFNVSVLQRNYAPSS

SEQ ID NO: 131913 - protein, 81 aa, Glycine max
  Coding DNA Sequence Number=SeqID_40228
MVNSMLSYSGLSEGFWGEAMLTACYLLNRIPNKRNKRLEHIIESIPKGARNKMTTYISMKFSRFKKLGLGFDMLMKDRDTG

SEQ ID NO: 131914 - protein, 78 aa, Glycine max
  Coding DNA Sequence Number=SeqID_40229
  Subcellular localization annotation: CTP_CleavageSite=21; ConfidenceScore=5.11e-01
MQGYRMVICTFRQPGTNKPVDVQRLTSSFAPFVILTHEVRFLLSSSGDIQARRHTRFFSAGRGAIKFDGVGKCRGCPI

SEQ ID NO: 131915 - protein, 127 aa, Glycine max
  Coding DNA Sequence Number=SeqID_40230
  Subcellular localization annotation: CTP_CleavageSite=69; ConfidenceScore=5.97e-01
SSSSDSVSSAASSSSSAASSSSSAASSSSSASSSSSAASPSSSAASPSSMPLSESLLISRSSSIFFSVVALMVASSTLHVSLSSAIRASLDTAPEAAAFPDVETIDFLGNLMLRNSNVHHSICWSAQ

SEQ ID NO: 131916 - protein, 84 aa, Glycine max
  Coding DNA Sequence Number=SeqID_40231
VAPSTSNEDDHLLSQDEQALNEAEEAAAHVQTDPVEINLSQPHLSHDSDMELMVPATIVPPIARNKLTITRPKQRKVADKDDAA

SEQ ID NO: 131917 - protein, 53 aa, Glycine max
  Coding DNA Sequence Number=SeqID_40232
MTKKRSHLSHARGAERHPPIGKSAEGAGECGLFPILRSNSDLHITRKTIKETV

SEQ ID NO: 131918 - protein, 70 aa, Glycine max
  Coding DNA Sequence Number=SeqID_40233
MTNKEHLTKNVVEVDYSRDLVAPRPRFLFFLLLISLSSQYPSMLNLGILHSASLTPIYSQKWHLVTWQLA

SEQ ID NO: 131919 - protein, 156 aa, Glycine max
  Coding DNA Sequence Number=SeqID_40234
MVICALSGDVSISDGDFSSLTSYLELRRSKFLIGGYVGARACFCRPPHNLCHTDPEVMRHAPLYHPETAGPMIRGDTLRLSAPFCHPEAAGPMTSRDQIWSFCTLVSSRGGGPDDTRRYLTVIRTLLSSRGGGPDDKQRPSLVILHPYIIQRRRAR

SEQ ID NO: 131920 - protein, 73 aa, Glycine max
  Coding DNA Sequence Number=SeqID_40235
  Subcellular localization annotation: CTP_CleavageSite=41; ConfidenceScore=5.65e-01
MSSMALANVIFFAFAGNGPKEAFMRQRRLGRTRQPKVQLFRRSMTVHRFLKRLAPSALSRPCYRDVNFLRLDV

SEQ ID NO: 131921 - protein, 252 aa, Glycine max
  Coding DNA Sequence Number=SeqID_40236
  Homolog annotation: Hit_ID=Q84VI1; Match level="QueryCoverage=100%, HitCoverage=36%, E-value=3e-82, Identity=67%"; Hit description =Envelope-like protein
MATSPKEISASGSPAVPSSPHQEQPEFNIQPIQMIPGQAPVPEKLVPKRQQGVKIAENPSPATSPREVDPEMDKKIRSIVSNILKNASVPEADEDVPTSSTPNVSVPDVDKDVPTSSAPNAEALPSPSEEESTEEDDQATEETPAPKAPEPAPSGLIDLADVESDEEPIANRLAPGIAERLQSRKGKTPIKRSGRIKTMAQKKSTPITPTSSRRNKVTIPSTPRKEISSSDSDDDVELDVSTSKRAKKSGKK

SEQ ID NO: 131922 - protein, 257 aa, Glycine max
  Coding DNA Sequence Number=SeqID_40237
  Homolog annotation: Hit_ID=Q6UUU1; Match level="QueryCoverage=23%, HitCoverage=40%, E-value=3e-18, Identity=78%"; Hit description =Putative uncharacterized protein
WNLLRADQRLIFAKKLAQGFPVSTGTPGFIYFCEVIFRHSGFCFYQLSLPVQLLTGWCVTAKAPPDISAGKCSGRVPFAIQAAQLLGRAIGAGLFAITPAGERGMCCKAIKLGNARVFPVTTLLISQIRVKPSSCDIRIHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131923 - protein, 35 aa, Glycine max
  Coding DNA Sequence Number=SeqID_40238
MTQELRPMWSSAPFPEMSASSGGDFFKSHKLSRTT

SEQ ID NO: 131924 - protein, 112 aa, Glycine max
  Coding DNA Sequence Number=SeqID_40239
  Subcellular localization annotation: CTP_CleavageSite=52; ConfidenceScore=5.34e-01
MTKNNPNRGQPERAPPRSTKNIPSRGQLKIALAKVNRKKPSLRSVKNNSWPRLAKNNPSRVVNDVDGNQKDGVNEEIPIVEDNIGDLENPLVVVDELYKGDYMKPFELGKVK

SEQ ID NO: 131925 - protein, 98 aa, Glycine max
  Coding DNA Sequence Number=SeqID_40240
  Subcellular localization annotation: CTP_CleavageSite=66; ConfidenceScore=5.25e-01
MVKGTNKVLLQGAVGVDGLYSFYNIKLQDHRPQLLTTTSSIANKESTVTSSSGFSSLSTVSHWHARLGHPNSHIFVPLVVWENLIGCLPMLPLQFILL

SEQ ID NO: 131926 - protein, 61 aa, Glycine max
  Coding DNA Sequence Number=SeqID_40241
MGHLSDQGVPKDPKRIKIILDWPTPPSVEGRSPKYEEPQDLRSNPFQGEGDDAILPRKGIG

SEQ ID NO: 131927 - protein, 127 aa, Glycine max
  Coding DNA Sequence Number=SeqID_40242
  Homolog annotation: Hit_ID=Q5CDC4; Match level="QueryCoverage=33%, HitCoverage=32%, E-value=8e-16, Identity=100%"; Hit description =LacOPZ-alpha peptide from pUC9
GFPSHDVVKRRPVNCNTTHYRANWSSTAVAAALELVDPPGCRNSMFKRIVYVSCHPGSLARDAGYLVNEQDQAYRYRRPRGGARYQLLFPLVRVNFELGVIMVIAVSCVKLLSAHNSTQHTSRKHKV

SEQ ID NO: 131928 - protein, 288 aa, Glycine max
  Coding DNA Sequence Number=SeqID_40243
  Gene Ontology: Biological process=transposition, DNA-mediated
  Homolog annotation: Hit_ID=Q6UUU1; Match level="QueryCoverage=24%, HitCoverage=46%, E-value=2e-18, Identity=71%"; Hit description =Putative uncharacterized protein
WNSYVPINVSFRQKLARASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMASLGVHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 131929 - protein, 130 aa, Glycine max
  Coding DNA Sequence Number=SeqID_40244
MAQPPPCDRTLREMATPDFTYKSLCIQYPDEDVPYVLKTGLIHLLPKFHGLAGEDPHKHLRNFILSAPPCPQIPRGVYFGLKLPSPSDFKAAASPIFLFFERLSNMEKSMIDAASGGALGDMTPAECRKI

SEQ ID NO: 131930 - protein, 176 aa, Glycine max
  Coding DNA Sequence Number=SeqID_40245
  Homolog annotation: Hit_ID=Q9AVH2; Match level="QueryCoverage=80%, HitCoverage=50%, E-value=1e-47, Identity=66%"; Hit description =Putative senescence-associated protein
MGMRFKRLVGLSASRGSPTARAFGGPRPPTAAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 131931 - protein, 47 aa, Glycine max
  Coding DNA Sequence Number=SeqID_40246
MGDGPFQVLERINDNAYKVELPGEYNAQVSRRKVQVVSCIMAQMEED

SEQ ID NO: 131932 - protein, 148 aa, Glycine max
  Coding DNA Sequence Number=SeqID_40247
MGKAEEVQEKVKADMEAMKEKMATMMEAMMSMKKIMEANAVTIASTSTVAKVNPMPPSDLNQMNHPTSAMVGKIWEVRAAPMMCKFKTSTPSRHMACLSTIHHPMWRTLPIRMSIIPLLYPLRANNLKLIMHMSLKPWGRHMKFPTTI

SEQ ID NO: 131933 - protein, 89 aa, Glycine max
  Coding DNA Sequence Number=SeqID_40248
MSILTLGSKKDEKENFQSKRKQKREKENFQSKEKRKQGNSQSKSGRKRKERKENSKSKKKEWEKVKKKKAPGQRNQKKCAERSLDQTIS

SEQ ID NO: 131934 - protein, 95 aa, Glycine max
  Coding DNA Sequence Number=SeqID_40249
AARPTEVLKAFEAYTSLLHDKKGGALLSINGKISVRGVIRNPRKDRLRLPPRSHEDLYVLVQSRTTEIFRSACVGSSSNKEESGLKFRPGPPVCC

SEQ ID NO: 131935 - protein, 45 aa, Glycine max
  Coding DNA Sequence Number=SeqID_40250
MRGVATTVYSRKMMQSYPARALDRKLQVDWARDAREGPRVLMSLR

SEQ ID NO: 131936 - protein, 126 aa, Glycine max
  Coding DNA Sequence Number=SeqID_40251
MTNRLRYLLFPLTKIQKTNRLRILCPNTLEGTSFVAQVEGTSTWVVILRTREGTSLVDQFKWRVHPLGCSKRTREGTSLVDLWLVKDFTRLKEISRTVGCLGIGCRHGLWPNQYKSYVCLLLPYTF

SEQ ID NO: 131937 - protein, 109 aa, Glycine max
  Coding DNA Sequence Number=SeqID_40252
  Homolog annotation: Hit_ID=A5AWV0; Match level="QueryCoverage=96%, HitCoverage=8%, E-value=2e-08, Identity=30%"; Hit description =Putative uncharacterized protein
MDRSWMKAKRISDEYENGVEQFLQFTQLNAESLRGNYFCPCVKCLDDSGERIEEMIHDLGQETFEQAHAPLYDTIERYSKMPLYSGCTSFTRLSAVLALVKLEGKIWVE

SEQ ID NO: 131938 - protein, 345 aa, Glycine max
  Coding DNA Sequence Number=SeqID_40253
  Homolog annotation: Hit_ID=Q6WAY6; Match level="QueryCoverage=80%, HitCoverage=50%, E-value=2e-31, Identity=32%"; Hit description =Putative uncharacterized protein
MVEEFEEILGCPLGGRRPYLFSGFYPSLARISKIVQISAQEVDHRKQVENGVVGIPRKYLEAKARILASKGEWASFIDILALLIFGGVLFPNVGGLVDIATIDSFLAYHNHKESPVVTMLADLYATFDRRCKKSKVRHACPLEGHRSCTEKGGANWDQLLANKEGAFVNWFPWWKEGRIRVLISCGGFPNVPLMGTRGCISYNPVLAIRQLGYPMRGAPLEEELAPVISRGFNKTNLETLQKVRKAWEVVRKKDKELRGSNNGPIGGYRKWLRAHVQGLDWLLSLRTARREEVEALEEDEEVQALRAELEQAQTVKEKFKSAALKIRKNNAELRDTNIATTKALE

SEQ ID NO: 131939 - protein, 175 aa, Glycine max
  Coding DNA Sequence Number=SeqID_40254
  Homolog annotation: Hit_ID=Q2HSV3; Match level="QueryCoverage=74%, HitCoverage=22%, E-value=3e-11, Identity=32%"; Hit description=IMP dehydrogenase/GMP reductase, putative
MSPRACRWLTTKAYSKGFPASTYRTRINALTIPDVCWMPYGEHRGVRAFDLISCFQERVVRQFGYVQTIPPLPTGASLSFEDIDDRWMHYSDHLAVGGQICLVPGQYTPDYMDWFFRISHPFITPTQAADPPIHPPVLQYDTYVKPDIPEVPVAPETGPSHAPSDVEQLKHAVVR

SEQ ID NO: 131940 - protein, 58 aa, Glycine max
  Coding DNA Sequence Number=SeqID_40255
TFTYLWLWTWSPAGRSRVVGNALAFVDELRWTLEVVAVRLLPTTGCPQAAVVPRPALA

SEQ ID NO: 131941 - protein, 62 aa, Glycine max
  Coding DNA Sequence Number=SeqID_40256
  Homolog annotation: Hit_ID=A0PAV3; Match level="QueryCoverage=61%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYQLSLLFSTDGV

SEQ ID NO: 131942 - protein, 84 aa, Glycine max
  Coding DNA Sequence Number=SeqID_40257
AANHRAHVQTHDCLYQLSLSLQSLGFTSFPCPTPDQFRAEVAWSGDWPEAPVEAPAEAPDEADEAHEDEEMTDLLDFLGGSGAT

SEQ ID NO: 131943 - protein, 160 aa, Glycine max
  Coding DNA Sequence Number=SeqID_40258
MAPTRHPLDPDKSNRALGFPALITGLCQSFGVPVTPSKVIRPPITRAFIEKYCTQRQAQGDASQAADAPPPHQAAPAGSFDTDVLGGRQQAGNHRAHSQGFTSFPCPTPDQFRAEVAWPRDWPEARAGEAPAEAPDEANEAREDEEMADLLDFLGGSGAT

SEQ ID NO: 131944 - protein, 45 aa, Glycine max
  Coding DNA Sequence Number=SeqID_40259
MEGEEPWVGLWLPLKYRVDMGSSLAYDNGIGVVFVIGSAVDRLCG

SEQ ID NO: 131945 - protein, 90 aa, Glycine max
  Coding DNA Sequence Number=SeqID_40260
MARSVSASCPYSRDLYGRELTRLLVIIPKVVISLLMVSRVSSGVANCRNLPFGGKATSDSRVRVPRKEYARSRHQHLFEENTGKAMIYEL

SEQ ID NO: 131946 - protein, 448 aa, Glycine max
  Coding DNA Sequence Number=SeqID_40261
  Gene Ontology: Mol. function=transporter activity; Cellular component= integral to membrane; Biological process=transport
  Homolog annotation: Hit_ID=A7MN05; Match level="QueryCoverage=88%, HitCoverage=90%, E-value=1e-162, Identity=71%"; Hit description =Putative uncharacterized protein
  Pfam annotation: Domain name=MFS_1; Domain location=29-393; Score =151.7; E_value=2e-42; Accession=PF07690.7; Description=Major Facilitator Superfamily
  Pfam annotation: Domain name=Sugar_tr; Domain location=25-434; Score=- 115.9; E_value=0.00019; Accession=PF00083.15; Description=Sugar (and other) transporter
  Pfam module annotation: Pfam domain module=MFS_1::Sugar_tr; Domain location=29-393::25-434
MLRDEVDMISSDVSGSTLSQLNKRIIPFIVICYFVANLDKTNISIAALQMNADLGLTTSMYGLGVGMFYISYILFEIPSNVIMTKVGARRWIARIMITWGIVSTGMALVHSANQLYVMRFLLGMAEAGFAPGIIYYISCWFPKSNRARAMSFFYMGSVGASIIGLPISGAILNMHGIADIAGWRWLFALEGIPAVVLGCLVLWRLPDKPDDAVWLTTPQKHWLRQRLEQDNLGVTLNKNHSWLQALKDRTVLLLSLVWFLQAFGSIGITLFMPLIIKSMAAEQSNFIISLLSALPFVMVCVFMYLNGRHSDRSGERAWHMGLPLILSGLALTGAIYSGSLLLAYILLVLTVGLNFALTPIFWAVTTEKLAGVAAAASIAFINTVANFVGLGLPPLLGKMKDATQSYHSGLLIVAIALIVGGILGIIIARPSGGAGASKTRAQHVETGH

SEQ ID NO: 131947 - protein, 92 aa, Glycine max
  Coding DNA Sequence Number=SeqID_40262
  Homolog annotation: Hit_ID=A0KDE3; Match level="QueryCoverage=72%, HitCoverage=39%, E-value=2e-07, Identity=43%"; Hit description =Putative uncharacterized protein
  Pfam annotation: Domain name=DUF892; Domain location=1-81; Score= -64.6; E_value=0.029; Accession=PF05974.3; Description=Protein of unknown function (DUF892)
MSVVGQAASDMLQDEEGIRVAVSSYVFCNYKIATYSTLLVAAEQAEEGEDVRIVRRILQQESQMASWLLQLLPQAAEEAIVLRTEPELSGTD

SEQ ID NO: 131948 - protein, 83 aa, Glycine max
  Coding DNA Sequence Number=SeqID_40263
  Homolog annotation: Hit_ID=Q8Z7N8; Match level="QueryCoverage=63%, HitCoverage=96%, E-value=8e-16, Identity=75%"; Hit description =Putative uncharacterized protein STY1156
MKDPKKKPEEEEKVTQRRGGSGNFAADKERAAEAGRKGGQVSGGNFKNDPQRAIEAGRKGGKISRRIIASAMHLTGVNPPLST

SEQ ID NO: 131949 - protein, 1254 aa, Glycine max
  Coding DNA Sequence Number=SeqID_40264
  Gene Ontology: Mol. function=acyl-CoA reductase activity; Cellular component=extracellular region; Biological process=bioluminescence
  Homolog annotation: Hit_ID=A1TVR5; Match level="QueryCoverage=37%, HitCoverage=94%, E-value=1e-143, Identity=56%"; Hit description =Putative acyl-CoA reductase
  Pfam annotation: Domain name=LuxC; Domain location=851-1254; Score =304.1; E_value=2.8e-88; Accession=PF05893.5; Description=Acyl-CoA reductase (LuxC)
  Pfam annotation: Domain name=LuxE; Domain location=447-799; Score= -77.4; E_value=2.9e-05; Accession=PF04443.3; Description=Acyl-protein synthetase, LuxE
  Pfam annotation: Domain name=Peptidase_M15; Domain location=195-379; Score=242.8; E_value=7.8e-70; Accession=PF01427.8; Description=D-ala- D-ala dipeptidase
  Pfam annotation: Domain name=Peptidase_M24; Domain location=10-202; Score=-77.0; E_value=0.0015; Accession=PF00557.15; Description =metallopeptidase family M24
  Pfam annotation: Domain name=VanY; Domain location=231-363; Score= -0.4; E_value=2.4e-05; Accession=PF02557.8; Description=D-alanyl-D -alanine carboxypeptidase
  Pfam module annotation: Pfam domain module=LuxC::LuxE::Peptidase _M15::Peptidase_M24::VanY; Domain location=851-1254::447-799::195 -379::10-202::231-363
RQAFPMPPLAQLSAQVQGGWRVRDVAALAAAQFLRLGADSGETGPIVIASGDSGFLHASGHEQRLQAGDVLHVELIPKVRHYSARLMRPLIVGEISAARAALAQQLIAIQDRQLRAMKPGVAACTVDAVAREAVLSAGLREDYSNITGYALGLYTRTPRPSDFSCCFHPQAPWLLEENMVFHMYISAQGLAFSETDVELIDLAATLPGLMFDLKYATADNIAGYAIYRDAQALLHPDAAAALRRSSDIARLAGFRLLVLDAYRPQQAQWHLWDACPDADYVVPPARGSNHSRGVAIDVTLMDEAGNILEMGTGFDDMSAESHPFHPNVPQQAQRHRLLLNAIMLGGGFVGMPTEWWHFELPDAQNYPLLSDRFACVSRADRAPRGVLRLPALTRPPFRPQNAACSKGCPGCGTGVTARPHSLFAPFCESCAFLRPWLAVMPQSKEGTFMTEASIIATLLAFMQREETTEADFNQLALQLFAWQFEHNLPYARFARQRGRTPLTVKQWRQIPAVPITAFKDLTLSCRPVAEIPHIFMTSGTTGTGRGRSYHPTLAVYDLSMLINFRQRFMAGYPRLPMAILFPHSSELPNSSLAHYLTLAMHECGTPDSEVMVDAQGLKLPRLIAALEQAQASGQPYALLGASYSFVHLLDELARQQRRFRLPPGSRILDTGGFKGQSREVAAEAFYNALQQTFGVPRSHCINMYGMTELSTQFYDFGNEICPPVKSGPHWIRTRVVNPLTGADVPEGETGVLVHHDLAHFNSVSAILTEDAGVMVPGGLLAGDGIVSRCCAGTGMKVYAGHLPGIRHSEVAWHSLHFGQQGSTLEVCVPVLSEAQIATLAASVRDNARRYLHTLSVARITALIDEAIARLLNRSHPLRQQAERLLPLVTGYDAGMLRLGLTGYLKTFREPQLRRFLAEDFGNVQMLDDFQPRPKGGFARAFGPQLLLQVWAGNVPGLPLWSLIAGLLVKAGSVGKVASAEPLMAGWFAQLLAEIDPQLGDCLAVVWWQGGDERTEQQWFREADVVMAYGGEAALTAMQRRLPPATRFLPHGHKISFGMVARSALDVRRGTALARQVAYDVMRYDQAGCYSPQALFIERGGRMSPQEFAAYLAHELAALAQRYPRATLTLGESQAVAAWRNAEEMRALSGDRTLYGDENDAWAVVYVDKPEPLQPGALGRTLKVIAVDTLEETVNWVAAQRAYLQSVGLAAAPEVLFRLAAQLGAAGVTRITALGKMTSPEAGWHHDGRFSLLDL

SEQ ID NO: 131950 - protein, 1547 aa, Glycine max
  Coding DNA Sequence Number=SeqID_40265
  Gene Ontology: Mol. function=transporter activity; Cellular component= integral to membrane; Biological process=transport
  Homolog annotation: Hit_ID=A5EHZ7; Match level="QueryCoverage=29%, HitCoverage=90%, E-value=1e-161, Identity=61%"; Hit description =Putative ABC transporter
  Pfam annotation: Domain name=BPD_transp_1; Domain location=1108-1334; Score=71.8; E_value=2.3e-18; Accession=PF00528.13; Description =Binding-protein-dependent transport s
  Pfam annotation: Domain name=BPD_transp_1; Domain location=1369-1545; Score=83.1; E_value=9.2e-22; Accession=PF00528.13; Description =Binding-protein-dependent transport s
  Pfam annotation: Domain name=M20_dimer; Domain location=330-449; Score=60.8; E_value=4.7e-15; Accession=PF07687.5; Description =Peptidase dimerisation domain
  Pfam annotation: Domain name=Peptidase_M20; Domain location=227-549; Score=66.3; E_value=1e-16; Accession=PF01546.19; Description =Peptidase family M20M25M40
  Pfam annotation: Domain name=SBP_bac_5; Domain location=641-986; Score=236.6; E_value=5.7e-68; Accession=PF00496.13; Description =Bacterial extracellular solute-binding proteins, family 5
  Pfam module annotation: Pfam domain module=BPD_transp_1::BPD_transp _1::M20_dimer::Peptidase_M20::SBP_bac_5; Domain location=1108 -1334::1369-1545::330-449::227-549::641-986
HQRFMHGRNALHPAQAFQANHCVTCCDLQLIGFVGAGAAVLILQQSRLRLQQTARFVMQTKIVKEMAEVMQRRPAGHHRAGFAPAHQHPFRRERRQRLAHRTDRDTELRRQTVFTGQNGARRQFALQDGFTDMALHYFVQRSAFAFVQATELWNENSSLQRALTHIADDQAQILDDLQRMLRWTPASRPDWRVSVPDALWQTPDGSAQGERVNLLAALDAGAAENCNLYFHTDTVPAGDGWRFPPLALSVAENKLFGRGAADMKGTIVAALAAVRAAQRYQLHLRYNPVFLLCTDEEGGLYPGIRYLAEQQLFHGHLLSFNGGAVPRIWAGCFGSIDIKIIVSGRSAHSGDPLQGINAIEAALPLMNALYQLKDEVEQRVSAMPAPPHYQGRPLTALLTLAAAHGGSKGSTIPERFELLVNRRYAPEEPFADVWQELTQCVDKAMQGSAASDVTLQLIGHLAPVADPTGPHWPRWQAALSQGFGFPPAEFKAWGSATSSDMGWVQQAGIQEILLGGLARPDNRIHAADEYTTMADVIALSQSILAYLANDFQPTQGLNRRQFIASSTALTGAALLPWSFSASAAAVASATPGGTPRKGGLLRISVDQAVSVLNPHQVRVNPEYLVAELLYSGLTRLTQAMKAEGDLAQSWQPNDDLTQWTFTLRPDLRFSDGSPLTAADVVASLQALLDPKNASPALHNIGPIKTVSAKDNNTILIETEAPYADLPVMLAYPDAKIIPAHIAQGQYDKLSSASLGAGPFQLVSYDPERKIVVKRNPHYYDATRPYLDGVEVVVYPDAIAESSALIAGDTDLMLSAQSSEFARLAKSAGVLPLRVASGQFLNVNMGCDQKPFNDVRVRQALALCVDRQASVDFVADGLGSPGNDTPINAAYPYYAQLTQKALDYSKAKALLAEADKPSTRTQLGIALREMAKPGGFRINVQTMAHSTYLDQVWKKGNFYVGFYNMQPTPDAVFSLLYTSTAAWNETRWNNAAFDGAVMAARETNDETLRTQLYGKAQQLMHDEVPSLIPTFFDLLAASREHVAGYHLHPRAAARRCRGHAAGTKRHAGSTGGGAGAAWAGCTRLAAILALADAGVAGQLWRVDAQWPGGRTNVADGAVALAAAGAVRPVTDAGDRHSARHLGGRAARVISYMGISFPEFVTATLVLLLFADVWQILPATGYVPLSENFISGIQHLILPSITVALILVAHVSRMVRSEMVDVLHTDYVRAAWLKGLSRRRILWRHAMRNGLLPTITIVALDVGYLLGGIVVVEEIFAIPGIGRELIVAVQARDLPTIQAGVMILAATYAVGAAGVLILLLALLMVAGGAHVAPFDPEAISILTRYRPPSAEHWFGTDQLGRDIFSRVLVGARSTILLSLLATALAMVIGSVLGTASAYLGGKVDEFLMRTMDAVMAIPSLLFALLIVSTLGQSSMNAVLAITIAFVPGMVRIARSVALAARQQDYISAAIARGEAGYYIILREMLPNILAPIIVEATIRVAFAIMLFATLSFLGLGAQPPEPDTVDDDDPRSGYRAGGDWLQPAGRWPA

SEQ ID NO: 131951 - protein, 673 aa, Glycine max
  Coding DNA Sequence Number=SeqID_40266
  Gene Ontology: Mol. function=iron ion transmembrane transporter activity; Cellular component=membrane; Biological process=high -affinity iron ion transport
  Homolog annotation: Hit_ID=Q5DQI7; Match level="QueryCoverage=39%, HitCoverage=79%, E-value=1e-125, Identity=85%"; Hit description=EitA
  Pfam annotation: Domain name=ABC-3; Domain location=457-645; Score= -158.5; E_value=0.0089; Accession=PF00950.8; Description=ABC 3 transport family
  Pfam annotation: Domain name=FecCD; Domain location=385-669; Score =149.8; E_value=7.7e-42; Accession=PF01032.9; Description=FecCD transport family
  Pfam annotation: Domain name=Peripla_BP_2; Domain location=93-355; Score=42.8; E_value=1.2e-09; Accession=PF01497.9; Description =Periplasmic binding protein
  Pfam module annotation: Pfam domain module=ABC-3::FecCD::Peripla_BP _2; Domain location=457-645::385-669::93-355
AGRAAGGTGGLGVCHRSALAQPAAPDRRAGISPPSRHCAGADQCLHVWRYRLWLGGRIMDISSGRLLRADRHVGGLYSAGDAQSAAVRKAQATGGPAGCGPAFTERPDKVIASAFWPTKVLPQLAEQNAKIKTLTVEIPTLESVLAQNPDFVPAQTPLLLGPESKVAKREDLITLGVNSYVSPGMCATKKAAGDMYGSRQQLWDMTYLYQEIQDFAKIFNVEDRGQAVIADFKKREAALRQEFGSSKKDLSFVFWFSSSSPSADAYVGGKNSPSGFIASVLGGHNAITSETEWPTVSWESIIAANPDVIVVSSLDRNRWALDKAEEKIKFLKSDPAVSQLDAVKKGHIVVMDGQAMNPTIRTIYGAEQARQGLFLAASLVAAVALLLLVIATGVSVGELSIPLKSVFYAISNKMGLTHVPLSRIYESVIWDFRLSRALVAACCGAGLAICGAVLQSLLKNALAEPYVLGVSAGASTGAVSVVVLGIGSGAVSLSAGAFAGAFTAFAFVAFLTKGARGGNERTILAGVAASQLFNAITAYTISTSASAQQARDVMFWLLGSFSGVRWPELQLVLVVVTLGLAICLYYSRALDAFTFGDDAAASLGIAVPQVRLALFIATALITATIVSMAGSIGFIGLVVPHRIGRCHSDGAGRYRVAPADRPAKPAGRRGDRA

SEQ ID NO: 131952 - protein, 152 aa, Glycine max
  Coding DNA Sequence Number=SeqID_40267
MRGAPTEESLSPFLVRNLGAQSLKAIQRVHKAWRSPLRKDKELRGIRNDVIRGYHGWLRIHAQGLDWLSKLKVINEENFEAPEEDEEVRALKLELGKARLAKEKFKSAATHIRKECTELQEENAATARAFEQETKRARKEEYGREKFRGALW

SEQ ID NO: 131953 - protein, 123 aa, Glycine max
  Coding DNA Sequence Number=SeqID_40268
MGIAPTETPSGPEEVQQGLGVSSSGYGPLSALQGARSPPASSCRRGIGKDCACKTPSGPEEGQQGLGVANSKYGSLSVLGSACRPQQGHQAPLPIELSSRSTAPPGRHRAKHHISIGMAGSGQ

SEQ ID NO: 131954 - protein, 66 aa, Glycine max
  Coding DNA Sequence Number=SeqID_40269
MTKDNDWYLKALHWGNEGHLTLTVERTTRPRLERTTRPHHQRAACPHLQRTTCPRLERATRPHLGY

SEQ ID NO: 131955 - protein, 139 aa, Glycine max
  Coding DNA Sequence Number=SeqID_40270
  Homolog annotation: Hit_ID=Q6WAY6; Match level="QueryCoverage=41%, HitCoverage=10%, E-value=8e-08, Identity=48%"; Hit description =Putative uncharacterized protein
MEGLVDLAAIDAFLAFHHGKESPVVAILAMYERPTGDVKRATQELFVVHWLSMCGWFHTFFSKKVGPSIRYKVTARCPNVPLMGTRGCINYNPVLAIRQLGYPMRGVPSDESITPFIARGFSDHNARVLQGVRKAWDAA

SEQ ID NO: 131956 - protein, 145 aa, Glycine max
  Coding DNA Sequence Number=SeqID_40271
  Subcellular localization annotation: CTP_CleavageSite=56; ConfidenceScore=5.44e-01
MVKVGTSYVPINVSFSPKVGPGLPGAPVASVSISCPSCSATDGGGGVTAKAPPDIRAGKCSGRVPFAIQAAQLLGRAIGAGLFAITPAGERGMCCKAIKLGRIGAPPAVAAALELVDPPGCRNSIHVAASPAPLFWLACPSTASD

SEQ ID NO: 131957 - protein, 177 aa, Glycine max
  Coding DNA Sequence Number=SeqID_40272
  Homolog annotation: Hit_ID=A5B5G7; Match level="QueryCoverage=90%, HitCoverage=10%, E-value=5e-07, Identity=28%"; Hit description =Putative uncharacterized protein
MASKKRKTPSTPTQARFDRSKFTSQEAWERYTDIVVPRKLLLERNVVVYYSEFDKFKEELERRHWDEKLTDFFDSIIDIAIGKEFYANLYDPEDKPPKQVKVRGHLVKFDEDTLNTFLKTPVVLEEGENLCTYSRFALLRPDPQELAAKLCIPRRGFELNADGQPLKILRKNMTTLA

SEQ ID NO: 131958 - protein, 66 aa, Glycine max
  Coding DNA Sequence Number=SeqID_40273
MMREDKKSSLILIRHRPLSQRALLQASEGEAHGCAFQRRKDARSRHQSLFVENVGKTEGNRSNEKF

SEQ ID NO: 131959 - protein, 154 aa, Glycine max
  Coding DNA Sequence Number=SeqID_40274
  Homolog annotation: Hit_ID=B0HC01; Match level="QueryCoverage=21%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLDFLEGDEDPLLEVDSPEEVMSASEADSTEDSGPREMAISGGSSS

SEQ ID NO: 131960 - protein, 254 aa, Glycine max
  Coding DNA Sequence Number=SeqID_40275
MAFIILNSCIQSILQRFMQKSVLNDSRFSWAAEASPPPEGEGWTPGQATCARNSSTLMVGCWTELCNLWMMMIWPLCRLWSMANNFFEVNEEGLVGGAGNDGAGKGVGAEAGNCGRCGVEADCAEESGKVDEEGEKVSGAAEVGGASDLLPLAFLGPLNVIVGSSRFQQFFFIYAKLMVGLRLSKDLESDVTLLALHKAVIKCDVRSVGGRNQVGVRKNTPSLSKCGHVLPEDLQRLTINIKLKSPPWDAESSS

SEQ ID NO: 131961 - protein, 50 aa, Glycine max
  Coding DNA Sequence Number=SeqID_40276
  Homolog annotation: Hit_ID=A7PII8; Match level="QueryCoverage=98%, HitCoverage=12%, E-value=3e-11, Identity=69%"; Hit description =Chromosome chr13 scaffold_17, whole genome shotgun sequence
MDIDYAIRKEEPSAITDESSPVVVALCERMERSNKLSVMFIKTKISTGIC

SEQ ID NO: 131962 - protein, 102 aa, Glycine max
  Coding DNA Sequence Number=SeqID_40277
MMVARVMLGHDYEPGMGLGENNGGRAGLAINLHRLNVRKNISERKNKGQGSRSGQHAKEVPPCHISRSFVSAGLRREGQVAAICDEDSPRRSNLVQPCPPGF

SEQ ID NO: 131963 - protein, 244 aa, Glycine max
  Coding DNA Sequence Number=SeqID_40278
  Gene Ontology: Mol. function=protein binding; Biological process=DNA recombination
  Homolog annotation: Hit_ID=P32053; Match level="QueryCoverage=94%, HitCoverage=55%, E-value=1e-125, Identity=97%"; Hit description =Prophage CP4-57 integrase
METPMARKTKPLTDTEIKAAKPKDADYQLYDGDGLTLLIKSSGSKLWQFRYYRPLTKQRTKQSFGAYPAVSLSDARKLRAKSRVLLAKDIDPQEHQKEQVRNSQEAKTNTFLLVAERWWNVKKTSVTEDYADDIWRSLERDVFPAIGDISVTEIKAHTLVKAVQPVQARGALETVRRLCQRINEVMIYAQNTGLIDAVPSVNIGKAFEKPQKKNMPSIRPDQLPQLMQTMRTATSHHYPPCRSR

SEQ ID NO: 131964 - protein, 60 aa, Glycine max
  Coding DNA Sequence Number=SeqID_40279
MDKAVPADDNSPKISSVCKGHILKVLEWELEWKFERKHHCRCEQWTSIGKIKPNVEFTTV

SEQ ID NO: 131965 - protein, 169 aa, Glycine max
  Coding DNA Sequence Number=SeqID_40280
  Gene Ontology: Mol. function=motor activity; Cellular component=cell projection
  Homolog annotation: Hit_ID=UPI00016621D1; Match level="QueryCoverage =96%, HitCoverage=40%, E-value=6e-16, Identity=33%"; Hit description =UPI00016621D1 related cluster
GLHALAFRGLHALSFRGLHVLAFGGLHILAFRGLHVLAFRGLNVLAFGGLHVLAFRGLHALVFKGLHILTFRGLHVLTFEGLHVLDFRGLHLLALRGLHVLTFRGLHALVFTGLHALAFRGLHTLTFRGLHALTFKGLDVLTFRGLHILAFRGLHVLAFRGLHTLTFRG

SEQ ID NO: 131966 - protein, 60 aa, Glycine max
  Coding DNA Sequence Number=SeqID_40281
HPSQENQEQVKSSRIKKNSRLKKKAYNQESRFKIQDLKNQDQDSRFKTQNSRMKTRLNQD

SEQ ID NO: 131967 - protein, 191 aa, Glycine max
  Coding DNA Sequence Number=SeqID_40282
  Homolog annotation: Hit_ID=Q5CDC4; Match level="QueryCoverage=21%, HitCoverage=32%, E-value=1e-15, Identity=100%"; Hit description =LacOPZ-alpha peptide from pUC9
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSILSVSIKDHVAPLQAKEVDILQQKCNRFEMKNHNFREDQAYRYRRPRGGARYQLLFPLVRVNFELGVIMVIAVSCVKLLSAHNSTQHTSRKHKV

SEQ ID NO: 131968 - protein, 124 aa, Glycine max
  Coding DNA Sequence Number=SeqID_40283
MGEVEEVQKQMKADMEAMKKQMATMMEAMMSMKKIMEANAVAVSATSVVAKVNPMPPFGLNQMNHPTSAMVGKDLGSTSGPYYLQIQNKYAFPPYGLPPNYTPPNMAYTPSEDVNNSTPILIER

SEQ ID NO: 131969 - protein, 119 aa, Glycine max
  Coding DNA Sequence Number=SeqID_40284
MGETHEIPHHNLADFEPWLGYTTEGQAVGGIPYKTLWRALSITHNCTSCIPQRLKTLMTMAGMGKLDHLEERLKAIEGGEDYAFAHLKELFLEPNIITPPKFKVLDLDKYEGTTCPRTI

SEQ ID NO: 131970 - protein, 86 aa, Glycine max
  Coding DNA Sequence Number=SeqID_40285
MGIAPTKTPSGPEEVQKGPGVSSSGYGPLSALQGARSPPASSCRRGIGIVPARHLVDPKKANRVLELPALNTGRSRAKHHISIGMA

SEQ ID NO: 131971 - protein, 261 aa, Glycine max
  Coding DNA Sequence Number=SeqID_40286
  Gene Ontology: Mol. function=nucleic acid binding
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.19e-01
GTSYVPINVSFSPKVGPGLPAVPPVQLLTGWCVTAKAPPDISAGKCSGRVPFAIQAAQLLGRAIGAGLFAITPAGERGMCCKAIKLGGEFVTDKDGSLSYSGGDAYAIDIDQQTSLSDFKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131972 - protein, 96 aa, Glycine max
  Coding DNA Sequence Number=SeqID_40287
MTADMVALKDQTASMMEAMLSMERIMESNAAAVVAASAATEADPTHPSAINQSHQPVPDMVGQGGEVLGSASGPHMGVRNPNLWEVPVKNLGSMLK

SEQ ID NO: 131973 - protein, 146 aa, Glycine max
  Coding DNA Sequence Number=SeqID_40288
  Homolog annotation: Hit_ID=A0ST23; Match level="QueryCoverage=18%, HitCoverage=55%, E-value=2e-08, Identity=100%"; Hit description =Putative reverse transcriptase
  Pfam annotation: Domain name=Ins_element1; Domain location=8-87; Score=-19.3; E_value=0.0099; Accession=PF03811.4; Description =Insertion element protein
VLQWLLFLSAVPPCSATDGVVRNGKSTAGHQRWQAAQLLGRAIGAGLFAITPAGERGMCCKAIKLGNARVFPVTTLNSLGVGLRGGRARYRGLSVKLIDTVDLEGGPVGKPVVPAALMNRPTRGERRFAYWALAECILAYYVGTDE

SEQ ID NO: 131974 - protein, 32 aa, Glycine max
  Coding DNA Sequence Number=SeqID_40289
ITVSFSPKVDPGLPGTNRDTRIYLFGEVIFRH

SEQ ID NO: 131975 - protein, 92 aa, Glycine max
  Coding DNA Sequence Number=SeqID_40290
MADSTDDSSTIEETELNSKFEEVSKAFNEMHEEVQRLVVSNRKLRSNLKLHITKLASTQSELDKLGQENEKLVSSYKATGCVCASTSLNMDD

SEQ ID NO: 131976 - protein, 98 aa, Glycine max
  Coding DNA Sequence Number=SeqID_40291
  Pfam annotation: Domain name=Ins_element1; Domain location=1-94; Score=-22.3; E_value=0.02; Accession=PF03811.4; Description =Insertion element protein
MASVSISCPSCSATERGGVIRQFAQSYTPEHQRGKWRVPFHSGTVVQLLKNRQRGIECGPFAITPAGERGMCCKAIKLGNARVFPVNVVEKNDGPAEL

SEQ ID NO: 131977 - protein, 43 aa, Glycine max
  Coding DNA Sequence Number=SeqID_40292
MALGVRLLESTQGCLAAAFSACPELGRDDDLLVVTLASICVRS

SEQ ID NO: 131978 - protein, 69 aa, Glycine max
  Coding DNA Sequence Number=SeqID_40293
MGDQEETQEQMKADMSALKEQMASMMEAMLGMRQLVEKNVATAAAVSLAAEANPTLLATAHHPPPNAVG

SEQ ID NO: 131979 - protein, 115 aa, Glycine max
  Coding DNA Sequence Number=SeqID_40294
MVIEGFHQQTLLPRGENTETFSSLTSYPELCRSEFLIGGYVGARALLLSTTPPFAVMTQELVTRGGTLRLSAPRHSVTPSVVDEQRPMWSSAPFLEMSASSGREFFKSHKLSRTT

SEQ ID NO: 131980 - protein, 55 aa, Glycine max
  Coding DNA Sequence Number=SeqID_40295
MCRRQRWWRCACCPLSAIPRLMWCLALHLPEGAVLLDESSVNGGLMTLLGATGTS

SEQ ID NO: 131981 - protein, 222 aa, Glycine max
  Coding DNA Sequence Number=SeqID_40296
  Homolog annotation: Hit_ID=Q6UUU1; Match level="QueryCoverage=31%, HitCoverage=46%, E-value=1e-18, Identity=71%"; Hit description =Putative uncharacterized protein
  Subcellular localization annotation: CTP_CleavageSite=23; ConfidenceScore=5.00e-01
GLQWLLFLSAVPPVQLLTGWCVTAKSTAGHQRWASVAAAQLLGRAIGAGLFAITPAGERGMCCKAIKLGNARVFPVTTLNSIIIAAWARERPDLPVEVMELLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 131982 - protein, 153 aa, Glycine max
  Coding DNA Sequence Number=SeqID_40297
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=O98568; Match level="QueryCoverage=73%, HitCoverage=24%, E-value=1e-51, Identity=92%"; Hit description=ATP synthase subunit beta
  Pfam annotation: Domain name=ATP-synt_DE; Domain location=105-152; Score=63.3; E_value=8e-16; Accession=PF00401.11; Description=ATP synthase, DeltaEpsilon chain, long alpha-helix domain
  Pfam annotation: Domain name=ATP-synt_ab_C; Domain location=12-128; Score=155.8; E_value=1.2e-43; Accession=PF00306.18; Description=ATP synthase alphabeta chain, C terminal domain
  Pfam module annotation: Pfam domain module=ATP-synt_DE::ATP-synt_ab _C; Domain location=105-152::12-128
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLGSDIDPQEAQQTLEIAEANLNKAEGKRQTIEANLALRRARTRVEAINVIS

SEQ ID NO: 131983 - protein, 142 aa, Glycine max
  Coding DNA Sequence Number=SeqID_40298
NTETFSSLTRYPELRRSEFLIGGYVGARASLLSTTPPFVAMTQELEPAEIPYETNVVICALSGGHVSRDTTFPHGDLFKSPEWGIQNYVGGGPDGKQRPSLGHSCTLVSSRGGGPDDTRRYLTVIRTLLSSRGGGPDDKQRP

SEQ ID NO: 131984 - protein, 128 aa, Glycine max
  Coding DNA Sequence Number=SeqID_40299
  Homolog annotation: Hit_ID=Q84VI1; Match level="QueryCoverage=96%, HitCoverage=25%, E-value=8e-56, Identity=67%"; Hit description =Envelope-like protein
CWKCSDAPLDNISFHSIGNVEKWKYVYQRRLAVERELGRDALDCKETMDLIKAAGLLKTVTKLGDCYEGLILTVSEHQIAKEITAKQVQHWPKKGKLSAGKLSVKYAILHRIGAANWVPTNHTSTVAT

SEQ ID NO: 131985 - protein, 118 aa, Glycine max
  Coding DNA Sequence Number=SeqID_40300
AAGVPPPHQAGPAGLFDTEQYLRHLVRQQAANHRAHVQTHGCLYQMSLSLQSQGFTSFPCPTPDQFRAEVAWPGDWPEAQAGEAPAGAPAEAPDEAEEAREDEDMTDLLDFLGGSGAT

SEQ ID NO: 131986 - protein, 137 aa, Glycine max
  Coding DNA Sequence Number=SeqID_40301
MAPRKLASKRSKKDKAAEGTSSAPKYDSHRFRSAEHQQCFEAIKGWSFLRERRVQLKDDEYADFQEEIVRRQWASLVTPMAKFDPDIVLEFFANAWPTEEGVGDMRSWVRGQWIPFDADAINQFLGYPLVLEEGQEC

SEQ ID NO: 131987 - protein, 42 aa, Glycine max
  Coding DNA Sequence Number=SeqID_40302
RISQQRILALYYKGVPFTNRKRVSEKIPDYKAMGMSPPPLGT

SEQ ID NO: 131988 - protein, 100 aa, Glycine max
  Coding DNA Sequence Number=SeqID_40303
  Subcellular localization annotation: CTP_CleavageSite=54; ConfidenceScore=5.51e-01
MTTPPSSPPPPPTTDATSHSLFTLKRTRKSTHLRSLTTRPIGAERPLVHVDPVTGKADGTHKKKFRTYLGIIARDKVDVTYENWKQVPAAQKDLIWEDIQ

SEQ ID NO: 131989 - protein, 288 aa, Glycine max
  Coding DNA Sequence Number=SeqID_40304
  Homolog annotation: Hit_ID=Q6UUU1; Match level="QueryCoverage=20%, HitCoverage=40%, E-value=4e-18, Identity=78%"; Hit description =Putative uncharacterized protein
  Subcellular localization annotation: CTP_CleavageSite=46; ConfidenceScore=5.18e-01
MVKVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMSALFWVVQTRAHRKPRFSKNITYELGAPVITNQVDVYCEYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131990 - protein, 57 aa, Glycine max
  Coding DNA Sequence Number=SeqID_40305
CFDENKDDDQKPKRMTSRLSQEQFKNQVSSFKNQESRIKNNQDQDSRIKKRLNQDKC

SEQ ID NO: 131991 - protein, 144 aa, Glycine max
  Coding DNA Sequence Number=SeqID_40306
  Homolog annotation: Hit_ID=A0ST23; Match level="QueryCoverage=18%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLVSVGTLHSIKLIDTVDLEGGPVGKPVVPAALMNRPTRGERRFAYWALAECILAYYVGTDEGVSEVLHVAGEKRLH

SEQ ID NO: 131992 - protein, 251 aa, Glycine max
  Coding DNA Sequence Number=SeqID_40307
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFNSCHCSEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131993 - protein, 31 aa, Glycine max
  Coding DNA Sequence Number=SeqID_40308
QSEEKLEESQGTARDAAIDVGIHMSPLRGMG

SEQ ID NO: 131994 - protein, 78 aa, Glycine max
  Coding DNA Sequence Number=SeqID_40309
MTEARQKGVQKQNRGGACQPARPGEQGCFLQKQPPSGGRNWKAQLSKKLRKLTHYAKTPLFDLCHIPEFHGSRKPASL

SEQ ID NO: 131995 - protein, 114 aa, Glycine max
  Coding DNA Sequence Number=SeqID_40310
MAIVQHLVIDNKKRRPIICRTKPDLNKTFKEAAKSIEVAQVSIANKKNTDASIKNLEVQVGQLAKELSKHGSGSFSATTQDNIGKKNKEGSEEENNKNDEVVTSEKVEEKDPPI

SEQ ID NO: 131996 - protein, 240 aa, Glycine max
  Coding DNA Sequence Number=SeqID_40311
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPEFDEREREREKTSEGESERARARERENERGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 131997 - protein, 119 aa, Glycine max
  Coding DNA Sequence Number=SeqID_40312
MVALTLVKVPQPPFFQRYNSNTTCAYHGGVSGNSIEHCMTLKHKVQNLIDAVTCAPELISKSVQLDSAHSIRLVMTKDNNGYLRALHWGNERHCRNLPFGGRATRGLRDASSMGGKCAE

SEQ ID NO: 131998 - protein, 179 aa, Glycine max
  Coding DNA Sequence Number=SeqID_40313
MTLLLSNILPNDRNANLPLQKYQLVCVVSTWGLHPQRHPVDLKKSNRALGFPALVTGLYRPYRAPVPPASSCHHDIGIAPARHLVDPKEGQQGLGVASSKYGSLSVQGSACCPQQGHQAPYQSSFHLEVLRPQEGAGRDTTAALGWTVAGNRRTAITTKVHLSSSIKRLERCLRHMADP

SEQ ID NO: 131999 - protein, 321 aa, Glycine max
  Coding DNA Sequence Number=SeqID_40314
  Homolog annotation: Hit_ID=Q6Z8F0; Match level="QueryCoverage=22%, HitCoverage=67%, E-value=3e-21, Identity=74%"; Hit description =Putative uncharacterized protein P0459B01.18
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRGRRWVPELTGSHVIGSRAWLIHHFITAKVGHEPRFQPTTRRVLAGGQHTPRAATLLHVCVGETMCDTQAGVPVGLMASGATCVQRLDGSRDSAIHTKYRISLRSSSMQEPRYPLPRVIVCKCCVVTTPAGHRLRAPGSRT

SEQ ID NO: 132000 - protein, 116 aa, Glycine max
  Coding DNA Sequence Number=SeqID_40315
  Pfam annotation: Domain name=zf-CCHC; Domain location=51-68; Score =26.8; E_value=8.2e-05; Accession=PF00098.14; Description=Zinc knuckle
MQEENEEDESKDEEDFSLFVKKFQKFIKKRRIERRKNFNNGRRSQEDSQVLRCNKCNQLGHIKANCPSNEEWPKKSDKKRQARRGSRVRLPKEENARSHHQRLFVENVRKTKGNWS

SEQ ID NO: 132001 - protein, 56 aa, Glycine max
  Coding DNA Sequence Number=SeqID_40316
MPFCGRAKARLTGALSKGGKMRGVATNVYLWKTSEKPKETGDHFKALDLKNDPFTR

SEQ ID NO: 132002 - protein, 114 aa, Glycine max
  Coding DNA Sequence Number=SeqID_40317
MASGNRLPMGCNRLHRVSRALVTDYQLGVIDYTVLPATVEPVQVIEVSSSEEDPEEDPEELPPEPVVDALDLLEDDEDPLLDVDFPEDIRSASEADSIEESGPGGTANSDDSSL

SEQ ID NO: 132003 - protein, 141 aa, Glycine max
  Coding DNA Sequence Number=SeqID_40318
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=67%"; Hit description=LacZ protein
EHKRHLQKASLQSLDSNSCSPGDPLVLERPPPRWSSNSPYSESYYNSLAVVLQRRDWENPGVTQLNRLAAHPPFASWRNSEEARTDRPSQQLRSLNGEWDAPCSGALSAGGCGGYAQRGPLHLPALMSGGAFAVTHHPVSS

SEQ ID NO: 132004 - protein, 269 aa, Glycine max
  Coding DNA Sequence Number=SeqID_40319
  Gene Ontology: Mol. function=helicase activity; Biological process =viral genome replication
  Homolog annotation: Hit_ID=Q2R1R7; Match level="QueryCoverage=76%, HitCoverage=13%, E-value=3e-35, Identity=38%"; Hit description=AT hook motif-containing protein, putative
IPHIGDPVWKCKHCNAIMWYDERINKDKHPKNPRFALCCGDGKIQLPLLEDPPQPLRQLLFDNKSTQAKNFQLNIHSYNLMFAYTSPGAKVDTSYNTGRGPPKFCNHGQGHHLIGSLLPMANNSPKFAHLYIYDTGSEDILDEDIIIETKNMLDKHNQYALKFRMARDKLQSSAVCDLKLKLISDRQLDGRLYNLPNTAEVAALIIGDEHTVDGYTMIESEKLNYVREHQQELRVYKYMNLNAYNNDPETHGNEKEKRIILSSSFVGSH

SEQ ID NO: 132005 - protein, 177 aa, Glycine max
  Coding DNA Sequence Number=SeqID_40320
  Homolog annotation: Hit_ID=A5BTM1; Match level="QueryCoverage=64%, HitCoverage=4%, E-value=7e-12, Identity=35%"; Hit description =Putative uncharacterized protein
MTRGNPYDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKIGLIHLLPKFHGLAGEDPHKHLKEFHIVCSTMKPPDVQEDHIFLKAFPHSLEGVAKDWLYYLAP

SEQ ID NO: 132006 - protein, 86 aa, Glycine max
  Coding DNA Sequence Number=SeqID_40321
MMTKVMNKKLKRIKEHPSQENLEQVKEFKNQEEFKTREESLQTRIKIQVLKNQDQDSRLKRFKISRIIKIKIQDSRFKNEEKTQSR

SEQ ID NO: 132007 - protein, 76 aa, Glycine max
  Coding DNA Sequence Number=SeqID_40322
MTAPMYYLRGGGDSLEEQTTQGSFVPYGRDDILNTAIVKPEHPSRVRAAGSGMTLTQFYGRATRTSSSSSATLMQQ

SEQ ID NO: 132008 - protein, 255 aa, Glycine max
  Coding DNA Sequence Number=SeqID_40323
MGDPISRLSFPENTETLSSLTSYPELRRSEFLIGGYVGARASLLSTTAPFVAMTQELVARGDTLRLSAPFCHPEAAGPMTSRDQVWLFCTLVSSRGGGPDDTRRYLMVIRTLLSSRGGGPDDKQRPKTKFGHSAPLYHPEATGPMIRGDTLRLFAPFCHPEAAGPMTSRDQVWSFCTLVSSRGGGPDDTRRYLTVIRTLCHPEAEGPMTSRDQVWSFCTLVSSRGGGPDDTRRYLTVIRTLLSSRGGGPDDKQRT

SEQ ID NO: 132009 - protein, 105 aa, Glycine max
  Coding DNA Sequence Number=SeqID_40324
MWCYEWKKSEALRVGRTYEKAWTVLERKTNDQSEPRAISREKLGVEESNFDSLGRIDGDPVLRETRIWATWEYVSSVGGGQQGMVGLCALCGCGKLVVHHRPTAT

SEQ ID NO: 132010 - protein, 160 aa, Glycine max
  Coding DNA Sequence Number=SeqID_40325
MWAFLTGCQIDWAHLVRYRMLKALRANAPLPYPQLITLFLRHFQIPFDDEPFVQVKRSFAIGAGAVTSFGYRKDRNVQWLKKDALPPQDERTPSPPSQREDSTLMNEVLTELRGLRSYVGERFDSLDTRFAVMDIRLTQLEEDVGYIRQSFDLPPPPPPS

SEQ ID NO: 132011 - protein, 144 aa, Glycine max
  Coding DNA Sequence Number=SeqID_40326
  Gene Ontology: Biological process=transposition, DNA-mediated
  Homolog annotation: Hit_ID=Q1J7G7; Match level="QueryCoverage=31%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLDVNIKLIDTVDLEGGPGGLRIGALAECILAYYVGTDEGVSEVLHVAGEKRLH

SEQ ID NO: 132012 - protein, 198 aa, Glycine max
  Coding DNA Sequence Number=SeqID_40327
  Gene Ontology: Mol. function=phosphoinositide phospholipase C activity; Biological process=intracellular signaling cascade
  Homolog annotation: Hit_ID=Q2HTA0; Match level="QueryCoverage=91%, HitCoverage=29%, E-value=1e-27, Identity=36%"; Hit description=IMP dehydrogenase/GMP reductase, related
  Pfam annotation: Domain name=DUF1723; Domain location=11-60; Score =44.0; E_value=5.1e-10; Accession=PF08330.1; Description=Protein of unknown function (DUF1723)
LSSLIACSVNTGDRGLLSAFVEWWHRETSSFHLPVGDLTITLDDISSLLHLLVIGDLYAFQPLHVDDAVQMLVDLLVVSPESARAETVQCREPYVRLQWVHDIYQRRCQAGHWTAAACAYLRHLLGCTLFANKSATNVHVVYLEALRDLSMTERYAWGVAPLVHMYDQLNDVSMSHSRQLGGYITLLQLTNMFFIHSG

SEQ ID NO: 132013 - protein, 42 aa, Glycine max
  Coding DNA Sequence Number=SeqID_40328
MSAEKYQFFGALPLTDVGNVRSASSGDASFLTSIVDLTSSTS

SEQ ID NO: 132014 - protein, 77 aa, Glycine max; identical to SEQ ID NO: 124966
  Coding DNA Sequence Number=SeqID_40329

SEQ ID NO: 132015 - protein, 160 aa, Glycine max
  Coding DNA Sequence Number=SeqID_40330
MPPTRHPLDPDKSNRALGFPTLITSFCQSFGVPVTPSKAQGDAPQAADAPPLPHQADPAESFGMERYLQHLVRQQAANHRGQVQIRECLYQLSLSQQSQGFAPFACPTPDQFRAEVAWPRDWPEAQAGEALAEAPGDAEEARMDEEMTYLHGFLGGSGAT

SEQ ID NO: 132016 - protein, 69 aa, Glycine max
  Coding DNA Sequence Number=SeqID_40331
MAQPPPRERTLREMVAPDFTYESLCIQYPDEDVPYVLKTGLIHLLPKCLAPIIRQFVKFWDMPENKRKY

SEQ ID NO: 132017 - protein, 204 aa, Glycine max
  Coding DNA Sequence Number=SeqID_40332
MRLQLPATSVVAKVNPMPPSGLNQMNHPTSAMVGKDLGSIGDPYYVQIQNKYAFPPYGLPPNYTPPNVAYTLGEDVNNSAPILIESRQPHHAHVSQPMGDTHEMPYHNLADFEPCLGYATEGQAVGGIPLQNTLEGPQYHPQPHPSHSTTVKSPHAMAEMGKLDHPEERLRAIEGGEDYAFVNLEELFLVPNFITPPKFKGAGL

SEQ ID NO: 132018 - protein, 60 aa, Glycine max
  Coding DNA Sequence Number=SeqID_40333
MRGVATNVYLRKTSEKPEKTWSTNFKCERFRSCIYARGSRRGCFPCSYVFLNCDKEIRST

SEQ ID NO: 132019 - protein, 154 aa, Glycine max
  Coding DNA Sequence Number=SeqID_40334
AGTGERTREPPGGNAGIFIVLSGFATTDLSVRFRDACQGGGAYGKTALPRPSHFPVKYLPGIFQEISAPFVSHSARSPTPSVASVSEEAHGIEFLRTDQPFPEQLEMAKAVSATQLRCGELAHSLGTPGFTLAALMSGRYAFADYADNQFPVSS

SEQ ID NO: 132020 - protein, 136 aa, Glycine max
  Coding DNA Sequence Number=SeqID_40335
MAPRKLSAKRSRKDAAAEGTSAAPEFDSHRFRSAEHQQRFEAIKGCQFLGDLLVLEEGQECEYSQRRNRADGFDEEAIAQLLCIPGQDFARTATGRRVQIMGTNMTTLTQTWMTLLLSNILPNDHNSKLPLSKCQQ

SEQ ID NO: 132021 - protein, 135 aa, Glycine max
  Coding DNA Sequence Number=SeqID_40336
MSGFTRDSPQISASPYQLDLAPYASEPYNAQWNAPGLLRDKHTLRSSRILGKMEVDEPWLGLWLPLNYQVDMGARMAFVDNWAVGKEKVCYWLSNDIVGLVGNLAVLEWQSQHGLLLHPHPLHLPQFSHSSKQDD

SEQ ID NO: 132022 - protein, 62 aa, Glycine max
  Coding DNA Sequence Number=SeqID_40337
MGLRIRVEGGGEANSTSNQLAALQPRWISEQHWAINSQSSILDGGGHMNSARQSIHGSRNKS

SEQ ID NO: 132023 - protein, 15 aa, Glycine max
  Coding DNA Sequence Number=SeqID_40338
LWSSLVQQEESKDDA

SEQ ID NO: 132024 - protein, 78 aa, Glycine max
  Coding DNA Sequence Number=SeqID_40339
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=28%, E-value=8e-10, Identity=96%"; Hit description=LacZ protein
HPPFASWRNSEEARTDSPSQQLRSLNGEWDAPCSGALSAAGVVVTRSRVTATLARTDVRRRFCRYSPPRYVAEQLTDS

SEQ ID NO: 132025 - protein, 292 aa, Glycine max
  Coding DNA Sequence Number=SeqID_40340
  Gene Ontology: Mol. function=protein histidine kinase activity; Cellular component=integral to membrane; Biological process=two -component signal transduction system (phosphorelay)
  Homolog annotation: Hit_ID=A4WD48; Match level="QueryCoverage=100%, HitCoverage=61%, E-value=2e-80, Identity=76%"; Hit description =Integral membrane sensor signal transduction histidine kinase precursor
  Pfam annotation: Domain name=HATPase_c; Domain location=193-286; Score=84.6; E_value=3.1e-22; Accession=PF02518.17; Description =Histidine kinase-, DNA gyrase B-, and HSP90-like ATPase
  Pfam annotation: Domain name=HisKA_3; Domain location=88-156; Score =58.4; E_value=2.4e-14; Accession=PF07730.4; Description=Histidine kinase
  Pfam module annotation: Pfam domain module=HATPase_c::HisKA_3; Domain location=193-286::88-156
MSGELATLYRSLEASVAEKTRHLHDAHQQLDMLFKCSQALNTGQIDSHCFRHILQIVHDYTQMNYLELRTSDDWRLCAEALPAAAADGRARTIARELHDSLAQVLSYLRIQLTLLKRAVPEENTPAQTIITDFSRELNNAWQQLRELLTTFRLTLNHANLPAALQESLDALQSQTQAKLHLDCRLSSLALDAQKQVHLLQIVREAVLNAIKHAQASEITVSCVTAVDGTHRVSIRDNGIGIGEASEPPGHYGLNIMRERAQRLGGALHFSQPQNGGTLVSVTFPVPQAPAGK

SEQ ID NO: 132026 - protein, 209 aa, Glycine max
  Coding DNA Sequence Number=SeqID_40341
MASRKCKSIGARPTAQYDTRRFHSLDAWNRYTDNVLGRNIFPERKVEIYHTEFDNFRQSGEAFEGPSPKKAKVRGHLVKINADSLNTFLETLVVLEKGDSLPTYSRYCRLPTDYREIEVAQERFDYISHPGRILRRDLTTLAQAWSILSYSNLVSTSHTSDLIVDRARLIFGLVSCMDINIGALISGQMTSIAQSNSSRLGFPALITVL

SEQ ID NO: 132027 - protein, 52 aa, Glycine max
  Coding DNA Sequence Number=SeqID_40342
MASLWCGVSSLSSFSILLPFIFQEAKESIDEEDPRPKAPMELTSCGIKSIFI

SEQ ID NO: 132028 - protein, 152 aa, Glycine max
  Coding DNA Sequence Number=SeqID_40343
  Gene Ontology: Mol. function=oxidoreductase activity; Biological process=electron transport
MKTTFLAVDAFLDEVIAEHESSNKKNDDFLGILLQLQECGRLDFQLDRDNLKAILVVSLFIYPIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 132029 - protein, 19 aa, Glycine max
  Coding DNA Sequence Number=SeqID_40344
GINGRYYWKDSSLDNRYCN

SEQ ID NO: 132030 - protein, 181 aa, Glycine max
  Coding DNA Sequence Number=SeqID_40345
MVRTRGLGRVLGAGRGKGISEDTHEADVPLRRRPTVSARRQRVRLREDVTERPEDVPQLHEDVPHVSDATPEMTSAADAVQTEGMATDGSLGSPAADEGFPGGPRDPSILTDFAEHERPDLKLVSRGRKVDKIGRPAPEIEGLVAGTGLSPLIRCSVITTDLGLISVFVESGIARLARSTC

SEQ ID NO: 132031 - protein, 102 aa, Glycine max
  Coding DNA Sequence Number=SeqID_40346
MAEAVTQFMSRQQKSFVEAAAQEKSPLKEHEEQAQQQWEKYSTVKNQQENILQSDNLPHQLIDKKGRQAEHEETLNYMKFMEFLAKRRNFKEDVFFVTFMPP

SEQ ID NO: 132032 - protein, 405 aa, Glycine max
  Coding DNA Sequence Number=SeqID_40347
  Gene Ontology: Mol. function=phosphoribosylformylglycinamidine synthase activity; Cellular component=cytoplasm; Biological process =purine nucleotide biosynthetic process
  Homolog annotation: Hit_ID=Q6F994; Match level="QueryCoverage=99%, HitCoverage=31%, E-value=0.0, Identity=91%"; Hit description =Phosphoribosylformylglycinamidine synthase
  Pfam annotation: Domain name=AIRS; Domain location=1-152; Score=85.8; E_value=1.4e-22; Accession=PF00586.15; Description=AIR synthase related protein, N-terminal domain
  Pfam annotation: Domain name=AIRS_C; Domain location=162-322; Score =151.3; E_value=2.6e-42; Accession=PF02769.13; Description=AIR synthase related protein, C-terminal domain
  Pfam module annotation: Pfam domain module=AIRS::AIRS_C; Domain location=1-152::162-322
MRFYPKADENGHFVYKYKSQAAHILMKVETHNHPTAISPFAGAATGSGGEIRDEGATGRGGKPKAGLTGFTVSNLNIPGFEQPWEENYGKPSRMASPLQIMIEGPLGGAAFNNEFGRPALNGYFRTFEQNVNGEVKGFHKPIMIAGGYGNIRPDHVEKDAIQPGDLLIVLGGPAMLIGLGGGAASSVDSGTMGESLDFASVQRENPEMERRCQEVIDTCWRLEDFNPIVSVHDVGAGGLSNAMPELVNDHELGAVLNLRKIPSLEPGMSPMEIWSNEAQERYVLAIRPESLDQFEAICARERCPFAVLGEATEARHLTVEDPLFQNDAVDIPMQVMLGGTPRMQRSYETIERSGDDFDASKVDLKDAIFRVLKNPTVASKSFLITIGDRSITGMVARDQMVGRWQ

SEQ ID NO: 132033 - protein, 171 aa, Glycine max
  Coding DNA Sequence Number=SeqID_40348
  Homolog annotation: Hit_ID=Q6UUU1; Match level="QueryCoverage=35%, HitCoverage=40%, E-value=1e-18, Identity=78%"; Hit description =Putative uncharacterized protein
  Subcellular localization annotation: CTP_CleavageSite=32; ConfidenceScore=5.56e-01
MQVGSATSIIRVIKHSGNSSSCKSTSLLQDVKTSLVTSAFCFCFCSFSAVFQDVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132034 - protein, 30 aa, Glycine max
  Coding DNA Sequence Number=SeqID_40349
MRVFVGKGYATDGMFKLNLDINKVSPSAYM

SEQ ID NO: 132035 - protein, 175 aa, Glycine max
  Coding DNA Sequence Number=SeqID_40350
MGEAEKLPLLSAVAKVNPMLPSGLKQMNRPTSNMVGKDLGSTDDPMMCKFKTSTPSHHMACLPTIHHPMWHTLSMKISITPLRYSLRTNNLIRHISLKTMGKTHEIPHHNLADFEPWLGYATEGQAVGGIPFENPLEGPQYHPQLHLLHSTADKNPHDYGRNGKVGSSKGKAQGH

SEQ ID NO: 132036 - protein, 219 aa, Glycine max
  Coding DNA Sequence Number=SeqID_40351
MSCEWPRGSLPQRGPGRTRRPKELVPAPEYDSPRFRSAVHQQRFEAIKGWSFLRERRVQLRDDEYTDFQEEIGRRRWASLVTPMAKFDPEIVLEFYANAWPTEEGVRDMRSWVRGQWIPFDADAIGQLLGYPLVLEEGQECMAPTRHPLDPDKSNRALGFPALITGLCQSFGVPVAPTKVIRPPITQAFIEKYCTQRQAQGDAPQARRRTTTTSSGWPG

SEQ ID NO: 132037 - protein, 105 aa, Glycine max
  Coding DNA Sequence Number=SeqID_40352
MLAIINKYQEELNLATAHEHKVADEYAQLYAEKEARGRVIDSLHQEATMWMDRFALTLNGSQELPRLQAKAKAMADTYCTPEEIHGLLSYCQHMIDLMTHIIRNR

SEQ ID NO: 132038 - protein, 340 aa, Glycine max
  Coding DNA Sequence Number=SeqID_40353
  Subcellular localization annotation: CTP_CleavageSite=39; ConfidenceScore=5.60e-01
MFSLAGTYQLSQLCRGCSSATSAKRLHLSLSGSVYFVMMASRKRKSICSRPIVQYDTRRFSSLDAWTRYTNNVLGKNILPERKVEIYHTKLDEFKAELERRNFHKRLTNLVDGSIDLALVKEFYANLYSSEDHSPKKSRVRGHLVKIDADSLNTFLETLAVLAKGETLPGHLGKILRKDLTTLAQMWSVLSYSNFAPTSHTFDLTVDRARLIFGLVSRMDMNIGALISGQMTSIAQSNTSRLGFPALIIALCRARGVVSDSLTFEHLSPVINLTYIRMNCLNPKNLTVSIRGVRRARARPAELPSTSTAPTPTSTSAAPSVPAQTDSQRLEAMLQSIHQG

SEQ ID NO: 132039 - protein, 64 aa, Glycine max
  Coding DNA Sequence Number=SeqID_40354
MRLHSYRASRRPNKTTDRPPLLMAHIDPSIGPNISMCVQRIDKGVALAPMYPQVRCEIQTYIVL

SEQ ID NO: 132040 - protein, 116 aa, Glycine max
  Coding DNA Sequence Number=SeqID_40355
  Gene Ontology: Mol. function=transmembrane receptor activity; Cellular component=intrinsic to membrane; Biological process=innate immune response
  Homolog annotation: Hit_ID=A5BEI8; Match level="QueryCoverage=91%, HitCoverage=10%, E-value=2e-27, Identity=62%"; Hit description =Putative uncharacterized protein
  Subcellular localization annotation: CTP_CleavageSite=6; ConfidenceScore=5.22e-01
NGASQSAAHKANNVNFSSGLSAPKLIIDGGATNHITSSPSLLVDSKENTSLPPVVMPNGDQAPIISTGNLPLCPIICLKNVLGVPSCKVDSMSVSQVIRELNCSVTFSLNYVFCEI

SEQ ID NO: 132041 - protein, 206 aa, Glycine max
  Coding DNA Sequence Number=SeqID_40356
WIPFDEDALSQFLGDPLVLEESQQCEFSLRRNRADGFDEEAIAQLLCTPGQNFARTTVGRRVRIMCTSMTTLTQTWMTLLLSNVLPSDHNSDLPLPKCQLVYAILTWMSVHVAQVIADAIYLFAGMAPTRHPLDTDKSNRALGFPALITGLCQSFGVPVTPSKVIRPPITRAFIEKYCTPRQAQGDAHQAADAPPPPRQADPAGSL

SEQ ID NO: 132042 - protein, 120 aa, Glycine max
  Coding DNA Sequence Number=SeqID_40357
MKGIGFGSILGRIDFLLRKSKLCSKGDGPFQVLERIDNNACVANSDDEGSADLRTSPLQEGHDNAILPRRGPITKAMARRLKEDWVRDPGEGPMVLMSLRVDFGPMVMQSSLGRDQSLEP

SEQ ID NO: 132043 - protein, 38 aa, Glycine max
  Coding DNA Sequence Number=SeqID_40358
MTTLRIFPPLESAPVSLAFARPQKGTLRQLATPLGTIF

SEQ ID NO: 132044 - protein, 96 aa, Glycine max
  Coding DNA Sequence Number=SeqID_40359
MSSPSEGYTPSPWVLVTLAIRGLRVLTFRGLHTLAIRGLHVLTFVGLHALTFRGLHALAIRGLHVLTFRGLHALAIRGLHVLTFVGLHALTFGGLH

SEQ ID NO: 132045 - protein, 124 aa, Glycine max
  Coding DNA Sequence Number=SeqID_40360
  Homolog annotation: Hit_ID=Q1J7G7; Match level="QueryCoverage=25%, HitCoverage=58%, E-value=6e-07, Identity=68%"; Hit description =Transposase
WTSYVPINVSFSPKVGPGLPGINRDTRIYLFCEVIFRHRYYSAQSASAVPPVQLLTGWCVTAKAPPDISAGKCSGRVPFAIQAAQLLGRAIGAGLFAITPAGERGMCCKAIKLGNARVFPVTTL

SEQ ID NO: 132046 - protein, 138 aa, Glycine max
  Coding DNA Sequence Number=SeqID_40361
AELERARVVEEKFKSIAIKGSIVSSSSEEVKGIITGQRHDLEGRAKGNMWAIIDKCKEKLNLAATHEQRLEDEYAKISAEREARERVIDSLHQEATMWTDRFALTLNRSQELPPLLAKAKAVADTYSAPEEIHGLLSY

SEQ ID NO: 132047 - protein, 216 aa, Glycine max
  Coding DNA Sequence Number=SeqID_40362
  Homolog annotation: Hit_ID=UPI00006A2D9E; Match level="QueryCoverage =54%, HitCoverage=65%, E-value=2e-07, Identity=16%"; Hit description =UPI00006A2D9E related cluster
VDSRGSHLIRVDPRGLHVLTFRGLHVLAFRGLHVLPYRGLHVLTFRGLHVLALRRLHTLAFRGLQVHEFRGLHVLAIRGQHELAIRGLHAPTFRGLHVLAFRGLHALTFKGLHILAIRGLHALAIRGLHRTTHPRLQRAARPRLQRTTRSRHQRTACPRLQRATRPNLQRATSPRLPRTTRPRLQRATRTHLYRATRPCLQRATRPSLQRTTYPRL

SEQ ID NO: 132048 - protein, 126 aa, Glycine max
  Coding DNA Sequence Number=SeqID_40363
MGKTHEMPHHNLADFEPCLGYATEGQAIGGIPLQNPLEGPQYHPQLHLLHSTTSKNPHAMSEMGKLDHLEERLMAIEGGEDYAFANLEELFLVPNIITPPSSRAYAKDEKLLIHSFQESLTGVAVT

SEQ ID NO: 132049 - protein, 82 aa, Glycine max
  Coding DNA Sequence Number=SeqID_40364
MQTRQLFCTLIGISSSFSLLITVRPVFLGTTWIGLTHWLSEMGVDGLIPGMSAKVHPMASCASWELATTSPLAQHQGRQDDH

SEQ ID NO: 132050 - protein, 158 aa, Glycine max
  Coding DNA Sequence Number=SeqID_40365
  Homolog annotation: Hit_ID=A0ST23; Match level="QueryCoverage=28%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSRRNLNDASPAQRPCDPTSYGTELEFVIMVIAVSFGKPVVPAALMNRPTRGERRFAYWALFRFLAH

SEQ ID NO: 132051 - protein, 123 aa, Glycine max
  Coding DNA Sequence Number=SeqID_40366
  Gene Ontology: Mol. function=DNA binding
  Homolog annotation: Hit_ID=Q5PC45; Match level="QueryCoverage=100%, HitCoverage=37%, E-value=3e-61, Identity=95%"; Hit description =Putative DNA-binding protein
MGLTNYKGEEVHKGDVTVAKNYLTQDEVNELNRVVNMWLDFAEDQARRRQQVFLRDWQDKLDQFLQFNDREVLQGAGKVSKKMADEKAQAEYSQFAEQQRRLKEAEGEKDIAGLLQWKIEPKK

SEQ ID NO: 132052 - protein, 23 aa, Glycine max
  Coding DNA Sequence Number=SeqID_40367
MRSRCPPLLWPWLAIGEVLDSRS

SEQ ID NO: 132053 - protein, 150 aa, Glycine max
  Coding DNA Sequence Number=SeqID_40368
  Homolog annotation: Hit_ID=Q6WAY4; Match level="QueryCoverage=86%, HitCoverage=23%, E-value=2e-11, Identity=33%"; Hit description =Putative uncharacterized protein
MGINQTGKRFYQVKIKGLDITSIKGLGWLMGPLQMQAFRKAYGKILDLTIVEISMEAIVSLTQYYDPPLRCFTFGDFQLVPIVEEFEEILGCPLGGRKPYLFSGFLPSLSKIVVVVRDSARGLDCVKQTRNGVVGLPRKYLDGKARDMAN

SEQ ID NO: 132054 - protein, 20 aa, Glycine max
  Coding DNA Sequence Number=SeqID_40369
MAAKWRRKRDDWRCHFKEKI

SEQ ID NO: 132055 - protein, 77 aa, Glycine max
  Coding DNA Sequence Number=SeqID_40370
MGRRKYPSGYPYKHSFAICFYSRRPEIVNPNETRDFSLLDRDDRVQWRRDVSWLSNFVIFKTLKFVDASAALSFLSE

SEQ ID NO: 132056 - protein, 266 aa, Glycine max
  Coding DNA Sequence Number=SeqID_40371
  Gene Ontology: Mol. function=catalytic activity; Biological process =metabolic process
  Homolog annotation: Hit_ID=A7PQI6; Match level="QueryCoverage=99%, HitCoverage=47%, E-value=5e-92, Identity=64%"; Hit description =Chromosome chr6 scaffold_25, whole genome shotgun sequence
  Pfam annotation: Domain name=PGAM; Domain location=21-203; Score =10.6; E_value=0.00024; Accession=PF00300.13; Description =Phosphoglycerate mutase family
MQTPGSPIAGGKSGGREPSKRIILICNGSTQGNTEDVFPFGGDQPLNMLGVIQSQKSAELLLDLKVNSIISSLNKACIGTATIISQVQEAADCLGADCVPRYVEMKQMGSFDVETIFKQTETAKENYDHLIYQEVQLAKGFSKAISNFPPFQPGWLNRVDDGLRTKLWDQSRKAWQSLLDEISDESNPEVVVAVGHPAIHIALMGHCLNLTKEWLGSFHLDAGSVSLVDFPDGPKGKGVIRCLNYTAHLGRWSIPITRSAEDGEEF

SEQ ID NO: 132057 - protein, 80 aa, Glycine max
  Coding DNA Sequence Number=SeqID_40372
MASSCRGYSKAQMCFFKILRIISSTPPSKQEEEEPFPSKGVGIDLNLRFCSVTETPESESSRSDENNNEEEEGFPEKSVE

SEQ ID NO: 132058 - protein, 232 aa, Glycine max
  Coding DNA Sequence Number=SeqID_40373
  Homolog annotation: Hit_ID=A7PQJ6; Match level="QueryCoverage=78%, HitCoverage=93%, E-value=3e-41, Identity=51%"; Hit description =Chromosome chr6 scaffold_25, whole genome shotgun sequence
MPNSKNNRNGHGEPHRREKLTKKSSSFYGHSSPPSMSGEPIRRPKTVPDLLSERHRAALATPATDVVPKQPPKLLLKVTPMGSLGPVQVVMTPESTVGDLVAVTVRQYVKEGRRPILPSNDPSHFDLHYSQFSLQSLDREEKLMDIGSRNFFLCPRKCGGNGDEGSGTTPFGSCSREADKTNKGGAFGPVPGDVKDCTSSVEVSLFCYIVKKKLQGIEASFTPSYKLRQQLT

SEQ ID NO: 132059 - protein, 285 aa, Glycine max
  Coding DNA Sequence Number=SeqID_40374
  Gene Ontology: Cellular component=integral to membrane; Biological process=peroxisome organization and biogenesis
  Homolog annotation: Hit_ID=A7PQK0; Match level="QueryCoverage=100%, HitCoverage=65%, E-value=1e-103, Identity=64%"; Hit description =Chromosome chr6 scaffold_25, whole genome shotgun sequence
MKLYEFVIIFGCFMLILAQIPSFHSLRHINLVSLVLCLAYSAGATIGSIYIGKLNSQSPFQFFWRVIKRTRKGYSLKGDSMNRLFGIFNVIAIIATTYGNGIIPAIQSLFFSVSVSGYWAFGNESEGLILSNFVDNGKPLVPKWFIYMTNILIITQLSAVGVVYLQPTNEVLEQTFGDPKSPEFSKPNVIPRVISRSLATTISTTIAAMLPFFGDINSLIGAFGFIPLDFILPMVFYNLTFKPSKRSPIFWLNVTIVVAFSALGAIAAVRQIVLDAKNYQLFANI

SEQ ID NO: 132060 - protein, 82 aa, Glycine max
  Coding DNA Sequence Number=SeqID_40375
MGSHLLQSGHVVNIDLCFILKAFELPAFESGSSLFGSVCFKCYSVITKGRKGWQMLHALRVTEVELNFFYDAFYTKALVKNT

SEQ ID NO: 132061 - protein, 82 aa, Glycine max
  Coding DNA Sequence Number=SeqID_40376
MRKRNPNLLGFEALSDVAKFLVDAEPHLFLVLTIADVADEDGETSHSGQRHRRSEPPPRGSGAPPYLSSQAAEGSGNAIRVR

SEQ ID NO: 132062 - protein, 97 aa, Glycine max
  Coding DNA Sequence Number=SeqID_40377
MANNDEGEENDDDMVDDSSSYSGLGDREPGIDLEALSPLSSPLELLPLFGTHWCRVIQGSNIGGWRGEKRDSEGVRNKKKHFPNGYGIGGETKKKRR

SEQ ID NO: 132063 - protein, 301 aa, Glycine max
  Coding DNA Sequence Number=SeqID_40378
  Gene Ontology: Mol. function=binding; Cellular component =mitochondrial inner membrane; Biological process=mRNA modification
  Homolog annotation: Hit_ID=A7PSU3; Match level="QueryCoverage=86%, HitCoverage=85%, E-value=6e-67, Identity=35%"; Hit description =Chromosome chr8 scaffold_29, whole genome shotgun sequence
  Pfam annotation: Domain name=PPR; Domain location=154-188; Score =32.2; E_value=1.9e-06; Accession=PF01535.11; Description=PPR repeat
  Pfam annotation: Domain name=PPR; Domain location=49-82; Score=3.8; E_ value=2.7; Accession=PF01535.11; Description=PPR repeat
  Pfam module annotation: Pfam domain module=PPR::PPR; Domain location =154-188::49-82
  Subcellular localization annotation: CTP_CleavageSite=83; ConfidenceScore=5.20e-01
MFVRSLTAKLKQKTSKTSNLNHVPFLIDILNHSFTNSSLSHVHFPSDISQTNSLIASYVRRGDPVSALTLFHSLRRRAHSDVVADAYTFTSILRASSLLRVSGQFGTQVHAQMLKTGADSGTVAKTALLDMYSKCGSLDEATKVFDEMRHRDVVAWNALLSCFLRCDRPVEAFGVLREMGRENVELSEFTLCSALKSCASLKALELGRQVHGLVVCMGRDLVVLSTALVDFYTSVGCVDDALKVFYSLKGCWKDDMMSRRYDEAFRVMGFVRPNAIALTSALVGCSENLDLWAGKQIHCVA

SEQ ID NO: 132064 - protein, 141 aa, Glycine max
  Coding DNA Sequence Number=SeqID_40379
MDQPFLSLILVFPTHAPPHFTAKGLGFAIASHHRYRGGSRLGRADGDHVSCVPPRLMFSCFGEMAFTVEVNHGGYFTPEPFLKYFGGDITLLSEIDIDKWSFFEFVGILKQDVKIKGDFKLCWEGANAGFKELVLDSHVAE

SEQ ID NO: 132065 - protein, 489 aa, Glycine max
  Coding DNA Sequence Number=SeqID_40380
  Gene Ontology: Mol. function=aspartic-type endopeptidase activity; Cellular component=cellulose and pectin-containing cell wall; Biological process=proteolysis
  Homolog annotation: Hit_ID=A7PQL9; Match level="QueryCoverage=95%, HitCoverage=93%, E-value=0.0, Identity=70%"; Hit description =Chromosome chr6 scaffold_25, whole genome shotgun sequence
  Pfam annotation: Domain name=Asp; Domain location=76-435; Score= -40.5; E_value=3.3e-11; Accession=PF00026.14; Description=Eukaryotic aspartyl protease
MEAVAAAFLFAAVVLSAVVGSPVTLTLERAFPSNDGVELSELRARDSLRHRRMLQSTNYVVDFPVKGTFDPSQVGLYYTKVKLGTPPRELYVQIDTGSDVLWVSCGSCNGCPQTSGLQIQLNYFDPGSSSTSSLISCLDRRCRSGVQTSDASCSGRNNQCTYTFQYGDGSGTSGYYVSDLMHFASIFEGTLTTNSSASVVFGCSILQTGDLTKSERAVDGIFGFGQQGMSVISQLSSQGIAPRVFSHCLKGDNSGGGVLVLGEIVEPNIVYSPLVPSQPHYNLNLQSISVNGQIVRIAPSVFATSNNRGTIVDSGTTLAYLAEEAYNPFVIAIAAVIPQSVRSVLSRGNQCYLITTSSNVDIFPQVSLNFAGGASLVLRPQDYLMQQNFIGEGSVWCIGFQKISGQSITILGDLVLKDKIFVYDLAGQRIGWANYDCSLPVNVSASAGRGRSEFVDAGELSGSSSLRDGPHMLIKTLFLALFMHITLIL

SEQ ID NO: 132066 - protein, 69 aa, Glycine max
  Coding DNA Sequence Number=SeqID_40381
MDEDQWIYDSIMSEKIGMDDENEQECGVNEQHVDCSDAFNTSQVFATRDDILQWARSVAHENRFVEVIM

SEQ ID NO: 132067 - protein, 320 aa, Glycine max
  Coding DNA Sequence Number=SeqID_40382
  Homolog annotation: Hit_ID=Q2HTA0; Match level="QueryCoverage=30%, HitCoverage=18%, E-value=6e-10, Identity=36%"; Hit description=IMP dehydrogenase/GMP reductase, related
  Pfam annotation: Domain name=DUF1723; Domain location=151-200; Score =48.2; E_value=3e-11; Accession=PF08330.1; Description=Protein of unknown function (DUF1723)
MTSHLYAPFFSFVLCFLSRCRHHRLSLSPLRSSHHYRVVPIDEIMVRTKGLGRILDQVIGRALWREDVQHVDHTTNEVQEQPKEVVVDDEVVDVEGFPGGLHDTSVLTERPELKLSSHGRNVQKFGKPVIEIEGLVATTRLSLLIACSLGTSDQGLISTFVEKWHKETCSFHLLVGEVTITLDDVAFLLHLPIIGAFHNFKALHIDEAMLLLVELLEVSADECWIYEHFSFVAKAIAAEDYHERKPCAYHWKSGKALPVSTYRKRLDRVTFDGVCWMPYGDLHTYLTGPSYCHTSTREGCAAVWIFLSTRWQQQLWRKHL

SEQ ID NO: 132068 - protein, 141 aa, Glycine max
  Coding DNA Sequence Number=SeqID_40383
MDEDQWIYNSIMSKEVDMNEQNEDEAAIKSKHVDCSDAFNTFQARVVAYEIDFVAVIMRSGTNTSMRGMTSFILIGCEMSGQYRSRKKDFIRRNTSSRKRGYPFKLREKPVVGDQGWMGKLMCQSHNHEMTNTLVGHPCTD

SEQ ID NO: 132069 - protein, 460 aa, Glycine max
  Coding DNA Sequence Number=SeqID_40384
  Homolog annotation: Hit_ID=Q8RXC2; Match level="QueryCoverage=92%, HitCoverage=37%, E-value=1e-135, Identity=60%"; Hit description =Putative uncharacterized protein At2g27890:At2g27900:At2g27910
MTLTLSIPKKYITLCNHVRGVYCKVKGMNLVRELEKDLRIANVICMNGRRHLTSSMNEVSRDLIVNSYSKKKQALLDMLPTLTELRRALDMPSTLESLVEEGNYWKAFQVLSEYLQILDSLSELSAIQEMSRGVEVWLGRTLQKLDALLLGVCQEFKEDGYITVIDAYALIGDTAGLAEKIQSFFMQEVISETHSVLKAIVHEDEEGLSQNSRLTYSDLCLRIPDSKFRQCLLRTLAVLFDLMCSYHEIMEFQLERKDSAAQTSNKCNEEISCSPGETQEVDSDVRACNNSMSSSRDVIHGSSSREESATKSSLTETSGSPYSDFHDTIKEAGKEDSATSSIESPWYHLRKEATTFVSQTLQRGRRNLWHLTASRVSVLLSSAAVCTASIHQFLKNYEDLGVFILTGEAFCGIEAVEFRQKLKVVCENYFIAFHRQNVHVFVGMSNMFLFVDLLIGCLSN

SEQ ID NO: 132070 - protein, 400 aa, Glycine max
  Coding DNA Sequence Number=SeqID_40385
  Homolog annotation: Hit_ID=A7PQN2; Match level="QueryCoverage=52%, HitCoverage=24%, E-value=2e-64, Identity=63%"; Hit description =Chromosome chr6 scaffold_25, whole genome shotgun sequence
MEHIVQMKGRLKLNVTTTSNGGMRTIRNSDVLVTIEALKDRKLELLPAMVREQELDVLLKGFIKAHRRSNDNGRRWLMAEDGVERRPVVWDLCLTLEGCDFSVGIQGPSSPTRMNSLCVHSGLVLGVRTTAQPVHVCAGAADERGGMLLIVSHWKYGNLERCVAVDTISLVARILNRSKAHLQSMLLQSNSTILEDFYVHLVFSYPLEMRPILTKGIEVAPLSTFLQFWPRDIVDAVPDLTEHVHRTTVRLLLHINGSQNCVAKYNERIVSGDRYVERVANCKWEVKELGMEHNGYVDLMLGEFKHYKTRLAHGGIRKEVQDLLLDYGLEIVAETLVEGLSRVKRCSDEGRALMSLDLQTLIAIMSWVRIRKQPLCICKGKAAYNIPPPSLRIAKSLWTM

SEQ ID NO: 132071 - protein, 68 aa, Glycine max
  Coding DNA Sequence Number=SeqID_40386
MEDGEDTNVSISRKSFKFTRFRNKFKIQTYLENANVGEMVSQLMCEMGHVIGTVFGASTMVLQLMHAH

SEQ ID NO: 132072 - protein, 59 aa, Glycine max
  Coding DNA Sequence Number=SeqID_40387
  Homolog annotation: Hit_ID=A5BCY8; Match level="QueryCoverage=88%, HitCoverage=5%, E-value=3e-07, Identity=53%"; Hit description =Putative uncharacterized protein
MVTLNRGNFMRSGIIKHDILEVFRGTVSDDITSAKEFLAAIEKHFAKRDTAKTSTLLQT

SEQ ID NO: 132073 - protein, 147 aa, Glycine max
  Coding DNA Sequence Number=SeqID_40388
  Subcellular localization annotation: CTP_CleavageSite=66; ConfidenceScore=5.80e-01
MPQMHHHHPRRHNLHHSNSKALCKCRFVPFFLRAWPTSSSSSSPPSSSSASSSSTSASSPPTRPLSAAVIRHAGRRRRTPRRRLQQKSVCRWWGTAGGCAEVRNMFLRSCERGNAVKVIPYCKPVFHPGTALTRGSKKQVTGPGGRC

SEQ ID NO: 132074 - protein, 148 aa, Glycine max
  Coding DNA Sequence Number=SeqID_40389
MQMQSVCDEGGVKKVDGDAGGASILGCNVKHQRRLTQSIMKKVKDGVGKEVEGYFVVVASTIRKMSKDFIGNKFLSNLKDLLSSRILEGLCANYVFNKGKIERVLGVIFGSGVLCYCKVCKKIMTMRQDSDLRHPKNLTNKNAIVKPY

SEQ ID NO: 132075 - protein, 78 aa, Glycine max
  Coding DNA Sequence Number=SeqID_40390
  Gene Ontology: Mol. function=cyclin-dependent protein kinase regulator activity; Cellular component=cyclin-dependent protein kinase holoenzyme complex; Biological process=regulation of cell cycle
  Homolog annotation: Hit_ID=A2XCH8; Match level="QueryCoverage=80%, HitCoverage=81%, E-value=8e-29, Identity=84%"; Hit description =Cyclin-dependent kinases regulatory subunit 1
  Pfam annotation: Domain name=CKS; Domain location=1-62; Score=132.6; E_value=1.1e-36; Accession=PF01111.10; Description=Cyclin-dependent kinase regulatory subunit
MGQIQYSEKYFDDTYEYRHVVLPPEVAKLLPKNRLLSESRGWVHYAIHRPEPHIMLFRRPLNYQQQQENQAQQSMLVK

SEQ ID NO: 132076 - protein, 60 aa, Glycine max
  Coding DNA Sequence Number=SeqID_40391
  Subcellular localization annotation: CTP_CleavageSite=34; ConfidenceScore=5.62e-01
MEAPAIMAIALANGGTYTSATGLFSQSTQFTTTSRSSRKNRLRNLIPITVILQDSTLLLC

SEQ ID NO: 132077 - protein, 362 aa, Glycine max
  Coding DNA Sequence Number=SeqID_40392
  Gene Ontology: Mol. function=DNA ligase (ATP) activity; Cellular component=nucleus; Biological process=DNA recombination
  Homolog annotation: Hit_ID=Q2PEZ1; Match level="QueryCoverage=90%, HitCoverage=49%, E-value=1e-150, Identity=80%"; Hit description =Putative DNA ligase
  Pfam annotation: Domain name=DNA_ligase_A_C; Domain location=229-294; Score=94.0; E_value=4.7e-25; Accession=PF04679.6; Description=ATP dependent DNA ligase C terminal region
  Pfam annotation: Domain name=DNA_ligase_A_M; Domain location=21-204; Score=203.2; E_value=6.4e-58; Accession=PF01068.12; Description=ATP dependent DNA ligase domain
  Pfam module annotation: Pfam domain module=DNA_ligase_A_C::DNA_ligase_ A_M; Domain location=229-294::21-204
MRFDLIISLKSLVSHSRPLSPRVFHTSIAVLRQIHYLENGSVEIYSRHAERNTGKFPDVVAAVSRLKKPTVSSLILDCEIVAYDRQTQTIHSFQALSTRARKNVEMEDIKVDVCIFAFDLLYLNGQALLQENLRVRREHLYASFEEEPGFLQFATTITSNDVEEIQKFLDQAVGASCEGLIIKTLNEDATYEPLKRSLNWLKLKKDYMDNIGDSLDLVPIAAFHGRGKRTGVYGAFLLACYDSDNEEFQSICKIGTGFSEAVLEERSSSLRSKVIPKPKAYYRFGESINPDVWFEASELHLTFLVALVHFSIKGISLRFPRLLRVRPDKSPEQASSSEQVAEMYNAQKQNHTINQNDDEDDD

SEQ ID NO: 132078 - protein, 276 aa, Glycine max
  Coding DNA Sequence Number=SeqID_40393
  Gene Ontology: Cellular component=chromosome, pericentric region; Biological process=chromosome segregation
  Homolog annotation: Hit_ID=A7PQQ7; Match level="QueryCoverage=100%, HitCoverage=100%, E-value=1e-54, Identity=45%"; Hit description =Chromosome chr6 scaffold_25, whole genome shotgun sequence
MAKKSIGSLMRKKLSDITNNTNPNYSQQLDTSLSSDNNSIQQLLKERTALIQLLTERNKIIEATGSELQRLRADVKKLQIQNWNLAQSNTHMLAELNMGRERIKTLQHEILWRAALIKGKTVDVQEKVEIEGEKNPTALSQLQEGDKKAGVPSPKASNDEQHKCMNRRRIRSKSTGSSTASKNTNKDKVKDNRRRLRRHSTTFKTHEHEPLENLFELEDATYLVTQSPTSKTERGKSSASRNEATRCSFERPLRRAVQKVHSYKEIPVNVKMRRLD

SEQ ID NO: 132079 - protein, 494 aa, Glycine max
  Coding DNA Sequence Number=SeqID_40394
  Gene Ontology: Mol. function=transferase activity; Cellular component= membrane; Biological process=metabolic process
  Homolog annotation: Hit_ID=A7PQR4; Match level="QueryCoverage=86%, HitCoverage=92%, E-value=1e-168, Identity=65%"; Hit description =Chromosome chr6 scaffold_25, whole genome shotgun sequence
  Pfam annotation: Domain name=Exostosin; Domain location=104-411; Score=323.0; E_value=5.6e-94; Accession=PF03016.6; Description =Exostosin family
MAQQKRPPNSRGYYVKMKLLQKHGRPHHHHHHHQQEKNCFYRYYKWVLWLSLSLYFFTSYLISNNNNHHTKKPSHVSRALIQSNHTTTPQHALNSPESLKKLKVFVYDLPPKYNTDWLTNERCSKHLFASEVAIHRALLTSEVRTFDPYDADFFFVPVYVSCNFSTVNGFPAIGHARSLIASAVNLISSEYPFWNRSRGSDHVFVASHDFGSCFHTLEDVAMADGVPEIVRNSIVLQTFGVVFDHPCQKVEHVVIPPYVSPESVRDTMENFPVDGRRDIWAFFRGKMEVHPKNVSGRFYSKKVRTVIWRKFNGDRRFYLQRHRFAGYQSEIARSVFCLCPLGWAPWSPRLVESVALGCVPVVIADGIRLPFVSAVKWSEISVTVAEKDVGRLAEILERVAATNLSTIQRNLWDPATRRALLFNSQVQLEFLERWNLMTHVGAQSSSFKTFFEYINGDVVVCQVGDKRVGKTKVEEILVFVSEMINENGDLDGGR

SEQ ID NO: 132080 - protein, 195 aa, Glycine max
  Coding DNA Sequence Number=SeqID_40395
  Gene Ontology: Mol. function=serine carboxypeptidase activity; Cellular component=extracellular region; Biological process =proteolysis
  Homolog annotation: Hit_ID=A7PQR8; Match level="QueryCoverage=71%, HitCoverage=30%, E-value=9e-34, Identity=51%"; Hit description =Chromosome chr6 scaffold_25, whole genome shotgun sequence
  Pfam annotation: Domain name=Peptidase_S10; Domain location=1-194; Score=-231.5; E_value=0.1; Accession=PF00450.13; Description=Serine carboxypeptidase
MKHISTCKKEVFLLIGKFVSLGFAIGNGLTNPAIQYPEYPDFALDNKIITKAQHDDIIKSIPGCEEATKNCESKGGQSCETALNVCQGIFDSILSIAGDINYYDIRKKCVGQLCYDFNNVEKLLNLHKVKRALLEKGINVLDPTFWYPEPNRAWDRETRVKSLSTNGGNVPTQLLVLDGKNWERWHIQMKANFKT

SEQ ID NO: 132081 - protein, 394 aa, Glycine max
  Coding DNA Sequence Number=SeqID_40396
  Gene Ontology: Mol. function=serine carboxypeptidase activity; Cellular component=extracellular region; Biological process =proteolysis
  Homolog annotation: Hit_ID=Q2Z1Y2; Match level="QueryCoverage=91%, HitCoverage=90%, E-value=5e-84, Identity=67%"; Hit description =Serine carboxypeptidase
  Pfam annotation: Domain name=Peptidase_S10; Domain location=82-391; Score=329.9; E_value=4.5e-96; Accession=PF00450.13; Description =Serine carboxypeptidase
MASSPTFSKVSLLLLVSLSFSYATSGFNHEHAYPPQSQAEMLTRNLNLFPKDPVNIIKGDFDSFVPGKIVEKKFSLLGHSGPSIQHLGHHAGHYSLPHSKAARMFYFFFESRNNKDDPVVIWLTGGPGCGSELALFYENGPFHIANNLSLTWNDYGWDQASNILFVDQPTGTGFSYSSDDSDIRHDEASISNDLYDFLQEFFKAHPKFVKNDFYITGESYAGHYIPALASRIIQGNKENQGIYINLKKLKVDKVARSHLILAKKYSTISWTLLPALTKRVHEAMMQDYMRNMEVEIPSLLEDGIKLLVYVGEEDLICNWLGNSRWVHAMKWSGKKAFGKSPTVKFVVDGSKAGSLNSYGPLSFLKVHEAGHLVPMDQPKAALQMLQSWMAGKLT

SEQ ID NO: 132082 - protein, 759 aa, Glycine max
  Coding DNA Sequence Number=SeqID_40397
  Gene Ontology: Mol. function=serine carboxypeptidase activity; Cellular component=extracellular region; Biological process =proteolysis
  Homolog annotation: Hit_ID=Q2Z1Y2; Match level="QueryCoverage=54%, HitCoverage=84%, E-value=1e-165, Identity=65%"; Hit description =Serine carboxypeptidase
  Pfam annotation: Domain name=Peptidase_S10; Domain location=88-468; Score=455.6; E_value=6.5e-134; Accession=PF00450.13; Description =Serine carboxypeptidase
  Subcellular localization annotation: CTP_CleavageSite=25; ConfidenceScore=5.31e-01
MALASSPSLSKVYLFLVLLLFMSVSSSYATSRFTHKRDYPTQSQAEKLIRSLNLLPKDSVNIVKGDHVGFVPGKIVEKKFSLFCDSGPSIEDLGHHAGYYSLPHSKAARMFYFFFESRNNKDDPVVIWLTGGPGCGSELALFYENGPFHIANNLSLTWNDYGWDQASNILFVDQPTGTGFSYSSEESDIRHDETGISNDLYDFLQEFFKAHPEFVKNDFYITGESYAGHYVPALASRVNQGNKQNQGIHINLKGFAIGNGLTNPAIQYQAYPDFALDNGIITNAEYDNISKLIPGCEQAAKTCVLDKNGEVQFTNCTVLIHKVQYYDIRKKCVGELCYDFGNVEEFLNQKKVKSALGVRDDLQYVLCSTTVHAAMLQDWMRNMEVGIPSLLEDGIKLLVYAGEEDLICNWLGNSRWAHAMEWSGQKAFGTSSTVKFVVDGVEAGSLNSYGPLSFLKVCVIVLRVVFLSVMASDTDPNSKHLGTTVWDASLVFAKFLERNCRKGRFSPAKLKGKRVIELGAGCGVSGIGMALLGCDVIVTDQKEVLPLLQRNVERNISRIMQKNPDSFGSIKVAELQWGDESHIKAVGPPFDYIIGTDVVYVEHLLEPLLQTILALSGPRTTTMLGYEIRSTSVHEKMLQMWKRNFDVKTVAKSKMDETFQHPSIQLFIMGFKQSAECTENPGQATVEKVDVETVVEDESSEGNVVVEGSGLVEENVGDHSKPISQNAKLSEWEARRYGAMAARVLKDETLYGGDSVRNF

SEQ ID NO: 132083 - protein, 67 aa, Glycine max
  Coding DNA Sequence Number=SeqID_40398
MAAQWARELGLRIIASDSGEAKERRELLKIHSNKIKELRRFKRRLKICKNLKKSIKISIKRIFQRKD

SEQ ID NO: 132084 - protein, 181 aa, Glycine max
  Coding DNA Sequence Number=SeqID_40399
  Pfam annotation: Domain name=Transposase_23; Domain location=55-125; Score=-11.0; E_value=0.019; Accession=PF03017.5; Description =TNP1ENSPM transposase
MTCTKKSSQMMSKATKEIADSIGLTLPPKPEVGPSVTRVNTKESCVNPSGQDLDTGDSKKCGLYVDENPLDLVSLGRVYEGLTIVHNIPLCNDQVKVGVEEVQDADDRVPVPTQEFQLVGHALNTSLAWATHLLFLKSLQVSWDATVFGMYNDNFPLYIKPKDLSEITHGGQCLSISVIQL

SEQ ID NO: 132085 - protein, 527 aa, Glycine max
  Coding DNA Sequence Number=SeqID_40400
  Gene Ontology: Mol. function=fatty-acyl-CoA synthase activity; Cellular component=peroxisome; Biological process=jasmonic acid biosynthetic process
  Homolog annotation: Hit_ID=Q9M0X9; Match level="QueryCoverage=100%, HitCoverage=100%, E-value=0.0, Identity=64%"; Hit description=4 -coumarate--CoA ligase-like 7
  Pfam annotation: Domain name=AMP-binding; Domain location=56-454; Score=352.0; E_value=9.9e-103; Accession=PF00501.19; Description=AMP- binding enzyme
  Subcellular localization annotation: CTP_CleavageSite=57; ConfidenceScore=5.05e-01
MQKAGYGGDGIYRSLRPCLVLPNDPNLSLVSFLFQSVSSFPSKIALVDSHSSQTLTLAHLKSQVAKLAHGFLKLGINKNDVVLLLAPNSIHYPICFLAATAIGAVVSTANPIYTVNEISKQVDDSNPKLLITVPELWDKVKNLNLPAVIIDTETAQGLVSFEAGNEVSRITSLDAVMEMAGPATELPESGVKQGDTAALLYSSGTTGLSKGVVLTHRNFIAASVMIGMDDDLAGEQDDVYLCVLPMFHVFGLAVVTYAALRRGSAVVVMERFELEALLKAIEKQRVTKLWVVPPILLGLAKQSVVGNYDLSSLRRIGSGAAPLGKDLMEECGRRFPHVAICQGYGMTETCGIVSVENPRVGVRHTGSTGTLVSGVEAQIVSVDTQKPLPPRQLGEIWVRGPNMMQGDLGYFDEDGQLYVVDRIKELIKYKGFQVAPAELEGLLVSHPEILEAVVVPYPDDEAGEVPIAYVVRSPNSSLTEEEIQKFIAKQVAPFKKLRRVTFINNVPKTASGKILRRELTAKARSKI

SEQ ID NO: 132086 - protein, 119 aa, Glycine max
  Coding DNA Sequence Number=SeqID_40401
  Homolog annotation: Hit_ID=Q8LEW4; Match level="QueryCoverage=32%, HitCoverage=13%, E-value=6e-10, Identity=76%"; Hit description =Putative uncharacterized protein
MEIFKIRNESMYGVMLTKSLMKREYRRNKVGKRYVKQRGFSPRNAPNLRVLPRRHTCEATKPASWRRRIFPTSFTRQSGTPKGYLAEVPGRMAAVFSAAVMARNRKGSSVMHMFLHDVD

SEQ ID NO: 132087 - protein, 236 aa, Glycine max
  Coding DNA Sequence Number=SeqID_40402
  Gene Ontology: Mol. function=transcription factor activity; Cellular component=nucleus; Biological process=regulation of transcription, DNA-dependent
  Homolog annotation: Hit_ID=A9PL47; Match level="QueryCoverage=78%, HitCoverage=88%, E-value=2e-54, Identity=59%"; Hit description=C -repeat binding facor 6
  Pfam annotation: Domain name=AP2; Domain location=63-114; Score=68.8; E_value=1.8e-17; Accession=PF00847.11; Description=AP2 domain
  Subcellular localization annotation: CTP_CleavageSite=69; ConfidenceScore=5.14e-01
MEFEIINESPADSTSLSSSSVSPCTPPNPNLLCDSPNPQPNTNTNPSHKRKAGRKKFRETRHPVYRGVRQRNGNKWVCEIREPIKKSRVWVGTYPTPEMAARAHDVAVLALSGTSAKFNFPDSVSLLPLAKSHSAVDIREAAKAASIEAFIPNTAFSSSHNNSNFGENGNAEDTCLNIGMHDDESETMFFDEEAVYNMPGLLDSMAEGLLITPPSMKRAMDWDDIGCVIDLTLWTN

SEQ ID NO: 132088 - protein, 77 aa, Glycine max
  Coding DNA Sequence Number=SeqID_40403
MDEEFRKIFKKFIFTDVSTLEDTEKKDGSEENAATNKKVDSDSKEEENDNEQKEKVISIRRKRGIVEAITNLGLIGV

SEQ ID NO: 132089 - protein, 118 aa, Glycine max
  Coding DNA Sequence Number=SeqID_40404
  Pfam annotation: Domain name=Transposase_23; Domain location=4-83; Score=-14.8; E_value=0.049; Accession=PF03017.5; Description =TNP1ENSPM transposase
MDVRMFSLLLLDVQSTLDVSVLLESIFCPPGCPGRVYKGSTVVHNTPLLPGQVKVGVEEVTDVDAPVPVPTDEVSLVGQAIHTFLAWPTHLVKSLSKQLCLRQNHLKSRIRRSMIRFI

SEQ ID NO: 132090 - protein, 109 aa, Glycine max
  Coding DNA Sequence Number=SeqID_40405
  Subcellular localization annotation: CTP_CleavageSite=45; ConfidenceScore=5.30e-01
MNLLPSAVHVSSTFESGAPRIDCLALFANSPFSTFIWSHMNSLPSAVHASSTNESGAPQIYCLALFANSPFPSVAMCPFTGGRHVTRGMRVPRKEYARSRHQRLFEENV

SEQ ID NO: 132091 - protein, 63 aa, Glycine max
  Coding DNA Sequence Number=SeqID_40406
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=47%, HitCoverage=6%, E-value=7e-09, Identity=96%"; Hit description =Photosystem II 44 kDa reaction center protein precursor
  Subcellular localization annotation: CTP_CleavageSite=20; ConfidenceScore=5.21e-01
MTHAPLGSLNSVGGVATEINAVNYVSSRSWPFMARGKSSRSLPQDLKKELIEILNQFFPMTPS

SEQ ID NO: 132092 - protein, 116 aa, Glycine max
  Coding DNA Sequence Number=SeqID_40407
MERFPLALIFFFPLKQRIFGLVTRGTCSAVKVLASWSVTENIEGLDVVVTVQSFKHASYNLNRQYFIAKLMKNELERSLTELILGCLFAAEISGEFRSRGFVAEYGSVIANIRLYR

SEQ ID NO: 132093 - protein, 168 aa, Glycine max
  Coding DNA Sequence Number=SeqID_40408
MKRSMIDVASGGAFGDMTPTEARNLIEKMASNSQQFSARNDAIVLRRVHEVATDSSSSAENKKLEGKLDALVNLVNHHIDICPSLQQSGVNEQPEASAANIYNRPPQQQNQQQQNNYDLSSKRYNLGWRNHPNLRWTSPPQQQQPVPPFQNVVGSSKPYVPPPMQQQQ

SEQ ID NO: 132094 - protein, 192 aa, Glycine max
  Coding DNA Sequence Number=SeqID_40409
  Homolog annotation: Hit_ID=UPI00006A2939; Match level="QueryCoverage =60%, HitCoverage=75%, E-value=5e-08, Identity=31%"; Hit description =UPI00006A2939 related cluster
MRGTVHEPQVNIGADQKFSPIEDGPSGTSTLVFRGLHVLANRGLHALTLRGLCVLAIRGLHVLTFRGLHALAIRGLHVLTFVGLHALTFRGLHVLANRGLHALTLRGLNVLALRGLHVLTIRGLHALTSRGLHVLALRGLHVLTIRGLHALTSRGLHVLALRGLLALALGTSYPHLQRTTCPHLRRATRPHL

SEQ ID NO: 132095 - protein, 75 aa, Glycine max
  Coding DNA Sequence Number=SeqID_40410
MSGLIRDSPQISANPHQLDFAPYASRSYSAQWNVSELFHDMRMLHSSHILEEMEVDEPWLGLWLPLNYQVDIGAS

SEQ ID NO: 132096 - protein, 135 aa, Glycine max
  Coding DNA Sequence Number=SeqID_40411
  Homolog annotation: Hit_ID=Q6UUU1; Match level="QueryCoverage=44%, HitCoverage=40%, E-value=1e-18, Identity=78%"; Hit description =Putative uncharacterized protein
MVNSARAPCFGDSRSRRKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132097 - protein, 164 aa, Glycine max
  Coding DNA Sequence Number=SeqID_40412
  Pfam annotation: Domain name=Transposase_23; Domain location=60-124; Score=0.1; E_value=0.0012; Accession=PF03017.5; Description =TNP1ENSPM transposase
MALKEAIKVELSHKGSPNSLIIQLDIQQLGARVSTKGSNAQSNAQPSRESDGDVTRKMGLYVQHKDGTLGLVAMGKIMDRDSVIHTVAYADDVVRVSVDTVIDPDAKIPYATSEIKYVKQALHTFVAWPTDLVKLVFDEKLFCTKWMHMEISQLMWTQMIQCVG

SEQ ID NO: 132098 - protein, 17 aa, Glycine max
  Coding DNA Sequence Number=SeqID_40413
MPFSKVQRLEMVFSAVI

SEQ ID NO: 132099 - protein, 276 aa, Glycine max
  Coding DNA Sequence Number=SeqID_40414
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFATRLIISGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132100 - protein, 74 aa, Glycine max
  Coding DNA Sequence Number=SeqID_40415
MKKQQWKRSGRQRRRGERRRHPLGNKPWKKELHHQDEPWIRSLEMMLQWRKRKRERKREGGGGQEIDGRKRERS

SEQ ID NO: 132101 - protein, 96 aa, Glycine max
  Coding DNA Sequence Number=SeqID_40416
MAQLISDVIYYLQEWHPQRHPVDPEKSNRALGFPALVTGLCSPTGCPFPPARSRQHDIGIAPARHPVDPKKSNRVLELPSSHYWPRSVLRSACRPQ

SEQ ID NO: 132102 - protein, 55 aa, Glycine max
  Coding DNA Sequence Number=SeqID_40417
MPPPPQGSADVAFRTPLAPYEKSKSFGFRGGTGALFLILWGGGAWPFLVGGAICL

SEQ ID NO: 132103 - protein, 78 aa, Glycine max
  Coding DNA Sequence Number=SeqID_40418
MGKYLFHIKNIKINRKNKFTNPNQHILYETSGVYRKYLGPYISQECEEQILPINADTFLAMLILFIAFKLPFVGAHLL

SEQ ID NO: 132104 - protein, 532 aa, Glycine max
  Coding DNA Sequence Number=SeqID_40419
  Gene Ontology: Mol. function=catalytic activity; Cellular component =intracellular; Biological process=metabolic process
  Homolog annotation: Hit_ID=A9HVR7; Match level="QueryCoverage=33%, HitCoverage=25%, E-value=3e-63, Identity=72%"; Hit description=Acyl -CoA synthetase
MRRHGYAGTLYPINPQRAEVQGERAWPSLAALPAAPDLAIVAVAGEQAVRAVDDCAALGVAAAIVISAGFSETGEAGRALQEAMTARARAAGMRIIGPNSQGLANFGNGAIASFSTMFLEVAPGDGPVAVISQSGGMCAMVYGLLRQRGIGVRHVHATGNEADVSVAELACATLRDPEVGLRAAVPGIAARGRAAGRGGGAGAGARRAADRGQVGPLRGRRARRGLAHRRAGQRRPRGGCLLRTPRHPARARPAGTGALRRAGPAQPLAARAARGGGQQLRRQLRAGLRRGRRARPGDRAAGRRHPAGAGRASARLCHHRQPRGHHRRAAVEQRPVRASAARNRRRPGGRHVPARYSSGGARLRRGFVRNGRGRLCAGGIQAGGGGGVAGQRRRHVPRARPARLRRRDPGDGCLVGAVAPAAVARTRPHGVAASIARHCGGGAGPERRRGLPVRSGQPGAAGRQRTGGDRTRRLPHGRRGHCRVAPHRRAGGAEVARQNCRTSPNMDWSRWAWTMKPRCAPRFPIKPKPWVS

SEQ ID NO: 132105 - protein, 161 aa, Glycine max
  Coding DNA Sequence Number=SeqID_40420
MTLLLSNILPNDRNADLPLQKGHAHKTPSGLGEVQQGPGVSSSDCEPLSVLQGARYPQQGIAPARHPVESKKSNRVLGLPALITGLCEFYKVPVTPNKVIRPHINRAFIKKYCAPRQAQGETPQQHWDGQQQATNAPPPPPKPLSSSMKRLEYCLRHMVDQ

SEQ ID NO: 132106 - protein, 295 aa, Glycine max
  Coding DNA Sequence Number=SeqID_40421
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMSPNNILVPLIIVTRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132107 - protein, 160 aa, Glycine max
  Coding DNA Sequence Number=SeqID_40422
MSSSKGPQTKLGYDNGVSFEGTLDDDWKFDFSVSDARRLACINQADMTGRLLAGSLTFDCRILHYLIVRILLPRSSNLAQALQSDAPLPYPHLISLFLHHFEVPLDSEPSVQIKKSFSIGAAVVASFGYRKEHDGSWIKKDAQPHDAKGCSPAREDSSLL

SEQ ID NO: 132108 - protein, 161 aa, Glycine max
  Coding DNA Sequence Number=SeqID_40423
MVGYTPSSFTDLVSASKKIEVDPKRGKFDHPTRTTEKTGANKEGEDEGETHAVTAIPVRPSFPPTQQYLYSANNKLSPYPPPSYPQRPSLNQPQTTMLNEMDKVDIFVPHPLTNACLLIQLSPECGCKPLVCLLKQPAPLSVDFQDRSIRDYSSCTLVGVP

SEQ ID NO: 132109 - protein, 123 aa, Glycine max
  Coding DNA Sequence Number=SeqID_40424
  Subcellular localization annotation: CTP_CleavageSite=71; ConfidenceScore=5.49e-01
MLVRMIRTRLFAAARVKSYPGMHSSSVIASLSGCARTVGPPPISGGGPGTVRMWSTLKMRTRSPLKARACSLLKVKACSPLLARTCSPLQGDRYKYPRVHPYEKARDRLIERAGHPKSTRFGH

SEQ ID NO: 132110 - protein, 85 aa, Glycine max
  Coding DNA Sequence Number=SeqID_40425
EALPKRFRNVFREEFRKDFNRSSTFFIRSSSFFDLQRAHLGPPEYSSRKAVASGGSNLARLGELSSPGRAELAWASWAAPPPYLL

SEQ ID NO: 132111 - protein, 106 aa, Glycine max
  Coding DNA Sequence Number=SeqID_40426
  Homolog annotation: Hit_ID=A5BSW9; Match level="QueryCoverage=50%, HitCoverage=4%, E-value=2e-07, Identity=47%"; Hit description =Putative uncharacterized protein
  Subcellular localization annotation: CTP_CleavageSite=63; ConfidenceScore=5.16e-01
MGPKSILRLMRTLGPSLASLVQSSSSLLSNALGGSNQHKNTKKGVPTDPKRIKVIPKWPTPPSKMEIWGFHDLTNFHKRIVPYFSILLAPLFELVLMEEAQSFKNL

SEQ ID NO: 132112 - protein, 103 aa, Glycine max
  Coding DNA Sequence Number=SeqID_40427
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=82%, HitCoverage=73%, E-value=9e-17, Identity=56%"; Hit description=LacZ protein
  Subcellular localization annotation: CTP_CleavageSite=33; ConfidenceScore=5.15e-01
MLSTYSRSSGHQTLTRKPTSPGDPLVLERPPPRWSSNSPYSESYYNSLAVVLQRRDWENPGVTQLNRLAAHPPFASWRNSEEARTDRSFPTVAQPEWRMGRAL

SEQ ID NO: 132113 - protein, 169 aa, Glycine max
  Coding DNA Sequence Number=SeqID_40428
  Gene Ontology: Mol. function=helicase activity; Biological process =viral genome replication
  Homolog annotation: Hit_ID=Q9LW42; Match level="QueryCoverage=95%, HitCoverage=9%, E-value=8e-39, Identity=51%"; Hit description =Helicase-like protein
MARDRLIDTEVHNVRLKLIAGREKDGRTYNVPSVPEVAALIAGDIDANSNKDIIVKTQNGQLQRIHELHCSYLALQYPLLFPYGEDGYRSDIVHRDTLSGKKRKRNRLTMREWFAYRLQCRPNEGQTLLHSTKLFQQFVAEGYTMIESERLSYVRNNQKKLRVDKFYSL

SEQ ID NO: 132114 - protein, 190 aa, Glycine max
  Coding DNA Sequence Number=SeqID_40429
  Gene Ontology: Mol. function=phosphoprotein phosphatase activity
  Homolog annotation: Hit_ID=Q2HTA0; Match level="QueryCoverage=59%, HitCoverage=18%, E-value=1e-17, Identity=44%"; Hit description=IMP dehydrogenase/GMP reductase, related
  Pfam annotation: Domain name=DUF1723; Domain location=101-150; Score =62.8; E_value=1.2e-15; Accession=PF08330.1; Description=Protein of unknown function (DUF1723)
MHAGLKVEPWGERIIIIQMMFPSEEAVDDAKGFPGGPHDPSVLTDYGDHVVVIVWNGEEHPELKLSSHGRKVQKFGRLAPKVEGPVAATGLSLLIACSVDTGDRGLISAFVERWHKETSSFHLPVGELTITLDDVAYLLHLPIIGAFHSFETLHVDEAVLMLVELLEVSGEKGRAKTTQYHGAYIRLSWL

SEQ ID NO: 132115 - protein, 137 aa, Glycine max
  Coding DNA Sequence Number=SeqID_40430
MSNLNLHEDDDHDDDDYLVSNSYVEESLDKDDSVDGISDTDSEVPDMIPPVRIVHPAEGVQGIQNPFWNDPLHYNNINWSHPDEEDICGLEMPSSFNVGQELYVGMEFDSKDAVKNAVKQYVMKVHQSFKVVESKWD

SEQ ID NO: 132116 - protein, 286 aa, Glycine max
  Coding DNA Sequence Number=SeqID_40431
  Gene Ontology: Mol. function=motor activity; Cellular component=cell projection
  Homolog annotation: Hit_ID=UPI00016621D1; Match level="QueryCoverage =99%, HitCoverage=40%, E-value=7e-17, Identity=32%"; Hit description =UPI00016621D1 related cluster
RAACLTIRGLHVLAIRGLHALAFRGLHVLAFRGLHVLTFRGPNIRIFGGLHALAFRGLHVLIFRGLHILTFRGLHALTFRGPNILIFRGLYVLIFRGLHVLTFRGLHALTFRGPNILILRGLRILIFRGLRILIFRGLHVLTFRGLHALTFKGLHVLAFRGLHVLAFRGLHVLAIRGLHVLAFRGLHVLTFRGLHALAFRGVHVLASRGLYVLTFRGLHTLIFRELYVLPLRGLHVLAFGGLHALAFRGLHVLTIRGLHVLAFKGLHVLTFRGLHTLIFKGLYVLP

SEQ ID NO: 132117 - protein, 23 aa, Glycine max
  Coding DNA Sequence Number=SeqID_40432
MTPDACGCPLMFFDKWVKICDTG

SEQ ID NO: 132118 - protein, 214 aa, Glycine max
  Coding DNA Sequence Number=SeqID_40433
  Gene Ontology: Mol. function=nucleic acid binding
  Homolog annotation: Hit_ID=Q2AA09; Match level="QueryCoverage=32%, HitCoverage=25%, E-value=7e-09, Identity=44%"; Hit description =Retrotransposon gag protein
  Pfam annotation: Domain name=Retrotrans_gag; Domain location=12-104; Score=20.5; E_value=0.00055; Accession=PF03732.8; Description =Retrotransposon gag protein
LVGVPEDAVRLSFFSFSLSGEAKRWLHLFKGNSLKTWDEVVDKFLKKYFLESKTAEGKAAISSFHQFPDESLRGKIKLKTPEEAMELIGNMAASDHAILRDRAHIPTKRSLLELSSQDALLAQNKLLSKQLEALTETLKHMSPTAVFPKKKHHKKSTAWGTSQDKISMQGQWRNHPGNQFNKDQGGPSNRPQNKGPSLYDRTTKLEENLAQFVQ

SEQ ID NO: 132119 - protein, 138 aa, Glycine max
  Coding DNA Sequence Number=SeqID_40434
KAKLAKEKFKLAATHIRKEYAELREENATTTRALEQETKRARKEEYGRNKFRGALWGSNSELKLRREERDDSRAYSMVLKEELVACSRSKRSLSQRLCETETNMLAIIAKYPEELSLATAHEHRVADEYAQVYAEKEG

SEQ ID NO: 132120 - protein, 89 aa, Glycine max
  Coding DNA Sequence Number=SeqID_40435
MMHPTPQGYWIEDSKRIELDLLKKTLGNLLKEASQGSFSRKLLKEAFQGDKPLASQGSFKKKLLKEVSQGSFSRMFLKEVSQGSYLGYK

SEQ ID NO: 132121 - protein, 83 aa, Glycine max
  Coding DNA Sequence Number=SeqID_40436
MWAWERCTTLAPKRTPPVIQNKPLGHRWLRRGNQHIGNDDLIVFRRKLDIMKRHEFLWEPYTATVMLLLPPICLVGSVVWCTV

SEQ ID NO: 132122 - protein, 84 aa, Glycine max
  Coding DNA Sequence Number=SeqID_40437
MTEREMITIMVDTLPTFYYEKLIGYMPTNFADLVFAGERIESGLRKGKFEYASNTAPITTEEPQWWARGEKKEIPTRSPPPQHG

SEQ ID NO: 132123 - protein, 76 aa, Glycine max
  Coding DNA Sequence Number=SeqID_40438
HGLEIYPKAHENPRAFPWISSPIYLESSIQCPCGVGLHHLPRKGPVTRAMSKRLQEDWARAVEEGPRVLMNLRVDF

SEQ ID NO: 132124 - protein, 112 aa, Glycine max
  Coding DNA Sequence Number=SeqID_40439
MKKRDTGHQSVSLENKTEDSTVLKIGDSAKVVIKQDMKGRKHKYGFNNNKREKTEKKRVKITLDDVNQFSFIMIISISMNVVSFFFSDNVTSDLSGQSDGSLLVEILWRLDL

SEQ ID NO: 132125 - protein, 80 aa, Glycine max
  Coding DNA Sequence Number=SeqID_40440
MARTCSPLKVRTCSALMVRTCSPLKARTCSPLNGEGNEYPSPLKARTYSPLLGEGVQPSGGEECSPLKARTCSPLNGEGN

SEQ ID NO: 132126 - protein, 185 aa, Glycine max
  Coding DNA Sequence Number=SeqID_40441
  Homolog annotation: Hit_ID=A5AZW9; Match level="QueryCoverage=77%, HitCoverage=30%, E-value=2e-17, Identity=44%"; Hit description =Putative uncharacterized protein
GRSLSGDAPSSMSEPFRNWLGMGVTIPALIQPEEEIAMHLAQLARRSLEWECSVGAGGPPVPRQHLEVHLVVLHETRDIPHSMAWHLSLIHSARPDAAPFFIIIYRPFFPPGYSRMKIVVCMLDFGCRISHPGKPTLLQEELCYALPIPIERKSCLVIPRLQHVRSLTPRAAAAVSRTDRRLACT

SEQ ID NO: 132127 - protein, 92 aa, Glycine max
  Coding DNA Sequence Number=SeqID_40442
  Subcellular localization annotation: CTP_CleavageSite=35; ConfidenceScore=5.01e-01
MDTNLGYIISSQISMIAQHDSSRLGFPALITTLCKARGVTSDSLSFESLSPAINLAYAKKNFWNLDDLASSLSHPLLAEHMIHRSQHDWLSA

SEQ ID NO: 132128 - protein, 104 aa, Glycine max
  Coding DNA Sequence Number=SeqID_40443
MTLLFSNILPGDHNANLPFRCIELVMCRHDIGIAPTRHPVDPKKSNRALGFPALVTGLCQSYRVPVPPARSCHRDIGIKPTKTPSGPGEVQQGPGVSSSDYGPL

SEQ ID NO: 132129 - protein, 97 aa, Glycine max
  Coding DNA Sequence Number=SeqID_40444
MVAITLAKVHQPPFLLEYDSNATCACHGEAPGHSIEHCKALKRKVQGLIDMGWLKFEENRVIFNFHRKWVQAIGLFAQAICDHSIRDYSSCMLVGLP

SEQ ID NO: 132130 - protein, 67 aa, Glycine max
  Coding DNA Sequence Number=SeqID_40445
MEAGSLSFNKVKKRLSHEVLKVIVELSSSIGLSVYPPLSAASVLIARQKNLAEHQCQGRALSARSVR

SEQ ID NO: 132131 - protein, 183 aa, Glycine max
  Coding DNA Sequence Number=SeqID_40446
MNLSKRKGNALRRPYQTRARARVMGEAEKVQEKMKAKNGGHKRANGHNDKGHDEHEEDNGSQCADFEPWLGYATEGQAVGGIPFENTLEGPQFRPQPQPLRFVVGRAPPAMAEKGKADHLKERLRAIEGGEDYAFANLEELFLIPKHGHSQVQGAGLWQVQGDYSLQEPSKDVLSEDGGIRKR

SEQ ID NO: 132132 - protein, 127 aa, Glycine max
  Coding DNA Sequence Number=SeqID_40447
  Pfam annotation: Domain name=zf-CCHC; Domain location=14-31; Score =22.6; E_value=0.00058; Accession=PF00098.14; Description=Zinc knuckle
QPLKASMQEKTSSIKCFKCLGRGHITSQCPTKKTMIMRGQDIYNSQDEATTSPFSSESEEAKGEDSSKEIYPKEEGQPLMVKEECKETLVSIATPLRLEFIPQVKELLDEGLVRKSLNPCALLVPKI

SEQ ID NO: 132133 - protein, 179 aa, Glycine max
  Coding DNA Sequence Number=SeqID_40448
  Homolog annotation: Hit_ID=Q6WAY4; Match level="QueryCoverage=88%, HitCoverage=33%, E-value=7e-15, Identity=32%"; Hit description =Putative uncharacterized protein
MGTNQTGKRFYQVKIKGLDITSIKELGRLMGPPQMQAFHKAYGKILDLTIAEISTEAIASLTQYYDQPLRCFTFLPSLSKIAIVVRDLAKGLDRVKQTRNGIVGLPRKYLEGKARDIANQEEWVLFMDVLALLIFGVVLFPNMDGLMDLAAIDAFLAYHHSKESPVVAVLANLFDTFYR

SEQ ID NO: 132134 - protein, 70 aa, Glycine max
  Coding DNA Sequence Number=SeqID_40449
MDEGLVHKNLNPCALLVPKIGIIRQQIPKIGGMMNVLSAPLIELVRNHDPSLEHSQVLRKKAQSFKNLGI

SEQ ID NO: 132135 - protein, 276 aa, Glycine max
  Coding DNA Sequence Number=SeqID_40450
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRKNRKTTNSSITNTTTWCVDNSTQTHVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132136 - protein, 125 aa, Glycine max
  Coding DNA Sequence Number=SeqID_40451
MGELNYFLGLQIKQTKEDDQCLWYTSQFFSRIILDPKYVDPDFFNDETFDCYQVFQNSGVVDFMSLKLPYYPELVKVFYCNLKIQDGIISSKVHGISMIIDQSLFFSLTRLASQGAPFEGTIVDD

SEQ ID NO: 132137 - protein, 31 aa, Glycine max
  Coding DNA Sequence Number=SeqID_40452
MESHEVKLQFGLQQDIPVDPMNLDRLHQIDM

SEQ ID NO: 132138 - protein, 198 aa, Glycine max
  Coding DNA Sequence Number=SeqID_40453
MSPIFKGGHALTFRGLHVLAIIGLHSLAFKRPPPDVGGGPTVRVQPEREAITQLLCIPGQDFTRAAAKRRVRIMRTNMTTLTQIEMTLLLSNILPSDRNANLSLQKYQLVCVVPTWGSHPQRHPVDLKKSNRALGFPALKLRVSISSRECLLPPAGSSGPLPIEFSSRSAASPGRRRAKHHSSLGMAGSGQQTHRHHL

SEQ ID NO: 132139 - protein, 67 aa, Glycine max
  Coding DNA Sequence Number=SeqID_40454
MILFGNLVQPPIVDADSPTILHPSRNQLLLFVSDHDEADFLRDYLDGTHPLAVGWLPPSSLRQESPG

SEQ ID NO: 132140 - protein, 87 aa, Glycine max
  Coding DNA Sequence Number=SeqID_40455
MKWKITSTKRHGQMRNKQHRGVLFHMGDRTYSTRPLADLSIQAVFASQGQVVRTYMPHAEVPIPTSDVHYLEQAVGTFVAWPAHLVR

SEQ ID NO: 132141 - protein, 137 aa, Glycine max
  Coding DNA Sequence Number=SeqID_40456
VPPVQLLTGWCVTAKAPPDISAGKCSGHAARRVPFAIQAAQLLGRAIGAGLFAITPAGERGMCCKAIKLGGTTAQCKLVGGVYDEEVVSRTVWFKRFAYWALAECILAYYVGTDEGVSEVLHVAGEKKAAPVRQQNM

SEQ ID NO: 132142 - protein, 48 aa, Glycine max
  Coding DNA Sequence Number=SeqID_40457
MGGFWAISCLKLKQPSSPGLAELAWASEVATTPPVLLKNGIPGLPGHP

SEQ ID NO: 132143 - protein, 99 aa, Glycine max
  Coding DNA Sequence Number=SeqID_40458
  Homolog annotation: Hit_ID=Q0ZCB8; Match level="QueryCoverage=91%, HitCoverage=15%, E-value=6e-07, Identity=29%"; Hit description =Integrase
MLECLAEHGIVLGHIISSRGIEVDPAKIDVISQLPYPSCMREALYQGILAKWPFHYPIYCKRRWSLILMISAKRLLIASSVPVTTTPIIQAPDWTPHLS

SEQ ID NO: 132144 - protein, 74 aa, Glycine max
  Coding DNA Sequence Number=SeqID_40459
  Subcellular localization annotation: CTP_CleavageSite=29; ConfidenceScore=5.36e-01
MKCQKCQLSLPHQWAKCASTAKRSFIALRATEESGRASASRSRAKREISALSAAGVFSQVKCTTGTKPESTYPH

SEQ ID NO: 132145 - protein, 192 aa, Glycine max
  Coding DNA Sequence Number=SeqID_40460
MVKVGTSYVPINVSFSPKSWPRASRYQQGHQDLFIPVEVICPASTVWIYSGISIKLIDTVAGGPWRNHGSISCSSCSATDGDCYPRPIRTQAYRAGSISAASVAWVPDAAATLTPAGLIACRYRAALRHSAANCRERADRCQGLLLLRIANAGERGMCCKLRLSWVTPGVFPVTGYYVVKLRRPVNCNTTSL

SEQ ID NO: 132146 - protein, 65 aa, Glycine max
  Coding DNA Sequence Number=SeqID_40461
MPKLMEADVQFAVFTGRESPTCPSNTAVDPELNSDDQVLCSVSIAPLRPTTESQLVLPLSTTELT

SEQ ID NO: 132147 - protein, 164 aa, Glycine max
  Coding DNA Sequence Number=SeqID_40462
AAEEDEEVQALRTELKQTQTVKERARREEHGWNKFRGALWGSNNKLKLRREEMDQSRTNMLAIISKYQEELNLATAHEHRVADEYAQVYAEKEARGRVIDSLHQEATMWMDRFALTLNGSQELPRLLAKAKAMADTYSAPEEIHRLLSYCQHMINLMAHIIRNR

SEQ ID NO: 132148 - protein, 224 aa, Glycine max
  Coding DNA Sequence Number=SeqID_40463
  Homolog annotation: Hit_ID=A0ST23; Match level="QueryCoverage=12%, HitCoverage=55%, E-value=4e-08, Identity=100%"; Hit description =Putative reverse transcriptase
  Pfam annotation: Domain name=Ins_element1; Domain location=48-109; Score=-23.7; E_value=0.028; Accession=PF03811.4; Description =Insertion element protein
MVKVGTSYVPINVSFSPKVGPGLPGINRDTRIYLFCEVIFRPQWLLFLSAVPPCSATDGVVRNGKSTAGHQRWQAAQLLGRAIGAGLFAITPAGERGMCCKAIKLGNARVFPVTTLPEIAPNIHLQIKLIDTVDLEGGPVGKPVVPAALMNRPTRGERRFAYWALAECILAYYVGTDEGICDTGYIPLPRSLTRYARSFDCGERKWLTNGAEISWKMPGRYLTG

SEQ ID NO: 132149 - protein, 86 aa, Glycine max
  Coding DNA Sequence Number=SeqID_40464
STLEDPRLDWLPSLRTAKREEVEAPEEDEEVQAFRVELDQAQTVKERFKSTALKIRKENTELRDVNVATTKALEQETKRARREEHG

SEQ ID NO: 132150 - protein, 76 aa, Glycine max
  Coding DNA Sequence Number=SeqID_40465
TSLKLKDPASTEAPQASFHQDWCPGSAGAGCTDRSSCPADGRPDKLGGSDRHSIELAQACDQSRKSQGPVGLLWVN

SEQ ID NO: 132151 - protein, 84 aa, Glycine max
  Coding DNA Sequence Number=SeqID_40466
  Subcellular localization annotation: CTP_CleavageSite=64; ConfidenceScore=5.28e-01
MFEHSIKRLPYLGTDVWGANTFPVRKYNSRTFHLKVRRSRLFRFFRRFPQINVGGDSARIPFVEHASRESRLALPPKGYGVESI

SEQ ID NO: 132152 - protein, 160 aa, Glycine max
  Coding DNA Sequence Number=SeqID_40467
  Homolog annotation: Hit_ID=A5BSR3; Match level="QueryCoverage=68%, HitCoverage=34%, E-value=1e-12, Identity=40%"; Hit description =Putative uncharacterized protein
DQDGVEDTVCEKYGISKEKWAQFYQTRRDPSWEDVRMKAQAIQNQNTAPHVFVSWGPRRRCRKLHSQEALDGVIDPPSPVRRHVKWKMARTKKTGEMTTEAAKEIAEKIDSFEEQATQGSFVPHGRQDVLVAAIGRPEHPGCVRGIGAGVTIKQYFGSAP

SEQ ID NO: 132153 - protein, 159 aa, Glycine max
  Coding DNA Sequence Number=SeqID_40468
  Homolog annotation: Hit_ID=Q6WAY4; Match level="QueryCoverage=86%, HitCoverage=25%, E-value=3e-14, Identity=35%"; Hit description =Putative uncharacterized protein
MGTNQTGKRFYQVKIKGLDVTSLKELGRLMRSLQMQAFRKAYGKILDLTIAEIFTEAIVSLTQYYDQPLRCFTFGDFQLVPTVEEFEEILGCPLGGRKPYLFSGFLPSLSKIAIVVGDSARELDRVKQTRNGVVGLPCQYLEGKARDMANQEEWVPFMH

SEQ ID NO: 132154 - protein, 164 aa, Glycine max
  Coding DNA Sequence Number=SeqID_40469
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=72%, E-value=3e-24, Identity=68%"; Hit description=LacZ protein
MKHFTDTLISANIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGTATLASADVRRCFLPLRTTPSVAEQEGQLIETEATGAPQKHHHTLNQ

SEQ ID NO: 132155 - protein, 143 aa, Glycine max
  Coding DNA Sequence Number=SeqID_40470
GPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTLRIDQAYRYRRPRGGARYQLLFPLVRVNFELGVIMVIAVF

SEQ ID NO: 132156 - protein, 113 aa, Glycine max
  Coding DNA Sequence Number=SeqID_40471
MENFFPPLPVYSCCSVRRPMLLSRIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 132157 - protein, 261 aa, Glycine max
  Coding DNA Sequence Number=SeqID_40472
  Gene Ontology: Biological process=transposition, DNA-mediated
  Homolog annotation: Hit_ID=Q6UUU1; Match level="QueryCoverage=27%, HitCoverage=46%, E-value=1e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDEPILLAQILMVMDLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEIPGRCQEDT

SEQ ID NO: 132158 - protein, 151 aa, Glycine max
  Coding DNA Sequence Number=SeqID_40473
  Homolog annotation: Hit_ID=Q5CDC4; Match level="QueryCoverage=36%, HitCoverage=42%, E-value=2e-10, Identity=69%"; Hit description =LacOPZ-alpha peptide from pUC9
MVKVGTSYVPINVSFSPKVGPGLPGINRDTRIYLFCEVIFRHSRLLFYQLIHTVSSTGGRNGKSTAGHQLLLGKCRVNFTLGVIMVIAVSCVKLLSAHNSIQQHTSRKHKGKAWGLRYAVSVKGDVLKRLIGVTLMPVFQSRRKPDGQLLM

SEQ ID NO: 132159 - protein, 168 aa, Glycine max
  Coding DNA Sequence Number=SeqID_40474
  Homolog annotation: Hit_ID=UPI00006A2D9E; Match level="QueryCoverage =75%, HitCoverage=64%, E-value=2e-07, Identity=21%"; Hit description =UPI00006A2D9E related cluster
MDPRRTACPYLQRATRPRHQRTACPHLQRATRPRHQRTAWLHALTFRGLHVLANRGLHALTLRGLHVLANVGLHALTFRGLHVLANRGLHALTFRGLHILAFRGLHVLTLRGLHVLALRGLHVLALRGLHVLALRGLHVLTIRGAARPHLQRTTCPRLERATRPHLGY

SEQ ID NO: 132160 - protein, 280 aa, Glycine max
  Coding DNA Sequence Number=SeqID_40475
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSNRPSSIEAMDSSSALKLFRRSANKASDSPASGPRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132161 - protein, 63 aa, Glycine max
  Coding DNA Sequence Number=SeqID_40476
MTETMNIDKCLLYVLKTRLSSGFVPCTISLDNYLKGIIYSALKGFNDSQESKFKVVARWIVVK

SEQ ID NO: 132162 - protein, 122 aa, Glycine max
  Coding DNA Sequence Number=SeqID_40477
AQLKKVIADLEAEKEAHEEEISELKGEVGAAAWKECVEPERTWDLILSPEKPLMKEFVPPKREEPDCPTLVYIKFENLKRKEEERKADVSSKILRSFALKRFDMKVTAIDRRLFQDICNMTE

SEQ ID NO: 132163 - protein, 77 aa, Glycine max
  Coding DNA Sequence Number=SeqID_40478
MPLRAREARLSGVLSKGGNMRGVPPPRLFVENVGKPEGTRSKRKILSSGVVFTLEEGRQKWGFCYYVPSFGEEIRPT

SEQ ID NO: 132164 - protein, 189 aa, Glycine max
  Coding DNA Sequence Number=SeqID_40479
MTQELVARGDTLRLSAPRHSVTPSVIDEQRPIWSSAPFPEMSAFSDGDFSSLTSYPELRRSEFLIGGYVGARASLLSTTPPFVAMTQELVARGDTLRLSAPRHSVTPSVIHEQRPKFGHSAPMIRGDTLWLFAPFCHPEAAGPMTSRDQVWSFCTHDTRRYLTVIRTFLSSRGGGPDDKQRPSLVILHP

SEQ ID NO: 132165 - protein, 83 aa, Glycine max
  Coding DNA Sequence Number=SeqID_40480
MSGKAIREILVRWLDDLVEQQGGGEAKAKENETRDVAEDQGRGEKAIRRRISWRWLDTPSEWPTLCRSLRKMGWYECVRTIGT

SEQ ID NO: 132166 - protein, 74 aa, Glycine max
  Coding DNA Sequence Number=SeqID_40481
MAFALATSMLCSVASKCWAKLLLDLEQAANSSFKTMPCTRDWCRNLPFGGRATRDSRDAGSTKGIRAESPPTFI

SEQ ID NO: 132167 - protein, 157 aa, Glycine max
  Coding DNA Sequence Number=SeqID_40482
  Pfam annotation: Domain name=Transposase_23; Domain location=37-107; Score=-11.1; E_value=0.02; Accession=PF03017.5; Description =TNP1ENSPM transposase
MQSQGLALPPKPAVGPSAARVSTKESCVDPLRNDIDTGDSEKCGLYIKENPPRLDALGKLYEGSTTVHNIPLRHDKVKVGVEEVRDADALIPIPTEEVQLVGQTLNTFVAWLTHFVKRLSEQGAVGSAKPTDRPDHDVDDPLYLMILTIPQLFLKPL

SEQ ID NO: 132168 - protein, 149 aa, Glycine max
  Coding DNA Sequence Number=SeqID_40483
  Homolog annotation: Hit_ID=A6TCT4; Match level="QueryCoverage=100%, HitCoverage=100%, E-value=5e-63, Identity=81%"; Hit description =Putative uncharacterized protein ygaW
  Pfam annotation: Domain name=DUF1144; Domain location=1-145; Score =372.0; E_value=1e-108; Accession=PF06610.4; Description=Protein of unknown function (DUF1144)
MFSAQSRLRHAVADTFAMVVYCTVVNMMIEIFLSGMTFEQSLSSRLVAIPVNIIIAVPYGFYRDFAMRQARRISTSGWMKNIADVVAYVTFQSPVYVLILLSVGADWHQIAAAVSSNILVSMMMGAVYGYFLDFCRRLFRVSPYQQAKA

SEQ ID NO: 132169 - protein, 137 aa, Glycine max
  Coding DNA Sequence Number=SeqID_40484
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MLCKNLEWCILLIYGQLCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132170 - protein, 121 aa, Glycine max
  Coding DNA Sequence Number=SeqID_40485
  Pfam annotation: Domain name=G-patch; Domain location=46-90; Score =11.6; E_value=0.0075; Accession=PF01585.14; Description=G-patch domain
MDSLGGSCPFNAPPKTKIHGGGALSHCFEGGGCSESLSMRPRMSGVAMMVACVMLGHNYESGMGLGKNNDDMTSLVDIKENRGKFGLGYKPTRTDVRRSIVERRNRGAGPQLRPQAREDPP

SEQ ID NO: 132171 - protein, 132 aa, Glycine max
  Coding DNA Sequence Number=SeqID_40486
MGDLEEVQEQVKADMSAVKDQMASMMEAMLAQYRGSLSTPPDATTALLCRGPPLAVEGREKLNLIEERLKAVERFGDYPFADMANLCLVSDVVIPTKFKRASAKCNTHGLSARKTLEEDELYRFAKSTTSSH

SEQ ID NO: 132172 - protein, 58 aa, Glycine max
  Coding DNA Sequence Number=SeqID_40487
MHDAIKEQAKVSLLCVGFIPESQLKSKISHSLIHMGFIGLVAWSGKTNMLWLEGGSKG

SEQ ID NO: 132173 - protein, 202 aa, Glycine max
  Coding DNA Sequence Number=SeqID_40488
MQVQPEEEAIVQLLCIPGQDFTRAAAKRRVRIMCTNMTTLTQIWMTLLLRNIPPSDRNTDLPLRKYQLGSCPQGTQWTRRSLTGPWGFQLWLRASTSPIGCPSPQQGSCPQGTQWTRRSPTGPWGFQLWLRASANPIGCSCPQQGIAPARHPMDPEKSNRVLGYPAMITSLCQFYRVSVTPNKVIRPHINRAFIKKYCAPRQ

SEQ ID NO: 132174 - protein, 65 aa, Glycine max
  Coding DNA Sequence Number=SeqID_40489
MGKDLGSMGGPHDVQIQNEHAFPPYGLPLKYTPPNVAYTPNENVNNATPILVESQQARSDHAHVS

SEQ ID NO: 132175 - protein, 311 aa, Glycine max
  Coding DNA Sequence Number=SeqID_40490
MRSWVRGQWIPFDANALSQFLGYPLVLEEGQECEYGQRRNQSDGFDEEAIAQLLCIPGQDFSRTAAGRRVQIMRTNMTTLTQIWMMLLLSNIQPNDHNSGLPLPKCQLVYVVLKRMSIHVAQLIADAIYLFAGIALTRHPLDPDKSNRALGFPVLITGLCQSFGVPVAPSKVIRPPITWAFIEKYCTQRPAQDDAPQAADTPPPHQAGPAGSFDSEQYLRHLVRQQAANHRAHVQTHDCLYQLSLSLQSQGFTSFPCSTSDRFRAEVAWPGDWPEAQAGKAPAEAPGEADEAREDEEMTDLLDFLGGSRAT

SEQ ID NO: 132176 - protein, 148 aa, Glycine max
  Coding DNA Sequence Number=SeqID_40491
  Gene Ontology: Mol. function=RNA-directed DNA polymerase activity; Biological process=RNA-dependent DNA replication
  Homolog annotation: Hit_ID=A7QRV9; Match level="QueryCoverage=93%, HitCoverage=13%, E-value=3e-11, Identity=33%"; Hit description =Chromosome undetermined scaffold_153, whole genome shotgun sequence
MPLLDAIKQIPRYARFLKELCTHKRKLKGNERISMGKNVSALIGKSFPHILEKCKDPDVVIHLANRSVAYPAGFHRGCAGSGRPFMKTARTKIDVYAGTLSMEFGDIVVHFNILDAMKHPSEDHSVFRAEIIDQIVDDYMFDFDSVVH

SEQ ID NO: 132177 - protein, 72 aa, Glycine max
  Coding DNA Sequence Number=SeqID_40492
MVSKGWSFDRASMVEEKGRKKQLTRREKSDLFEMLKSRLGLRTISLVPVPRVSLHPSGPVFESKQYISKRSE

SEQ ID NO: 132178 - protein, 66 aa, Glycine max
  Coding DNA Sequence Number=SeqID_40493
MKKQQWKRRCSGRQRRRGKRRRHPLGNKPWKKELHHQDEPWIRSLERMLQWRKRKRERKREGGARN

SEQ ID NO: 132179 - protein, 186 aa, Glycine max
  Coding DNA Sequence Number=SeqID_40494
FADLVFAGERIEVGLKRGKFDYVSSTNVNAKRIGATGAKRKEGDAHAVSSTPTWVKPQQTPHGTHQYAQHHPSFSAHAGNASSSTPVQPKAPTQREAPQVPTPNTTRPAGNSNTTRNFPPRPLPEFTPLPMTYEDLLPSLIANHLAVVTPGRGPSNPLSRSGMTLMQLASTMGVSQGHSVEKMLGP

SEQ ID NO: 132180 - protein, 81 aa, Glycine max
  Coding DNA Sequence Number=SeqID_40495
  Homolog annotation: Hit_ID=UPI0000ECBAF8; Match level="QueryCoverage =53%, HitCoverage=50%, E-value=1e-17, Identity=100%"; Hit description= UPI0000ECBAF8 related cluster
MLFLQCRLKGPIAKSGRHRGGAPIRPIVSRITIHWPSFYNVVTGKTLALPNLIALQHIPLSPAGVIAKRPAPIALPNSCAA

SEQ ID NO: 132181 - protein, 132 aa, Glycine max
  Coding DNA Sequence Number=SeqID_40496
MAEYEVKSKERVGPFAPIKLGHVAFAFEKKMKKKRKIIFYKKPNLFSLSSENFSSSLSSLHVAFLPSSSPPLFPSLKLQIPLHFYPKLQGKAIFGVLEPTCTSWGFKFQVEKCEILRVRKAKFGVNGNWSLK

SEQ ID NO: 132182 - protein, 326 aa, Glycine max
  Coding DNA Sequence Number=SeqID_40497
  Homolog annotation: Hit_ID=Q2HW90; Match level="QueryCoverage=90%, HitCoverage=69%, E-value=1e-24, Identity=28%"; Hit description =Putative uncharacterized protein
MGSSQTSSLKKRFYQVKVKSLGITSLRELGQLMGQLQRQVFRKAYGKIWDLAMAEVSTEAIASLAQYYDQPLRCFTFGDFQLSPMVEEFEEILGCPLGEGNHTSSQGRGEWASFIDILTLLIFGGVLFPNVDGLVDLAAIDAFLAILANLYDTFDRRCEKSNTRIVCCTPALYVWLVSHLFRQEVRHACPLESHRSCTEKRGANWDGLLASKEGASVNWFPRWKEGRTGILISCGGFSNVPLMGTRGCISYNLVLAIRQLGYPMRGAPQEEKLAPIIARGFNKTNVEPLQKVRKAWEMVQKKDKELRGSNNGPIGDYRKWLKVHMQ

SEQ ID NO: 132183 - protein, 69 aa, Glycine max
  Coding DNA Sequence Number=SeqID_40498
  Subcellular localization annotation: CTP_CleavageSite=41; ConfidenceScore=5.11e-01
MVARGDTLRLSAPRHSMTPSVIDEQRPTSRGQCGHLRPFRRCQHFPVETFSSLTSYLELRRSEFLIEDA

SEQ ID NO: 132184 - protein, 99 aa, Glycine max
  Coding DNA Sequence Number=SeqID_40499
MQSSQRDVYLGAYLNGFHCSGHWQMVVILPKEHLVVWFCSLHNRPDNYLKGIINSALKGIDDAPQPKSKASARWIVVKTIGAREIKGIADPVGIVSSPS

SEQ ID NO: 132185 - protein, 67 aa, Glycine max
  Coding DNA Sequence Number=SeqID_40500
MVFHLRLVISFKTKKGEHRLKGAIKGIDSREKQGFQYTECQETPISKTITHYLYITYNSKRNMQCCT

SEQ ID NO: 132186 - protein, 172 aa, Glycine max
  Coding DNA Sequence Number=SeqID_40501
  Gene Ontology: Mol. function=lipid transporter activity; Cellular component=integral to membrane; Biological process=lipid transport
  Homolog annotation: Hit_ID=A4WE10; Match level="QueryCoverage=98%, HitCoverage=42%, E-value=4e-69, Identity=78%"; Hit description =Lysophospholipid transporter lplT
MESSTIAAILLGSVAGGVLADWHVLAALGVCPLVYAGAVVANLFIPKLPVARPGQSWRFKPMTGSFFNACRVLWRNGETRFSLMGTSMFWGAGVTLRFLLVLWVPVALGITDNATPTYLNAMVAIGIVVGAGAAAKLVTLETVARCMPAGILMASWCSFSRYSMRYCLLMFC

SEQ ID NO: 132187 - protein, 152 aa, Glycine max
  Coding DNA Sequence Number=SeqID_40502
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
GTKAGTGPPLEVDGIDKLDRCVAIVASASLREMIKPGALAIISPIVVGGPGDPLVLERPPPRWSSNSPYSESYYNSLAVVLQRRDWENPGVTQLNRLAAHPPFASWRNSEEARTDRPSQQLRSLNGEWGRALVTATLASADVRRCFCRYAPP

SEQ ID NO: 132188 - protein, 179 aa, Glycine max
  Coding DNA Sequence Number=SeqID_40503
YGLDQRATCLAALSELIASVEDSGFPDARAKRNCRAKHMASQLYANLYDPKDKSPKQVRVRGHLIKFDVDALITFLKTPVVIEEGESLPAYSKFANMRLVPQELAARLCIPGRGFELYANGLPLKILRKNLTTLVQTWSVLSFSNLAPASHTSDITLDRAKLIYGLVMKMDMNLGSLIS

SEQ ID NO: 132189 - protein, 303 aa, Glycine max
  Coding DNA Sequence Number=SeqID_40504
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMCVHSQSITFLLMDEFGDTVFVKSASGYLDLFEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132190 - protein, 81 aa, Glycine max
  Coding DNA Sequence Number=SeqID_40505
MTKARQKGEKREKLAPSSPRQARLLPLEGTAFWRNFLEGPSGPGCYLHPLFTKYTPAFFADSFFVTLQNFTNFITILVFFP

SEQ ID NO: 132191 - protein, 109 aa, Glycine max
  Coding DNA Sequence Number=SeqID_40506
MVVTARPERVVRQFGYIQSIPSPPVSARLSHDQIDDRWMQFANHLLPAGQDDYEGYEAIAQRLERVLNLRIVTAGTLLYDIMQDYLTITRGGPSADGTVRARQRRRTDY

SEQ ID NO: 132192 - protein, 96 aa, Glycine max
  Coding DNA Sequence Number=SeqID_40507
MTNDEERLKIFAKSPTETLRKRKGRRSLPPSSPRRARLLPPEATSFWRNILEGPSGPDYALCFLLAFGMSRNFTNCLTMGAKYLKVVKRGSHPNNG

SEQ ID NO: 132193 - protein, 126 aa, Glycine max
  Coding DNA Sequence Number=SeqID_40508
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=50%, HitCoverage=51%, E-value=2e-25, Identity=87%"; Hit description =Putative uncharacterized protein
MEKNGTYFESELPKGKKAVTSRLLFTINESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132194 - protein, 76 aa, Glycine max
  Coding DNA Sequence Number=SeqID_40509
MGSKIYPKVHENPRVFISSSSPSLLESSIQYPWGVELHHPLHLGKDLTSNPESRVRSENSFHGYLPMREHGSSPTQ

SEQ ID NO: 132195 - protein, 86 aa, Glycine max
  Coding DNA Sequence Number=SeqID_40510
MTFEATKEIAEKVLQQLTQQIRDQLEESITEKVTQQLMTSFSQMQSQFQSQMQSQGLALPPEPMAGPSGPRVITKESCVDPSGNDP

SEQ ID NO: 132196 - protein, 63 aa, Glycine max
  Coding DNA Sequence Number=SeqID_40511
MCESGVVSSTGERRWSPGTVVAVEVVAAHPRMAAASPPPPTVVPDLHAIPVSSEINWATWTLP

SEQ ID NO: 132197 - protein, 106 aa, Glycine max
  Coding DNA Sequence Number=SeqID_40512
FRAPFEHKIRALLSLSLHSSPSSSKLLSMASYGGELLLDSIFSLEVASPLSLPFSISLPFIFQEAKESIDEEDPRPTSSNGACIMWYQEHLHLGVFCFYLFVNGEF

SEQ ID NO: 132198 - protein, 119 aa, Glycine max
  Coding DNA Sequence Number=SeqID_40513
  Homolog annotation: Hit_ID=A5BTC0; Match level="QueryCoverage=38%, HitCoverage=59%, E-value=2e-09, Identity=65%"; Hit description =Putative uncharacterized protein
LSLACPWIQQQFEKVDLYRESPDLRLFSTPRKHFVAYYALPRLWVPSSRVGDKRTRTADIRHRDPATGEPGTESFPRPPFFSARLFALKNTGFYGRSATPGCRRRPWGDLVVPTGWRRW

SEQ ID NO: 132199 - protein, 163 aa, Glycine max
  Coding DNA Sequence Number=SeqID_40514
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MECEKNASPPLASQGCNFWDQQAHPSIARPPCRGNHPHPSISPGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132200 - protein, 78 aa, Glycine max
  Coding DNA Sequence Number=SeqID_40515
  Subcellular localization annotation: CTP_CleavageSite=31; ConfidenceScore=5.32e-01
MDTSEPYTGAMKGTMHNPQANLGAGQSFLCVQNSFTTKDPRSLNPFSEVRRREEEISLERDRLYNEDQSQFLIEYASV

SEQ ID NO: 132201 - protein, 146 aa, Glycine max
  Coding DNA Sequence Number=SeqID_40516
MTYISACKRACRSRLTKGAEDDVSLGVLSGFSSYRQQKVYTDNHSGISGRQRDSKVAEDDRDSKVSMTDLVSTEDDGTEDDVSLCVLSGFSSYRQQKVYTENHSGISGRQRVSKVSMTDLVSAEDDVNLRVPTACRTRLTKGAEDD

SEQ ID NO: 132202 - protein, 258 aa, Glycine max
  Coding DNA Sequence Number=SeqID_40517
MAKLDPDIVLEFYANAWPTEEGVRDMRSWVRGQWIPFNADAIGQLLGYPLVLEEGQECEYGQRRNRSDGFDEEAITQLLCIPGQDFARTAAGRRVRIMRTNMTTLTQIWMTLLLSNIQPSDHNSDLPLPKCQLVYAILTRMSIHVAQLIADAIYIFAGMASTRHPLDPDKSNRALGFPALITGLCQSFRVPVAPSKVIRPPITRAFIEKYCTQRQAQGDAPQAADAPPPHQAGPAGSFDTEQYLRHLVCQQAANHRAH

SEQ ID NO: 132203 - protein, 157 aa, Glycine max
  Coding DNA Sequence Number=SeqID_40518
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=66%, E-value=3e-24, Identity=72%"; Hit description=LacZ protein
MTNSVSSNRPEKYNIAAFFSGVGGIELGFEQTNEFRVVPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132204 - protein, 73 aa, Glycine max
  Coding DNA Sequence Number=SeqID_40519
SFDDNKDDDKKLKSQDHFMITKMMTFKIESRTLQGSKENLISRMKNQDSRFKNNQDQDPRLKDSRIKRRLNQD

SEQ ID NO: 132205 - protein, 38 aa, Glycine max
  Coding DNA Sequence Number=SeqID_40520
MSSLSARLKAVRLASSHSLSASVQLILLPDSSVRLAGG

SEQ ID NO: 132206 - protein, 117 aa, Glycine max
  Coding DNA Sequence Number=SeqID_40521
MGTGVERTKIWATWEYVSSDGGGQQGMSGTWRYVAGVRRPWGSQILIGEFRVGNSIQGLKIGSGGLGKGTENIVEASGLITSLVFCLCSVLLGCDSLCCLNVVLLGCCGSLGGLMGT

SEQ ID NO: 132207 - protein, 149 aa, Glycine max
  Coding DNA Sequence Number=SeqID_40522
MTTLTQIWMTLLLSNIQPSDHNSNLPLPKYQLVYATLTWMSIHVAQLITDAICLFAGMPPTRHPLDPDKSNRALGFLALITGLCQSFGVPVAPSKVIRSPITRAFIEKYCTTRQAQGGDPQAPDAPPPPPHADPTGSFDTEQYLWHLVF

SEQ ID NO: 132208 - protein, 322 aa, Glycine max
  Coding DNA Sequence Number=SeqID_40523
  Gene Ontology: Mol. function=iron ion transmembrane transporter activity; Cellular component=membrane; Biological process=high -affinity iron ion transport
  Homolog annotation: Hit_ID=Q6U5Y9; Match level="QueryCoverage=59%, HitCoverage=60%, E-value=2e-71, Identity=68%"; Hit description=Iron (III) ABC transporter periplasmic binding
  Pfam annotation: Domain name=Peripla_BP_2; Domain location=1-190; Score=-18.4; E_value=0.0014; Accession=PF01497.9; Description =Periplasmic binding protein
PDFFFAGWNYGMKIGGDVTPEKLAPFGIKTLVLSESCVQAGGRPQKADMNLLYDDELKLGKIFGKQQEATALVEGWQRRLAALPARPAGQPPLKVFVYDSGEEKPFTSGKYAMPTAIIEAAGGRNVMDGLPASWTTASWEAVAAAEPDFIILLDYQTGSGADALRRFLESHPLMKLTPAVRHHRYLKLQLNELADPALYAARTAGAVGIVRANDLEPAVGERRAVMAAGVCGVRARFGAAFRHAGHHRRAAAGAQGFVGGTTTRNELADPFLFGLSSGASAGAVLVITRFGDALGVLTLPLSAFVGGVLSALAVMILFRVSR

SEQ ID NO: 132209 - protein, 274 aa, Glycine max
  Coding DNA Sequence Number=SeqID_40524
MAPRKLASKRSRKDKAAKGTSSAPEYDSHRFRSAVHQQRFEAIKGWSFLRERCVQLRDDEYTDFQEEIGRRRWASLVTPMAKFDPEIVLEFYANAWPTEEGVCDMRSWLLGYPLVLEEGQECEYGQRRNRSDGFDEEAIAQLLCIPGQDFARTAARRRVRIMRTNMTTLTQIWMTLLLSNILPSDHNSDLPLPKCQLVYAILTRMSVHVAQLIANAIYIFAGMAPTRHPLDPDKSNRALGFPSLITGLCQSFGVPVAPTKVIRPPITRAISEKY

SEQ ID NO: 132210 - protein, 123 aa, Glycine max
  Coding DNA Sequence Number=SeqID_40525
  Homolog annotation: Hit_ID=A2Q5N6; Match level="QueryCoverage=91%, HitCoverage=47%, E-value=9e-09, Identity=33%"; Hit description =Putative uncharacterized protein
MDIFVRNPVLKYDDEDKTLLLDIDEDKWSVFKLVGILKDDIKCTGDFKLWWTRVNDVGLKELAFDSDALELTNFALSNNNEVKFYFKKNNDRGVVATEGDVVALDDEDEGVSNKVVGVEAAIN

SEQ ID NO: 132211 - protein, 294 aa, Glycine max
  Coding DNA Sequence Number=SeqID_40526
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRLRSFRGPGLEKGLQMLADIKARYNLPLTTDIHESYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132212 - protein, 77 aa, Glycine max
  Coding DNA Sequence Number=SeqID_40527
MGTPFIAFAESLDIKYQGLLSRIPVRAGFHLTTMYAGPSITRKAQCMVGPRALAEHGRQSGKRIRHGFLSSRERDGR

SEQ ID NO: 132213 - protein, 101 aa, Glycine max
  Coding DNA Sequence Number=SeqID_40528
MSPPPLEPHNHSQTHLKLSGRLPLQALFSIGGLVGACTLYATLDCLACISEFRLSARLLAQHSSSALSGMSPRSANMRSSSFFQILPHTQPREWCAQRMAR

SEQ ID NO: 132214 - protein, 110 aa, Glycine max
  Coding DNA Sequence Number=SeqID_40529
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=65%, E-value=2e-33, Identity=100%"; Hit description=LacZ protein
MAGILFLLKQQDSLGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 132215 - protein, 132 aa, Glycine max
  Coding DNA Sequence Number=SeqID_40530
MEVMKEKMATMMEAMMRMKKIMEANAIAVAATSIVAKVNPMPPSDLNQMNHPTSDMVGKDLGSTDGPMMWKFKTSTPSRHMACLPTIHHPMWRTLPLRMSITPLPYSLRADNLIMYMSLNPWGRHMKFPTTI

SEQ ID NO: 132216 - protein, 190 aa, Glycine max
  Coding DNA Sequence Number=SeqID_40531
FLWEPYTATVLSMLPPICLVGSLAWRKTKMFVDQNNAKTATLGEVAETLQYMVSPQGRNTWTVDDFVPYVEKLTILSEEQERITEPVAHGPASERRFPPQQFHMLPSSVETRGFDRRREIVQAEDFSQQMEQRGHGMYYRPPTFSQYPSQMYQYPFEGHDTDMSASEHSYGGVAETPSFFMADHDPFAAT

SEQ ID NO: 132217 - protein, 196 aa, Glycine max
  Coding DNA Sequence Number=SeqID_40532
  Gene Ontology: Mol. function=aminoacyl-tRNA ligase activity; Cellular component=cytoplasm; Biological process=arginyl-tRNA aminoacylation
  Homolog annotation: Hit_ID=A2SL94; Match level="QueryCoverage=99%, HitCoverage=27%, E-value=3e-52, Identity=61%"; Hit description =Glycine--tRNA ligase
  Pfam annotation: Domain name=DALR_1; Domain location=85-185; Score =9.9; E_value=0.00093; Accession=PF05746.6; Description=DALR anticodon binding domain
METDLPLAFDQLIAQALSVFNGGQDVAEAIKAFCFDRLAVNLRDQGASAQEVDAVLSLSPNQLAEVPRRLSAVQVFANLPEAPALAAANKRVSNILKKVEGEVKAEVQAALLQESAENALYQALTDNKPKADQLFEAGDYAASLQALAVLKAPVDTFFDEVMVNAEDPALKANRLGLLATLHQAMNRVADLSKLAS

SEQ ID NO: 132218 - protein, 263 aa, Glycine max
  Coding DNA Sequence Number=SeqID_40533
MHTGARFHPCRCRKTSADHAHQQDHSYMDTDAAAIQQHSAQRPQCQSSPADVSVGLGHHDIGITPTRRPVDPKKSNRALGFPALVTGLCQSYRVPVPTARSCHRDIGIAPTRHPMDPKKSNRALGFPALVTGLCQSYRVPVPSARSCHRDIGIAPTRHPMDPKKSNRALGFPALGSCSQDTQWTRRSSTGSWSCQTLITGLGQFYGVPITPSKDIRPPTNRAFIKKYCVPRQAQGETPQQPGDGRQRATNAPPSPLEFTSAHP

SEQ ID NO: 132219 - protein, 72 aa, Glycine max
  Coding DNA Sequence Number=SeqID_40534
MKNKAKGKGKEVAGKGSTGKRKGAFDDDKIGGDRKRNKRGLVRMNRCLLLFLLDSLTCKHETGHLWRVSRLS

SEQ ID NO: 132220 - protein, 266 aa, Glycine max
  Coding DNA Sequence Number=SeqID_40535
  Gene Ontology: Mol. function=5-methyltetrahydropteroyltriglutamate -homocysteine S-methyltransferase activity; Cellular component =microtubule; Biological process=methionine biosynthetic process
  Homolog annotation: Hit_ID=A4WAQ8; Match level="QueryCoverage=100%, HitCoverage=77%, E-value=1e-142, Identity=93%"; Hit description =Methionine synthase
  Pfam annotation: Domain name=Meth_synt_2; Domain location=2-266; Score=-49.7; E_value=5e-09; Accession=PF01717.9; Description =Cobalamin-independent synthase, Catalytic
DQELLAGKQDALRLSLDEQIRAGIDIVSDGEQTRQHFVTTFIEHLSGVDFENRQTVRIRNRYDASVPTVVSAVARQKPVFVDDAKYLRQLTDKPIKWALPGPMTMIDTLYDAHYKSREKLAWEFAKILNQEARELEAAGVDIIQFDEPAFNVFFDEVNDWGIAALERAIEGLKCETAVHICYGYGIKANTDWKKTLGSEWRQYEEAFPKLQTSNIDIISLECHNSRVPMDLLELIRGKKVMVGAIDVATNTVETPEEVADTLRKAL

SEQ ID NO: 132221 - protein, 43 aa, Glycine max
  Coding DNA Sequence Number=SeqID_40536
MHIQGNASAFVDELRWTLEVVAVRLLPAAGHPQATVMPRPTPV

SEQ ID NO: 132222 - protein, 67 aa, Glycine max
  Coding DNA Sequence Number=SeqID_40537
MEYVEEGKIDDSLQGVFPLEHMNIQVNKIPKEMTKETMKILQKKANPMMHSQENGNFKRSSPRQHYW

SEQ ID NO: 132223 - protein, 130 aa, Glycine max
  Coding DNA Sequence Number=SeqID_40538
MVQAFLSQSICPLTNISNCDPTLLFFLIYKHAHSKLMISTHASPLHAINLQHQFHKENNYVCTAYSDNQVKLFSMLQDMHTIIYNKNTGVAEEVVVSPRTGVAGSSGISSNGVEGSAGISCTGEGGSASY

SEQ ID NO: 132224 - protein, 31 aa, Glycine max
  Coding DNA Sequence Number=SeqID_40539
MGLNQAHAFKERFIKSSGIEKEKDEWRRHFK

SEQ ID NO: 132225 - protein, 158 aa, Glycine max
  Coding DNA Sequence Number=SeqID_40540
  Homolog annotation: Hit_ID=UPI00006A2939; Match level="QueryCoverage =81%, HitCoverage=69%, E-value=2e-07, Identity=30%"; Hit description =UPI00006A2939 related cluster
GLHVLALRGLHVLAIRGLQVLAIRGLHVLAIRGLHALTSRGLHVLALRGLHALTLVTLTVRGLHALTLRGLHVLTIRGLHALTSRGLHVLALRGLHALTLGTSYLHLQRTTRPRLQRVIGLYVLAIRGLHVPHFQRGARPHLQRTARPRFQKATRPRL

SEQ ID NO: 132226 - protein, 129 aa, Glycine max
  Coding DNA Sequence Number=SeqID_40541
MTRGNPGDLQPFDPEIDRTFHRLVRHSVHPGHLLHFEHSEYYVAGDSEHSDFEHSTTNFHTENMAQPPPRERNLREMAAPDFTYESLCIQYPDEGVPYVLKTGLIHLLPKFHVLACEDPHKHLKEFHIV

SEQ ID NO: 132227 - protein, 56 aa, Glycine max
  Coding DNA Sequence Number=SeqID_40542
  Gene Ontology: Mol. function=nucleic acid binding
  Homolog annotation: Hit_ID=A5C693; Match level="QueryCoverage=96%, HitCoverage=32%, E-value=5e-10, Identity=50%"; Hit description =Putative uncharacterized protein
MTGDASKFTHISPKKSGHVTYGDNNKGRILGVGKIGLKHSLLSESINCDKGYLVSS

SEQ ID NO: 132228 - protein, 126 aa, Glycine max
  Coding DNA Sequence Number=SeqID_40543
GGGAYGKTALPRPSHFPVKYLPGIFQEISAPFRVSEEEAEYESCIDIPAEPGGTFLRPATAVELQFAPHSESITITGRRFTRRDWENPGVTQLIANLQHSPRRWRIIAKRPAPIALPDSCANGEGQ

SEQ ID NO: 132229 - protein, 97 aa, Glycine max
  Coding DNA Sequence Number=SeqID_40544
  Subcellular localization annotation: CTP_CleavageSite=29; ConfidenceScore=5.50e-01
MWQKSKRGVFAQSQSGPLGPSRSFFQKAVASGGSNLARLGELAGKLLPYFAINRGRSEEEKGSAFLALLSLSKLLRKIISVKKIQADALPNVSVTFP

SEQ ID NO: 132230 - protein, 24 aa, Glycine max
  Coding DNA Sequence Number=SeqID_40545
MATSGKIGKAIKPSNRMDKCNKSI

SEQ ID NO: 132231 - protein, 121 aa, Glycine max
  Coding DNA Sequence Number=SeqID_40546
MAARLIHDRVVMECLEGVWETLEGNERCRFCGTIRLTATSLVHPEEPARTLQRPVEWILPTPTPYRLVEPVQVIEVSSSEEDLEEDPEELPPEPAMDALDLPEDDETHSQMLIFRVHYVSI

SEQ ID NO: 132232 - protein, 85 aa, Glycine max
  Coding DNA Sequence Number=SeqID_40547
MVVTGDGEFRVRFRRGEPEKRPPTSKEGSRRANYPILTRGVKKLVVGPWVGSIGPPPVCTGRLVPSAGDALLSLTGRVVPPVLLL

SEQ ID NO: 132233 - protein, 292 aa, Glycine max
  Coding DNA Sequence Number=SeqID_40548
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P12862; Match level="QueryCoverage=100%, HitCoverage=73%, E-value=1e-119, Identity=68%"; Hit description=ATP synthase subunit alpha, mitochondrial
  Pfam annotation: Domain name=ATP-synt_ab; Domain location=70-235; Score=89.0; E_value=1.5e-23; Accession=PF00006.16; Description=ATP synthase alphabeta family, nucleotide-binding domain
  Pfam annotation: Domain name=ATP-synt_ab_C; Domain location=237-292; Score=0.1; E_value=0.03; Accession=PF00306.18; Description=ATP synthase alphabeta chain, C terminal domain
  Pfam module annotation: Pfam domain module=ATP-synt_ab::ATP-synt_ab _C; Domain location=70-235::237-292
DTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVAQLVQILSEANALEYSILVAATASDPAPLQFLAPYSGPWHIDKCHYCYADHQAVRLSQAMFSIYIPRLLERAAKRSDQTGAGSFIAEIRPAINVGLSVSRVGSAAQLKAMKTNLDAATQALLNRGARLTEVLKQPQYAPLPIEKQILVIYAAVNGF

SEQ ID NO: 132234 - protein, 254 aa, Glycine max
  Coding DNA Sequence Number=SeqID_40549
MASLVDWLAKLKVVSEESFEAPEEDEEVQALKSELGKAKLAKEKFKLAATHIRKECAGLQEENAITARALEQETKRARKEEYGRNKFRGALWGSNSELKLRREERDQSRAHSMVLKEELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYCQHMIDLMAHILEIVRKLVWSLRPD

SEQ ID NO: 132235 - protein, 52 aa, Glycine max
  Coding DNA Sequence Number=SeqID_40550
MRKWALTANQDGVDDTVCEKYNISKEKWAQFCQTRRDPSWEDVRKKTKAIQK

SEQ ID NO: 132236 - protein, 150 aa, Glycine max
  Coding DNA Sequence Number=SeqID_40551
  Gene Ontology: Mol. function=metal ion binding; Cellular component =nucleus; Biological process=histone H3-K9 demethylation
  Homolog annotation: Hit_ID=A7Q7J4; Match level="QueryCoverage=62%, HitCoverage=8%, E-value=4e-38, Identity=79%"; Hit description =Chromosome undetermined scaffold_60, whole genome shotgun sequence
MFGCFLSLPHFAVFALPAQTFLVALASFVAADFCISLLRDWLAWPQILKLKDWPPSNLFEEQLPRHCAEFISSLPFKEYTDPHKGSLNLAVKLPNGSLKPDLGPKTYIAYGFPQELGLGDSVTKLHCDMSDAVCSICLFLSWAVIFKDFF

SEQ ID NO: 132237 - protein, 376 aa, Glycine max
  Coding DNA Sequence Number=SeqID_40552
  Homolog annotation: Hit_ID=Q2HW90; Match level="QueryCoverage=95%, HitCoverage=70%, E-value=5e-43, Identity=33%"; Hit description =Putative uncharacterized protein
MGTNQTGKRFYQVKVKGLDTTSIKELGRVMEPLRMQAFRKTYGKILDLTIAEISIEAITSLTQYYDQPLRCFTFGDFQLVPTIEEFEEILGCPLGGRKPYLFSGCLPSLSRIATVVKDSARGLDRVKQTRNGIAGLPRKYLEDKARDMANQEDWVPFMDVLALLIFGVVLFPNVDGLVDLAPIDAFLAYHHSKESPVVAVLADLFDTFDRRCEKSSARIVCCLPALCVWLVSHLFQQDTRHPCPLQSHHSCTEKRRIDWDQLLAGIGGRTINWFPRWKEGKEGVLFSCGGYPNIPLIGTRGCINYNPALAIRQLGYPMRGAPMEESMSPFLVRDFGAQNFKAIQRIHKAWETPLRKDQELRGIRNGIIGGYHECLK

SEQ ID NO: 132238 - protein, 96 aa, Glycine max
  Coding DNA Sequence Number=SeqID_40553
MKTGLQHWAVMFLGQSLISSGTEAFFNNAIHKTADFFLSVEFWRMMEMNGTEGIQTGEGFFGEVFSQRSPAALMRSMISLQSKASLPSSLSKASLR

SEQ ID NO: 132239 - protein, 238 aa, Glycine max
  Coding DNA Sequence Number=SeqID_40554
  Homolog annotation: Hit_ID=A5BSR3; Match level="QueryCoverage=53%, HitCoverage=37%, E-value=3e-09, Identity=33%"; Hit description =Putative uncharacterized protein
DVRMKAQAIQKQNTAPHVLSRGGYDYLEQKLLAEKTKKKMQEAAQSGSIDGVIDPPSPIRRHVKWKMARTKKTGEMTTEAAKEIAEKIVSHVQLTITIMIRLRSRPHRGSFVPHGRQDVLAAAIGRPEHPGRVRGIGAAVDPADQGPLEESITEKVTRQGLAVPPEPLVGPSGNDPETGDSDRCGLYIEADPAGLVAMGRVYEGFTVVHNTPLLPGQVKVSVEEVTDADAPVPVPIDE

SEQ ID NO: 132240 - protein, 95 aa, Glycine max
  Coding DNA Sequence Number=SeqID_40555
  Homolog annotation: Hit_ID=A5AK77; Match level="QueryCoverage=90%, HitCoverage=10%, E-value=8e-08, Identity=37%"; Hit description =Putative uncharacterized protein
MAQPPPRERTLREMAAPDFTYKILCIQYPDEDVPYVLKTGLIHLLPKFHGLAGEDPHKLLKEFHIVCSTMKPPNVQEDHIFPKAFPHSLEGVAKD

SEQ ID NO: 132241 - protein, 200 aa, Glycine max
  Coding DNA Sequence Number=SeqID_40556
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=100%, E-value=1e-116, Identity=91%"; Hit description =Chloramphenicol acetyltransferase
  Pfam annotation: Domain name=CAT; Domain location=6-190; Score=449.9; E_value=3.4e-132; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYANPWVSFTSFDLNVANMDNFFAPVFTMGKYYTQGDKVLMPLAIQVHHAVCDGFHVGRMLNELQQYCDEWQGGA

SEQ ID NO: 132242 - protein, 94 aa, Glycine max
  Coding DNA Sequence Number=SeqID_40557
MGTNQNGKRFYQVKIKSLDVTSLKKLGWLMGPLQRQAFRKVYGKILDLTTTKPLRCFTFRDFQIVPTVEEFEEILGCPLGGKKTAIFSPGFFLP

SEQ ID NO: 132243 - protein, 71 aa, Glycine max
  Coding DNA Sequence Number=SeqID_40558
  Subcellular localization annotation: CTP_CleavageSite=52; ConfidenceScore=5.07e-01
MLATHSKYRATAKKPASNCFLTSSLIFKDISGLILRSFCLTGEDPGFNGNLCCTMSRSKPSMSWYDHAKMS

SEQ ID NO: 132244 - protein, 205 aa, Glycine max
  Coding DNA Sequence Number=SeqID_40559
MTTLAQTWSVLSYYDLAPTSHTSDVNLDRARLIYGLGVVSDTLIFESLSPAINLAYVKKNCWNPADPSITFPGTRRTRTRASTSASEAPLSTQPPSQPSSQRPRPSPASTSASLGMHGQMLRSIHVGQQLIMENMHRLSLHLQMDPPLITPEAYRQQVAWPGDQPSTDRGEEPSGAAEDPAVDEDLIADLASADWGPWADLGGGS

SEQ ID NO: 132245 - protein, 108 aa, Glycine max
  Coding DNA Sequence Number=SeqID_40560
MEMTRKGGVVLWALQMVRGVDGQQRRRKWMSPFAFSMIQPFDEVYGDFNRLNQRRIENDEVWAFWEKEARRGECGCATLLVYVAIYRRWRYVIDYKDAIIDYRLSVLV

SEQ ID NO: 132246 - protein, 67 aa, Glycine max
  Coding DNA Sequence Number=SeqID_40561
MADGKLIEMKGRVNLGIQYGQFWMRARVISKICTSMQNFAVKKMLRHDCLWKGLYILGSGSFLEEGT

SEQ ID NO: 132247 - protein, 58 aa, Glycine max
  Coding DNA Sequence Number=SeqID_40562
MTITEATGLQMRWFQNEVKEQGVKMKGRKESLFPARATHKGCESSLIQPGVFLNHSRI

SEQ ID NO: 132248 - protein, 90 aa, Glycine max
  Coding DNA Sequence Number=SeqID_40563
MNPRNVGPLCSVFNQEDLLLKTVTKSRSLEKLFLLQHALLRASEARLTGALSQGGKMRGVATNVYLWKTSEKPKEPIKSENSKFGSCIYV

SEQ ID NO: 132249 - protein, 58 aa, Glycine max
  Coding DNA Sequence Number=SeqID_40564
MVAVGGGGLDDVEAKLHDDDKGDDKKLKDQSKNNSSKSRTIQEFKLRIKKNLRLKKKV

SEQ ID NO: 132250 - protein, 118 aa, Glycine max
  Coding DNA Sequence Number=SeqID_40565
MGDFISRLSFPACLHFSEENTETFSSLTSYLELRRSEFLIGGYVGARASLLSTAPLFVTMIQELVARGDTLRLSAPRHSVTPSVIDEQRPMWSSAPFPEMSASSSGDFLKSHKLSRTT

SEQ ID NO: 132251 - protein, 149 aa, Glycine max
  Coding DNA Sequence Number=SeqID_40566
MAPTRHPLDPDKSNRALGFPALITGLCQSFGVPVAPTKVIRPPITRAFIEKYCTQRQAQGDAPQAADALPPHQAGQAESFDMEYMQSQGFASFSCPTPDQFRAEVAWPGDWPEAQAGEAPSEAPDDGEEAHEDEEMADLLDFLGGSGAT

SEQ ID NO: 132252 - protein, 138 aa, Glycine max
  Coding DNA Sequence Number=SeqID_40567
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MSSHNQATAEGKGSSYVPIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132253 - protein, 146 aa, Glycine max
  Coding DNA Sequence Number=SeqID_40568
AEFEISEASDSRTKKKLLQTVGEKWRQFKSDLTRKWVLAADQDGVDDTQVTQGSFVPHGRQDVFTAAIGCPEHPGRVRAARAGVTIKQYFGSALRTSRSSSSLPPQELQQLTQQIRDQLVESITEKVTQQLMASFSQMQSQIQSQM

SEQ ID NO: 132254 - protein, 81 aa, Glycine max
  Coding DNA Sequence Number=SeqID_40569
MVEREMITMRYDTCQFYYGEERGTCRQLGSGGKKDTLEEMAMPFQHPRGYKPSKAYTFMVPISTRNYSPPKLLEAHAGNAI

SEQ ID NO: 132255 - protein, 106 aa, Glycine max
  Coding DNA Sequence Number=SeqID_40570
MEEEGAGVSGGAEVVRASDLLPLAFLGPLNVTIGSSRFQQFFLIYAKLMAGLKFSKDLESDWTPLALHRVVIKAGNPSLDVSCCAIKEIWWEMRYPKFMSIFIMIP

SEQ ID NO: 132256 - protein, 55 aa, Glycine max
  Coding DNA Sequence Number=SeqID_40571
MSNRTSQIIEMTSLITHDQQRIMALAERFDLKALIPLKSRDSPLPLTYISPTLKE

SEQ ID NO: 132257 - protein, 68 aa, Glycine max
  Coding DNA Sequence Number=SeqID_40572
  Homolog annotation: Hit_ID=A2Q4W5; Match level="QueryCoverage=100%, HitCoverage=44%, E-value=2e-08, Identity=42%"; Hit description =Reverse transcriptase-beet retrotransposon, putative
MNIMSYNIRGLGRGIKWASIRRLVGKHKIDLLCLQETKRDSLDKALCQTLWGQSNFEWEWVPAVNTVG

SEQ ID NO: 132258 - protein, 71 aa, Glycine max
  Coding DNA Sequence Number=SeqID_40573
MEEEGGSVEEGGAGASDGAVEEALDLLPLAFLGLNLSWVKESEWTPRALHKAMIRAGKSSLEESCWAMSVI

SEQ ID NO: 132259 - protein, 113 aa, Glycine max
  Coding DNA Sequence Number=SeqID_40574
MQRLLNRNKEKPYRRIAKSSSFTLKPLSPRETYQGNPCGVYPDLSSFIGSGVYPDLSSLTGSGVYPDLSSFTGSGVYPDLSSFTGSGVYPDLSSFTGSGVIQTSVACIKRSAP

SEQ ID NO: 132260 - protein, 230 aa, Glycine max
  Coding DNA Sequence Number=SeqID_40575
MIMRGQDIYSSQDEATTSPSSSESEGAKGEESSEEIYPQEEGQPLMVKEKCKEVSVSSKRLAKKESYFEINTNIKETSPLRQPPHLLLCKKTLVSTATPLRLEIIPQVKELLDESLIHKSLNPCALSVPKIGIMRHQIHMIGGMMIMLSGATLLCKITHASNIFMILIHKDSFGVPTNPKRIKVIHKWFTPPSVDGRSPEFQNPLDLRSNPFQGGGNNAILPPRILDRRL

SEQ ID NO: 132261 - protein, 114 aa, Glycine max
  Coding DNA Sequence Number=SeqID_40576
  Gene Ontology: Mol. function=structural constituent of ribosome; Cellular component=ribonucleoprotein complex; Biological process =regulation of translation
  Homolog annotation: Hit_ID=A8AKU2; Match level="QueryCoverage=97%, HitCoverage=47%, E-value=5e-44, Identity=82%"; Hit description=50S ribosomal protein L1
  Pfam annotation: Domain name=Ribosomal_L1; Domain location=1-101; Score=64.7; E_value=3e-16; Accession=PF00687.12; Description =Ribosomal protein L1pL10e family
MRVVGQLGQVLGPRGLMPNPKVGTVTPNVAEAVKNAKAGQVRYRNDKNGIIHTTIGKVDFDADKLKENLEALLVALKKAKPTQAKGVYIKKVSISTTMGAGVAVDQAGLSAAAN

SEQ ID NO: 132262 - protein, 101 aa, Glycine max
  Coding DNA Sequence Number=SeqID_40577
MLATARDGEGVDVGTGDGSRASTEDGDGVDVGVTSRGLTGIDTEDEDGVDDGRLSRGCNSLTTYHLFFAIVPFPLESCDRGRGGLAPPDDISIYRKTYYTD

SEQ ID NO: 132263 - protein, 73 aa, Glycine max
  Coding DNA Sequence Number=SeqID_40578
MTLMHGSGKMARSVFAPCPYLRDLYGRELKRFLVIIPKVVISRLMVSRGIILFEEHTAAVGTTSNNMFSKSKL

SEQ ID NO: 132264 - protein, 255 aa, Glycine max
  Coding DNA Sequence Number=SeqID_40579
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRYLVAVGYFDPGNWATDLSGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132265 - protein, 42 aa, Glycine max
  Coding DNA Sequence Number=SeqID_40580
MAFVDTWVVGKEKTHIDPFTGKDQILKALKLHPIRRHYTDTA

SEQ ID NO: 132266 - protein, 240 aa, Glycine max
  Coding DNA Sequence Number=SeqID_40581
MRSWVRGQWIPFDADALSQFLGDPLVLEEGQECEFSQRRNRANGFDEEAIAQLLCTPGQDFARTAVGRRVRIMRTSMTTLTQMWMTLLLSNVLPSDHNSDLPLPKCMPPTRHPLDPDKSNRALWVPVTPSKVIQLPITQAFIEKYCTPRQVQGDAPQDPNAPPPPHQADPTGRPTTGGRYKYMSVSIASALVSRGKVSLLLRALRQSSLGMRSHGRRLARGPGRGGTCKIPGRCRGGPHG

SEQ ID NO: 132267 - protein, 17 aa, Glycine max
  Coding DNA Sequence Number=SeqID_40582
MALKVMAARPGELELAQ

SEQ ID NO: 132268 - protein, 122 aa, Glycine max
  Coding DNA Sequence Number=SeqID_40583
ALPRTMPRRHELAGGNGRPVGPTEARNQSWKPQGPIGLLQVHWVSLGRLALRSLGRMLLSSNVIYICVRVVMLVRMIRTRLFAAARVKSCPGMHSSCVIASLSGCARTVGRPPISGGGPGIR

SEQ ID NO: 132269 - protein, 199 aa, Glycine max
  Coding DNA Sequence Number=SeqID_40584
MGTNQNGKRFYQVKVKSLDVTSLKELGRLMGPLQRQAFRKVYGKILDLTAAEVFTEVVVSLAQYYDQPLSKIAAVIGDSAKELDRMKQTRNGVVGLPRKYLEGKARDMASQEKWGPFADILALLIFGICLTPLTGGVRKIMHGLSVVYPLFVYGRVDWDQHLAGIGGSAINWFPRWKEGKEGVIFSCGDYPNVPLIGTR

SEQ ID NO: 132270 - protein, 157 aa, Glycine max
  Coding DNA Sequence Number=SeqID_40585
MRAQREREAITQLLCIPGQDFTGAAAKKRVRIMRTKMTTITQIWMMLLLNNILPSDRNADLPPAEGSRPTRHPVDPEKSNRALGFPALMTGLCQFYGVPVAPTKFIRPPIDRAFIKKYCAPRQAHGETPQQPRDGRQRATNALPPPLEFTSAHPQKG

SEQ ID NO: 132271 - protein, 66 aa, Glycine max
  Coding DNA Sequence Number=SeqID_40586
MVVIVPKEHLVVWFCSLHNRPDNYLKGIINSLNQRLLLGGLSSSVIDKKEVLSAATMSCTGCPPSF

SEQ ID NO: 132272 - protein, 256 aa, Glycine max
  Coding DNA Sequence Number=SeqID_40587
MTATIFRSVEHQQRFEAIKGWSFLRERRVQLRYGEYIDFQEEIVRRRWASLVTPMAKFDPDIVLEFYANAWPTEEGVRDMRSWVRVLEEGQECEYGQRRNRADGFDEEAIAQLLCIPGQDFSRTAAGRRVRIMRTNMTTLTQIWMTLLLSNIQPSDHNSDLPLPKCQLVYAILTRMSIHVAQLIADAIYLFAGLAPTRHPLDPDKSNRALGFPALITGLCESFGVPVAPSKVIRPPITRAFIEKYCTQRQAQGDAP

SEQ ID NO: 132273 - protein, 93 aa, Glycine max
  Coding DNA Sequence Number=SeqID_40588
MASKKLSTKRSRRDAAAEGPSATPEFDSHRFRSAEHQQRFKAIKGWSFHRERRVQLREDEYTDFQEEIARRPWAPLVTPMAKFDPEIVLGVLC

SEQ ID NO: 132274 - protein, 75 aa, Glycine max
  Coding DNA Sequence Number=SeqID_40589
  Subcellular localization annotation: CTP_CleavageSite=31; ConfidenceScore=5.00e-01
MASGNRLPRVGFHVLKLCNSSLASGNRLPMRCNRLPEMKSLEISLLLACSGYGMHCVATAVRSLVKESTPFLFFL

SEQ ID NO: 132275 - protein, 171 aa, Glycine max
  Coding DNA Sequence Number=SeqID_40590
  Homolog annotation: Hit_ID=A5ZQM3; Match level="QueryCoverage=38%, HitCoverage=92%, E-value=3e-19, Identity=53%"; Hit description =Putative uncharacterized protein
CRKVKEVGDLMTGEPTSEAPVNGGRTYNGPKVAKFLVGCGLPAPGQKDPMKLHCFLDWLWAFLRSLGGGQRRPPLGGPEPSVRYHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 132276 - protein, 224 aa, Glycine max
  Coding DNA Sequence Number=SeqID_40591
MARNLSRAQKKSKSSKRKQECSKATLNRLDTWFTDENKKNDFKMLYTMKNGFNFPNLLKAQGLSKFMQMKGYNKMQTYRGMLLDPSRNLRNRLGVGGLTAEYRMLVYLITYILAPRSSNHVQVTNDNLQIVYGLKSDIMLKSRQLVDYEFPYVVLASKFIDYFNIDVSNEIVDSTKASNEITERHLKKLDMRYIDHEWIMVGEPPPAENMNQMEKEAQQEPAHQ

SEQ ID NO: 132277 - protein, 209 aa, Glycine max
  Coding DNA Sequence Number=SeqID_40592
  Subcellular localization annotation: CTP_CleavageSite=40; ConfidenceScore=5.44e-01
MRRQKLTVICALAFRHSRVTPSMIDGQRTMWSSAPFPEMSASSGGDSNVSLSRTTLLSRRAPETKISGHTAPFVIQRRRARRHAEKNLVISHPFAIQTQSCPMVRRDKIWSFCTLCPPEAAGPMTCGDKIWSFRTPLPFRHSRVRWRAETKIWSFCTLCHPEAAGPMTCGDKIWSFRTPLPFRHSRVRWRAETKIGHSAPFVIQRRRAR

SEQ ID NO: 132278 - protein, 58 aa, Glycine max
  Coding DNA Sequence Number=SeqID_40593
MDQAGEERKLHLIEIKSDSTNKSFKVNGHRLKPFLTNPSLVDVVVEETSLLHPTLPPP

SEQ ID NO: 132279 - protein, 292 aa, Glycine max
  Coding DNA Sequence Number=SeqID_40594
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISFQDPNGQTVETYLRDCRNLPFGGRATRDSRVRVPRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132280 - protein, 45 aa, Glycine max
  Coding DNA Sequence Number=SeqID_40595
MEKEKMSQEQAHHHRKPWIRALKVGEDEWREKQIRSTKFYASNEI

SEQ ID NO: 132281 - protein, 63 aa, Glycine max
  Coding DNA Sequence Number=SeqID_40596
MTKARQKGVRKKMGEKLATQLAQASKVASSRSNRLLEESSGPKWAWLLFAPPFLLNTPPTFFW

SEQ ID NO: 132282 - protein, 61 aa, Glycine max
  Coding DNA Sequence Number=SeqID_40597
MPLIAPVLGFEGTYGVRTSNLPLGSLEVHARCPSLPQCKALRYQLLSCFHNLVVRKNERSS

SEQ ID NO: 132283 - protein, 154 aa, Glycine max
  Coding DNA Sequence Number=SeqID_40598
ASLEEQMRQGTFVPHGREDILNTAIGRPDHGGRVRAAGSGVTISQYFGRVARGSSCSSGSISQVQLAEIIGGLQEQWKNEIQVLKHELKEQIILEMSQRGASIPTHIQPNIHVLGARVSTKGSNMETVVNSCPPNHVATVEPPMGLYVQCQDSI

SEQ ID NO: 132284 - protein, 114 aa, Glycine max
  Coding DNA Sequence Number=SeqID_40599
  Homolog annotation: Hit_ID=A5BXN6; Match level="QueryCoverage=96%, HitCoverage=6%, E-value=7e-11, Identity=39%"; Hit description =Putative uncharacterized protein
MNIPLLDAIKQIPRYAIKHSRYAKFLKELCTHKRRLKGNERISMGRNVSALIGKFVPHIPEKCKDPEGFSHGSVPIILGRPFFKTSRTKIDVYAGTLSMEFGDIVVHFNILDAI

SEQ ID NO: 132285 - protein, 185 aa, Glycine max
  Coding DNA Sequence Number=SeqID_40600
KHALRRPHRTCARARVMGEVEEIQEKMEADMEAIKEKMATMMEAMMSVKKIMEANAVAIAATSVVAKVNLMSPSGINQMNHPTSDMVGKDLGRETQEIPHHNLVDFEPWLGYATEGQAVGAPPAMAEKGEVDHLKERLRAIEGGEDYAFANLEELFLNPDMVIPKFKVPDFGKYQGTTRSKNHLK

SEQ ID NO: 132286 - protein, 80 aa, Glycine max
  Coding DNA Sequence Number=SeqID_40601
MVLFGNLVQPPIVDADSPTVLHPSRNQLLLLIFYHGEGMSARGPAYSLLMLLENRITASPLAHQQGEADIITGKLLLSSK

SEQ ID NO: 132287 - protein, 235 aa, Glycine max
  Coding DNA Sequence Number=SeqID_40602
  Pfam annotation: Domain name=zf-CCHC; Domain location=1-18; Score =21.5; E_value=0.00084; Accession=PF00098.14; Description=Zinc knuckle
MKCFKCLGRGHITSQCPTKKIMIMRGQDIYSSQDEATTSPSSSKSEEAKGEESSEEIYPQEEGQPLMVKEVSVSSKRLAKKERHFEIKTNIKEISLLRQPPHFLLCKKTLVSIATSLRLEFIPQVKELLDEGLVHKSLNPCALLVPKIGIIRHQIPKIGGMMNALGSATLICKITRAPNIFMICVHRDSLGRNNQHENTEKGVPMNPKRIKVIPEWPAPPSVLRKKAQSFKNLGI

SEQ ID NO: 132288 - protein, 31 aa, Glycine max
  Coding DNA Sequence Number=SeqID_40603
MEIQKETYLFWVYLMFAMNTKIQVAIMRKQD

SEQ ID NO: 132289 - protein, 129 aa, Glycine max
  Coding DNA Sequence Number=SeqID_40604
MAVMVARVMLGNGYEPKISLGKDNGVITSLISGKGNRGKFGLGYKPTQADIRKSVAGRKNGSQGSRLRQEDKGIPPCHISRSFISAGLGDEGQVVAICEDDAPSGSDLVRPCPPDFRLGNWQVEERPNI

SEQ ID NO: 132290 - protein, 89 aa, Glycine max
  Coding DNA Sequence Number=SeqID_40605
MPFPRRGHAIDIGIVPAKTPSGLREVQQECLSSPTKVIKPPINRAFIKKYCAPRQAQGETPQPPGDGRQRAISAPPPSLEFTSAHPQKG

SEQ ID NO: 132291 - protein, 93 aa, Glycine max
  Coding DNA Sequence Number=SeqID_40606
DFSLEREMLLSHDVKPIGACRPRLLQLDFLMLYLEDEWQRNEKEREETPLQGEDLSLEEAHHSRRPWIRAWRKKKMNKGEGEKSTKFCALNEL

SEQ ID NO: 132292 - protein, 136 aa, Glycine max
  Coding DNA Sequence Number=SeqID_40607
MEGEQLMPLSQIGRAVKPVPFTKDAAPLKPRYPSVVKPVPFPYRNSHTVPWRYAPPSERKEEATDISSLSAKVTNITGLSGVTCSGRVFAPPDLPTQPTNVMGKTKMVEEQNDKTTLTSDKDIPVKGLPEKRDGCG

SEQ ID NO: 132293 - protein, 141 aa, Glycine max
  Coding DNA Sequence Number=SeqID_40608
  Homolog annotation: Hit_ID=Q6WAY4; Match level="QueryCoverage=72%, HitCoverage=18%, E-value=2e-07, Identity=32%"; Hit description =Putative uncharacterized protein
MGTNQIGKKFYQVKIKGLDVTSLKELGRLMGPLQPLRCFVCGDFQIVPTVEEFEEILGCPLGGRKPYLFSGFLPSLSKITAVVRDSARELDRIKQTRNSVVGLPRKYLEGKARDMANQEEWVPFADVLALLIFGSYLGGLI

SEQ ID NO: 132294 - protein, 125 aa, Glycine max
  Coding DNA Sequence Number=SeqID_40609
MGIAPTKTPSGPEEVQQGPGVSSSGYGPLDRARKTPSGPEEGQQGLGVASSKYGSLSVQGSACCPQQGHQAPYQSSFHQERAIDAPPPPLEFTSAHPQKGLSIAYTTWPTNRRPSPKPKDAPSCS

SEQ ID NO: 132295 - protein, 58 aa, Glycine max
  Coding DNA Sequence Number=SeqID_40610
  Subcellular localization annotation: CTP_CleavageSite=9; ConfidenceScore=5.07e-01
MGHSILSAKSKSVQPRTISTASFQTLKFVPFNIGIEFTWATFAALVCYYLAKLCLPLG

SEQ ID NO: 132296 - protein, 249 aa, Glycine max
  Coding DNA Sequence Number=SeqID_40611
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEYLSADISQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132297 - protein, 75 aa, Glycine max
  Coding DNA Sequence Number=SeqID_40612
MSNEEVKLQDPRCRIQCPDILPENTGVAVQCKIKVKCRNFSEEDRSPPASSRCSPETQICYIIMEAARVLYQVRD

SEQ ID NO: 132298 - protein, 405 aa, Glycine max
  Coding DNA Sequence Number=SeqID_40613
  Gene Ontology: Mol. function=phosphoprotein phosphatase activity
  Homolog annotation: Hit_ID=A7UQU7; Match level="QueryCoverage=70%, HitCoverage=61%, E-value=1e-35, Identity=30%"; Hit description=IMP dehydrogenase/GMP reductase, putative
  Pfam annotation: Domain name=DUF1723; Domain location=164-213; Score =54.4; E_value=3.8e-13; Accession=PF08330.1; Description=Protein of unknown function (DUF1723)
MKIQRFKKPGWIGYRQERIYILAPAAGYCTLSQGLGREDRGDSDGAPQCRRPTASARRQRVPVTIADDVPVVPADSPAVPTDEPMVNANAQDTGVDIGAEAAADEAEGFPGEPNDPSMLTECAEHVAANIWSREEHKLGRPVLTIEEMVAGTGLSPLIMCSVDTDDQGLISSFVERWHRETSTFHLPVGEVTITLDDVASLLHLLIVGDFHAFQPLHIDEAVLMLVELLMVSLETTAARAYLLHLMGCTLFANKSATHVHVVFLDALGDLSQTRRYAWGAIGLVHMYDHLNDASISTSRQVAGYITLLQCNADLDYDKVSPRVCRWIVTKKTVKKIYIATYRQRLDRLRILDVYWMPYGEHRPLRRGPVAVRYKPERVMRQFGYVQSIPAHPVDSWVSFDDIDDR

SEQ ID NO: 132299 - protein, 237 aa, Glycine max
  Coding DNA Sequence Number=SeqID_40614
MSCSSWDEQGSEGWLASRVATARGGITGGGVGGVSGVARALTHLGPEKTIEESVGFQQFFRMEAEPRCNGLGNLGNLGRNEAAQVHVHLHHQPINESSTIDIEVKGVRGRSEVEVAENAPRLGLGAWPRWLGGWDMCGGTGSRCLEESFQRLSIKRNKLPPDPTLLRGIVLWVIDVGACEASMPLSSLELVIKLIVHGGGELHNPLWKNVPKVNVVLVVELGNLRYKMGGVPSKIPP

SEQ ID NO: 132300 - protein, 40 aa, Glycine max
  Coding DNA Sequence Number=SeqID_40615
MWICNVSHLNFWPSYAGHRVWMTPLPEREDESGKMPQGLP

SEQ ID NO: 132301 - protein, 49 aa, Glycine max
  Coding DNA Sequence Number=SeqID_40616
MGHEDEEDDDDNNNTNNNDDNDDGDDDDNGNDHVSQQQHTITHYTLSKF

SEQ ID NO: 132302 - protein, 210 aa, Glycine max
  Coding DNA Sequence Number=SeqID_40617
  Gene Ontology: Mol. function=protein tyrosine/serine/threonine phosphatase activity; Cellular component=nucleus; Biological process= protein amino acid dephosphorylation
  Homolog annotation: Hit_ID=A7PP04; Match level="QueryCoverage=73%, HitCoverage=42%, E-value=6e-63, Identity=74%"; Hit description =Chromosome chr8 scaffold_23, whole genome shotgun sequence
  Pfam annotation: Domain name=mRNA_cap_C; Domain location=32-128; Score=135.6; E_value=1.4e-37; Accession=PF03919.6; Description=mRNA capping enzyme, C-terminal domain
MEIVADNIDYQGWDDPYIPRTHEGLLKWKYAYLNSVDFLFEVDGDRELLFLNERGKKKLLEGNRVEFTDGSDPSLYSGKIIECSWDFDKLEWKYMRIRTDKSTPNEFNTYRKVLRSIRDNITEEDLLNEISEIIRLPMYADRIRIDSKANQHANVARRSMFDGSPVTATHSTSSSGNLPWKDEEGGNCVNCLAVVKMCKVQINGCGKKQC

SEQ ID NO: 132303 - protein, 645 aa, Glycine max
  Coding DNA Sequence Number=SeqID_40618
  Homolog annotation: Hit_ID=A7PP05; Match level="QueryCoverage=87%, HitCoverage=65%, E-value=0.0, Identity=66%"; Hit description =Chromosome chr8 scaffold_23, whole genome shotgun sequence
  Pfam annotation: Domain name=FG-GAP; Domain location=125-154; Score =21.1; E_value=0.0042; Accession=PF01839.14; Description=FG-GAP repeat
  Pfam annotation: Domain name=FG-GAP; Domain location=413-437; Score =9.7; E_value=0.43; Accession=PF01839.14; Description=FG-GAP repeat
  Pfam annotation: Domain name=FG-GAP; Domain location=494-523; Score =30.2; E_value=7.3e-06; Accession=PF01839.14; Description=FG-GAP repeat
  Pfam annotation: Domain name=FG-GAP; Domain location=540-569; Score =25.0; E_value=0.00028; Accession=PF01839.14; Description=FG-GAP repeat
  Pfam annotation: Domain name=FG-GAP; Domain location=77-102; Score =20.7; E_value=0.0053; Accession=PF01839.14; Description=FG-GAP repeat
  Pfam module annotation: Pfam domain module=FG-GAP::FG-GAP::FG-GAP::FG- GAP::FG-GAP; Domain location=125-154::413-437::494-523::540-569::77 -102
MKPCLRTKPLLLLLSLLLLHNITFVLSDDSSRKNTFREREASDDSLGYPEIDEDALVNSKCPKNLELRWQTEVSSSIYANPLIADINSDGKLEIVVPSFVHYLEVLEGADGDKMPGWPAFHQSTVHSSPLLYDIDKDGVREIALATYNGEVLFFRVSGYMMSDKLEVPRRKVLKKWFVGLDPDPVDRSHPDVHDDQLVQDATIKNSMSQMNGSRHEAKSSAATSTENHLETKNLSNPEPEKKINGSQVDESIKVPNPEPEKKINGSQIDEIIKVPNPEPEKKINGSQVDESIKVPTVVDNSSVNAGSLETVHADNKTSTGRRLLEDNNSKGAVQGSSESKVKEGIHAATVENDEGLDADADSSFELFRNSEDLADEYSYDYDDYVDETMWGDEEWTEVKHEKLEDYVNVDSHILCTPVIADIDNDGVSEMIVAVSYFFDHEYYDNQEHRKELGDIDIGKYVAGGIVVFNLDTKQVKWTAELDLSTDTSNFRAYIYSSPTVVDLDGDGNLDILVGTSYGLFYVLDHHGKVRQKFPLEMAEIQGAVVAADVNDDGKIELVTADTHGNVAVWTPKGDLIWEKHLKSLIPQVEKNIRGSGCITPVLYLVHFPLALGILLDVLEDEKRLKDEEIEHATIEESMQQCAGLQ

SEQ ID NO: 132304 - protein, 36 aa, Glycine max
  Coding DNA Sequence Number=SeqID_40619
MALSAPSRFMEPNRRRAYANDALSMTLAQMTEVMQA

SEQ ID NO: 132305 - protein, 82 aa, Glycine max
  Coding DNA Sequence Number=SeqID_40620
  Gene Ontology: Mol. function=translation initiation factor activity; Biological process=translational initiation
  Homolog annotation: Hit_ID=P56821; Match level="QueryCoverage=100%, HitCoverage=11%, E-value=1e-22, Identity=63%"; Hit description =Eukaryotic translation initiation factor 3 subunit B
MANVMVMKEIKGTVLRLGVDLFTLDLDAIRLPPGEDCSIASDDEVVYREENLEFESGFGNIIIVDNLLVVPREKFEKLEGVV

SEQ ID NO: 132306 - protein, 187 aa, Glycine max
  Coding DNA Sequence Number=SeqID_40621
MRLASSSSFNEEIKQIYHISIILNSTFVPLGISLSICRTCLLQKIRPIPRSCDSGSELLGSRPWPNDACTRAYGAPSFACELRWTLEMVADVEAVVVCLWLATAVGLAPTVRPMINVENPSALLDLSGSTGPTNIWVEGDQSYGHWEGVTEQAHHLDLSQSGHANVHDPYPPPCSLREKSCPGEQSS

SEQ ID NO: 132307 - protein, 86 aa, Glycine max
  Coding DNA Sequence Number=SeqID_40622
  Subcellular localization annotation: CTP_CleavageSite=73; ConfidenceScore=5.07e-01
MNGLSAPAALSLFIATVKILDFQMIALSGPSLSLACQAKHHFASVVSPLNKAKCSYCAKPLLCVEEVELSVPCCAKLNSLTVFEFL

SEQ ID NO: 132308 - protein, 70 aa, Glycine max
  Coding DNA Sequence Number=SeqID_40623
MEVEEWKVVIFVAKVEAHNVAPCRACRPWILFITRVLCFLKITGGIGSSSSVAMGCSKQMLNSPLGWSEI

SEQ ID NO: 132309 - protein, 234 aa, Glycine max
  Coding DNA Sequence Number=SeqID_40624
MGSDQASSFKKRCFTFGDFQLAPTIKKFEGILGCPIGGRKPYLFSGYYYSMARIAGVVKISKRELDQVKKSKNRVAGIPGKYLEEKAETLVRHQRRPSPFIMRGFDEANAKILQRICKAWNKVGRKDKELRGSSNGVIGDYHKWLKSRTQGITWLQKLKCLNGEEAEVPEESEEMQALKAELEKTRVAKEKPKVAVTRVRKECDELKDINMTTAEALERETKKARKEEWSRNKF

SEQ ID NO: 132310 - protein, 18 aa, Glycine max
  Coding DNA Sequence Number=SeqID_40625
MARMKIEHDSVRGATTIV

SEQ ID NO: 132311 - protein, 52 aa, Glycine max
  Coding DNA Sequence Number=SeqID_40626
MTPSQQHDAPIPTPNTPLGIDLRDQFSTEANEVEAGRHRGRRNPDRQVRRWD

SEQ ID NO: 132312 - protein, 169 aa, Glycine max
  Coding DNA Sequence Number=SeqID_40627
MQTASPIGEFALATTRGVCSGLVTVIDDLAMQRGLATLFKLGITNTTGDLCLDGIANTTGDLSSFYESLPPKHTKHIQLNARSTLTWPSNLSHKNDDLELIHRWIVVKFKKHVCNPFPNILTVGNFDITEKKESHEDSPNGGFNPFSVSLTFGNSIGAVGGKTGGILGN

SEQ ID NO: 132313 - protein, 156 aa, Glycine max
  Coding DNA Sequence Number=SeqID_40628
  Homolog annotation: Hit_ID=Q8H6Q8; Match level="QueryCoverage=46%, HitCoverage=2%, E-value=2e-07, Identity=35%"; Hit description=CTV.20
MNTCASRVLLKPQRGETTLLITDMTKANVSLPITIKWDEVTLPKKWIMDKATPSVPRPAPTIEQIKQNNSDKVEITFKRRNSFSFKIEASRSEYESARRSFSKLRNLNLEPSIEEQINNLLIETSEKETEDVSSEENLNLIQRDDQPPSTDDEDTQ

SEQ ID NO: 132314 - protein, 93 aa, Glycine max
  Coding DNA Sequence Number=SeqID_40629
MEMVINNETNLHGKRWREALREAAGISGVVVLNSRCHTSGKSFPSRVVNLSVHRVYLEFIESTQNMLKKSLHMSQLTEKINEEESNRQKKLEQ

SEQ ID NO: 132315 - protein, 220 aa, Glycine max
  Coding DNA Sequence Number=SeqID_40630
  Gene Ontology: Mol. function=transporter activity; Cellular component= membrane; Biological process=oligopeptide transport
  Homolog annotation: Hit_ID=A7PP13; Match level="QueryCoverage=88%, HitCoverage=46%, E-value=2e-34, Identity=56%"; Hit description =Chromosome chr8 scaffold_23, whole genome shotgun sequence
MSKKETTKVHTTLADKPRCPLERRNSQLQTDKVQVPSDKYLLYEIGDEEFDIRGSRKLNHTQQLSFFDKANVVTPSYKIKGTMNPWRLYCTVSQKHHKPQEQFHTAFQRIEIGLVISIFAMFVFGTLEFLRLREVKNYNYYNLKHMLMSIFWQVPQYFIIGFAEVFTFVGKLKFFYEQAPTCNESLCSSLSLTTVALRSYLSIMLVNVVTDVSTRHGGSG

SEQ ID NO: 132316 - protein, 84 aa, Glycine max
  Coding DNA Sequence Number=SeqID_40631
  Gene Ontology: Mol. function=oxidoreductase activity; Cellular component=intrinsic to mitochondrial inner membrane
  Homolog annotation: Hit_ID=A7NYD9; Match level="QueryCoverage=55%, HitCoverage=11%, E-value=3e-11, Identity=62%"; Hit description =Chromosome chr6 scaffold_3, whole genome shotgun sequence
MEDAPVSPASPSHRRWFVREVMLHVLKAYSCQFEIEPQVAERQGKANGGRANSAKDVDFGDQFVYKHMGSMASIGSYKALVDLR

SEQ ID NO: 132317 - protein, 92 aa, Glycine max
  Coding DNA Sequence Number=SeqID_40632
MAGAGDGGALVTGRDDYTNATFVLNRNSEEPYGRIEGQEHQMNQNVGRPYGGIRRGNNGPRQNRMEWQNRIEGVKLSIPPFKGESDPNAYLD

SEQ ID NO: 132318 - protein, 344 aa, Glycine max
  Coding DNA Sequence Number=SeqID_40633
  Homolog annotation: Hit_ID=Q6WAY6; Match level="QueryCoverage=56%, HitCoverage=34%, E-value=5e-11, Identity=29%"; Hit description =Putative uncharacterized protein
MGMRGCINYNPVLAIRQLGYPMRGAQLEEVIMPFIMRGFNEANLKILQKIRKAWNRVGRKDKELKGSSNGDIGGYHKWLKSRMQGITWLPKLKSLSGKKAEILEENEEVQVLKVELKNTRVVKVKLKTTITRVRKEYDEEQVPRGSMGSSNELKLRRAESGESRMESMVLEGKLKACQRSKRSLTEQLSKIEDNMLIIINQYKEKVNLVASHGQMLEDEHAKSQELPRLLAKAKAVVDMYSALDEVHSLFNYYQHMADMEAMKDQMTTMMSMRKMMEVNAATIATTSVATKVDPTHLFSVNQVQSKHPFLLYGLPPNYAPPSAVHVPEENVDHSSPIPLKGQQP

SEQ ID NO: 132319 - protein, 168 aa, Glycine max
  Coding DNA Sequence Number=SeqID_40634
  Homolog annotation: Hit_ID=A5AK77; Match level="QueryCoverage=55%, HitCoverage=11%, E-value=3e-11, Identity=38%"; Hit description =Putative uncharacterized protein
MTRGNPGDLQPFDPEIDRTIHRLVRHSVHPDHSVHFEHFVHSEYSVAGDSEYSDFEHSTTNFHTENMDQPPPHERTLREMAGPDFTYENLCIQYPDEGVPYVLKTGLIHLLPKFHGLAGEDPHKHLQEFHIVCSTMKPPNVQEDHIFLKAFPHSLEGVAKDWLYYLAP

SEQ ID NO: 132320 - protein, 330 aa, Glycine max
  Coding DNA Sequence Number=SeqID_40635
  Gene Ontology: Mol. function=sugar:hydrogen symporter activity; Cellular component=integral to membrane; Biological process =carbohydrate transport
  Homolog annotation: Hit_ID=A4L9G5; Match level="QueryCoverage=93%, HitCoverage=83%, E-value=1e-118, Identity=68%"; Hit description =Putative integral membrane protein
  Pfam annotation: Domain name=DUF6; Domain location=28-154; Score=5.5; E_value=0.033; Accession=PF00892.11; Description=Integral membrane protein DUF6
  Pfam annotation: Domain name=TPT; Domain location=163-308; Score= -21.5; E_value=0.01; Accession=PF03151.7; Description=Triose -phosphate Transporter family
  Pfam annotation: Domain name=UAA; Domain location=15-314; Score= -144.0; E_value=0.0034; Accession=PF08449.2; Description=UAA transporter family
  Pfam module annotation: Pfam domain module=DUF6::TPT::UAA; Domain location=28-154::163-308::15-314
MGSDGEGNWYTSLAHQISMYGVAAGYCLSASLLSIINKWAVMKFPFPGALTAMQYATCTAAVVLCGRLKLLEHDPLDLKTMWRFLPAAILFYLSLFSNSELLLHANVDTFIVFRSVVPLFVAVGETLFLHQPWPLTKTWASLATIFAGSVLYVITDYQFSFMAYTWALAYLVSMTIDFVYIKHVIMTIGLNTWGLVLYNNLEALLLFPLELLIMGELEKMKREIKHDSDWHSFQVILPVLLSCLLGLSISFFGFSCRRAISATGFTVLGVVNKLLTVVINLVIWEKHSTWVGTVGLLICMLGGVMYQQSTSKPNNAAKQENEEEQLKLVD

SEQ ID NO: 132321 - protein, 209 aa, Glycine max
  Coding DNA Sequence Number=SeqID_40636
  Pfam annotation: Domain name=G-patch; Domain location=44-88; Score =6.8; E_value=0.029; Accession=PF01585.14; Description=G-patch domain
MSCPSSTPYMEAVEESLETSFQELEIVNNAYVDAPPVQPRLSSASLMVARVMLRDVYEPEIGLGRNGNGTTSLVRFVENHGRYGLGYEPTHADKRKVALERKERSLAYLQGRGPQIERVPICHISKSFVSVGWMHQNQVVVLDEETNQKQPSWVQRKNEKEVKPYQEETKVVNLGIGGEKKEVKVSTCMSAKVRDEFVTLLGDYQDIFA

SEQ ID NO: 132322 - protein, 326 aa, Glycine max
  Coding DNA Sequence Number=SeqID_40637
MIQGERNVKLYITEFDEFRRELERRNLHKRLTNLADGSIDVAMVREFYTSLYDPKDNSPKKVRVRGNLIKFDADTLNTFLETPVVLEPRETISTYSRFCRLRMDPQEIVANLYIPSRGFVLNTEGMPWKLLRRDLTTLAQTWSVLSYSNLALTSHTSDLNLDKALLVYGLVMRMDMNIGALISGQISFIVQSKSSRLEFPTLITALCKARGVTFDSLSYDSLSPTIDLAYIKKNCWNLDEPSVYFLGTRKARARAAEIPSSSTPEDPPVPTSSPSPAPTHPGPSTDLIMVMLQRLYHGQYLLMHNFQNLAQHQPFISLEEFTRQVA

SEQ ID NO: 132323 - protein, 87 aa, Glycine max
  Coding DNA Sequence Number=SeqID_40638
SALKGPYDTPQSKSKAGARWIVVKCNKQEGSTECGYYVMHWMSSIILGSFRNNWKTYFNDVRPLEAERLKALRIQWTQYYLKVENQT

SEQ ID NO: 132324 - protein, 76 aa, Glycine max
  Coding DNA Sequence Number=SeqID_40639
MVSEQTLTLGPRIRLRCDKHPPFVVHAPSPISAGREGVLVVRGGTSGSGDDSNRSVTIIMMIKAKNSQPLEMRPIN

SEQ ID NO: 132325 - protein, 63 aa, Glycine max
  Coding DNA Sequence Number=SeqID_40640
MRGLNESNWEGVLQHGSLTWLAAQARIYDRDQEQGWIHNKRGWAVAWWQLAPLNEANTADAVK

SEQ ID NO: 132326 - protein, 115 aa, Glycine max
  Coding DNA Sequence Number=SeqID_40641
MGKSLSLEQHTYDLAEVFEKLEKLNSRLNPEKCTFRVGREPIKSQCLVDFIVELPPITSNNDGDDWWMLYVGGAGITLEGPGQILLEQSLRCKSDSKLAMVISKPNMHRCRNTTT

SEQ ID NO: 132327 - protein, 311 aa, Glycine max
  Coding DNA Sequence Number=SeqID_40642
MSYSIFGGDESSVVCQKSMLDTKYFGIGEESESSSGSFVCLFHSDEETFQNLMKGTKVTSNVNVFVSDINAIPIESNEDEEKYVFDRIWDEPDIGGDNIVVGGGGLGRKGIKFPLVTISNYTWVTGEVVVYSSIFQHTSSIADLKSKVSITHFNDLDWVIVDHCLSKAWVYLSADQLLSPKERQDAVIIMEFPRRMNIKKVLNLPYCGNVENTLEASIVDLMKPKEGKHYDKEVGKFCDKNDQPQVKVARIMEIGSTNFEKEKKKNKSPEKEKEIPKTINVEEPTIDGGNPPDVTQPRNMDKPITTLDEAA

SEQ ID NO: 132328 - protein, 176 aa, Glycine max
  Coding DNA Sequence Number=SeqID_40643
  Homolog annotation: Hit_ID=A7P5G1; Match level="QueryCoverage=22%, HitCoverage=13%, E-value=6e-07, Identity=67%"; Hit description =Chromosome chr4 scaffold_6, whole genome shotgun sequence
MCNAGKGAEKYFKHGSRLKWHEGAISRESISAVKKLGHLKDEVCNATKFDLPNKDRKDSQGICFLGKVCGVSSSFTSYLFHGAGFGSKRKYMFRKVTIQLKLVEGDSIETGPFLFNNEHNLRCTYSAQCIELFSSSDNPICINELNITSLGIMEIPICLGGSISSSGSTLYVLMFS

SEQ ID NO: 132329 - protein, 70 aa, Glycine max
  Coding DNA Sequence Number=SeqID_40644
MTNTKHYSLPCIDHNYKNASLNYLQSTMSPVEPLRYINTSRDFGASTYRQQTPFLGNDANDDVAQATRRF

SEQ ID NO: 132330 - protein, 124 aa, Glycine max
  Coding DNA Sequence Number=SeqID_40645
  Homolog annotation: Hit_ID=A2Q4L4; Match level="QueryCoverage=66%, HitCoverage=9%, E-value=2e-11, Identity=44%"; Hit description=RNA -directed DNA polymerase
MGVSYMGEEEDMVNHMKHMEERDQKEIEQVKKKKKEKKEVDSGRSWWCIGEVVRKRIGCLIGDFNNVRRTCERKRVGGIELGRRERTDFNNFIDNTELEDVSLLGRKFTWLRPSGTTRSRIDRA

SEQ ID NO: 132331 - protein, 170 aa, Glycine max
  Coding DNA Sequence Number=SeqID_40646
MAKPDTSALSELSARLTLSSNSLTRAKRENGAKRDIEIRNLEFIFFLNCLTVVPVSVCTRRSSVGELVPLDLEIEATFRRNNAERKRKLLHDRTVASILEEAHFSESSSSNSSTSRESQTAEFEVEVMAEEQPRRVTLEDYSSTFVPQYFLSVAQPEVQAQNLTYPPSLI

SEQ ID NO: 132332 - protein, 247 aa, Glycine max
  Coding DNA Sequence Number=SeqID_40647
  Pfam annotation: Domain name=Transposase_24; Domain location=91-222; Score=-24.1; E_value=0.072; Accession=PF03004.5; Description=Plant transposase (PttaEnSpm family)
  Subcellular localization annotation: CTP_CleavageSite=63; ConfidenceScore=5.82e-01
MPVSPHDVAPTPSPPPTEARPFVCHLNARGLSSVPTSTPSPSLVHARGPSSVPTSTPSPSPAIANMPTDEDATNLAMEDHPLNDCPMIMLINGAFHPSKVPTKAVSLSIRQQFGGSISLQDHVIRLSEELGQSVYVDDVFQQTHLRKDTGQFVNDRSRQTHEEFEARLSQARSDTTSSVGESQLTPLDPTEEQRLRSRCWVATAGPKCKGHLYGTGDLAHAFKCENENFMQHIQGFSSGAKDVAEIN

SEQ ID NO: 132333 - protein, 179 aa, Glycine max
  Coding DNA Sequence Number=SeqID_40648
MASRKRKALASVSQARYDRSRFVSQDAWDRYANNVLSLKILPERNVKLYITEFDEFIREIERRNWHKELTNFSEGRIDVAIVKEFYANLYDPEDKSPKGRGELARLLQNLDDPSVTFRGTQKSRARRSEASSTSAPPTLAPSTSAPSTSPLPPALAPPVLTGFPAQSLEHSLSMLQSLH

SEQ ID NO: 132334 - protein, 106 aa, Glycine max
  Coding DNA Sequence Number=SeqID_40649
MTRGNPYDLQPFDPEIDRTFHRLVRHHLVPFEHPEHSIFGDFEHYSFEHSDFEHSENMAQPPPREDPHKHLKEFHIVCSTMKPPDVQEDHIFLKAFPHSLEGVAKD

SEQ ID NO: 132335 - protein, 106 aa, Glycine max
  Coding DNA Sequence Number=SeqID_40650
  Homolog annotation: Hit_ID=A7Q9M1; Match level="QueryCoverage=83%, HitCoverage=23%, E-value=2e-10, Identity=40%"; Hit description =Chromosome chr5 scaffold_67, whole genome shotgun sequence
MASIYDCREASNEKARTEKDVALQLGLKIDGLSVTDIITGDVRVACQALLGETPPDKYVKGKIIYQSWLWQNFQQLHIDSEDVVIAQHARAHIMMHIGCCLMPDTS

SEQ ID NO: 132336 - protein, 322 aa, Glycine max
  Coding DNA Sequence Number=SeqID_40651
  Gene Ontology: Mol. function=transporter activity; Cellular component= mitochondrial inner membrane; Biological process=mitochondrial transport
  Homolog annotation: Hit_ID=A9PAU0; Match level="QueryCoverage=86%, HitCoverage=90%, E-value=1e-142, Identity=88%"; Hit description =Putative uncharacterized protein
  Pfam annotation: Domain name=Mito_carr; Domain location=133-228; Score=109.0; E_value=1.4e-29; Accession=PF00153.18; Description =Mitochondrial carrier protein
  Pfam annotation: Domain name=Mito_carr; Domain location=233-320; Score=116.4; E_value=8.4e-32; Accession=PF00153.18; Description =Mitochondrial carrier protein
  Pfam annotation: Domain name=Mito_carr; Domain location=39-127; Score= 62.4; E_value=1.6e-15; Accession=PF00153.18; Description =Mitochondrial carrier protein
  Pfam module annotation: Pfam domain module=Mito_carr::Mito_carr::Mito_ carr; Domain location=133-228::233-320::39-127
MDEESSFVDDLFCIIGGLHGDSMLYIVDFCPEIDLACYIFVTDFLVCTIPLDTAKVRLQLQKQAVAGDVVSLPKYKGMLGTVGTIAREEGLSALWKGIVPGLHRQCLYGGLRIGLYEPVKTFYVGKDHVGDVPLSKKILAAFTTGAFAIAVANPTDLVKVRLQAEGKLPPGVPRRYSGSLNAYSTIVRQEGVGALWTGLGPNIARNGIINAAELASYDQVKQTILKIPGFTDNVVTHLLAGLGAGFFAVCIGSPVDVVKSRMMGDSSYKNTLDCFIKTLKNDGPLAFYKGFLPNFGRLGSWNVIMFLTLEQTKKFVKSLESS

SEQ ID NO: 132337 - protein, 58 aa, Glycine max
  Coding DNA Sequence Number=SeqID_40652
MMAHHPPWRCSGRQIRRAPLELVGLGSSSSMDSFASWKMNGSGMKKGRERGDTTSRRR

SEQ ID NO: 132338 - protein, 133 aa, Glycine max
  Coding DNA Sequence Number=SeqID_40653
  Subcellular localization annotation: CTP_CleavageSite=49; ConfidenceScore=5.62e-01
MATPPASPPPPLLPPHADASASPSTLKQTGKATRLRSLATRPPGVERVVVNIDPATGKAEGPHKKKLRTYLGIVACDKVDVTYETWKEVPAAQKDLICEDIQDVQKNICVMYRILWKSRRHRDGSSPMDVRMS

SEQ ID NO: 132339 - protein, 161 aa, Glycine max
  Coding DNA Sequence Number=SeqID_40654
MEKLGLRGGACHLARPGEQGCFLQKQQPSGGRIWKAQLSKKLRKLTDYAKTPLFDFRHITEFHGSLRATTSLDDESERSAIPPTGEVGRSTVSPADESGGAAASSDDTSEMIIRGGHGETTSRSGEDSEFTTGDYGSTGSGSTCTGVGSGGAASLGLTNGS

SEQ ID NO: 132340 - protein, 85 aa, Glycine max
  Coding DNA Sequence Number=SeqID_40655
MTSTNLLGLKVMPKDVVKEVKDKMTMELALWNENDYLCNNFILNVLADDLYDYYSLYKSAKLVWLTFEEKYDTEEAGTKKYAVSR

SEQ ID NO: 132341 - protein, 49 aa, Glycine max
  Coding DNA Sequence Number=SeqID_40656
MTISEKIIVNKYEKAATAKYLVRCSEKARSPTPINIGTGNGIKGMIHEY

SEQ ID NO: 132342 - protein, 46 aa, Glycine max
  Coding DNA Sequence Number=SeqID_40657
EIKSESTDKSFKVNGHRLKPFLTNPFLVDVMVEETSLLHFVWGFLG

SEQ ID NO: 132343 - protein, 82 aa, Glycine max
  Coding DNA Sequence Number=SeqID_40658
MSTHHILGLKKVPRGELRGANPSTRGLGWANLWCTGCYANSSAGLLSWYGRTAAPREILLYTSSRTRFLNRTSIGERCKHRE

SEQ ID NO: 132344 - protein, 152 aa, Glycine max
  Coding DNA Sequence Number=SeqID_40659
MVKEECKEVNVSSKRLAKKERHFEIKTNIKEISLLRQPPHFLLCKKTLVSIATSLRLEFIPQVKELLDEGLVRKRLNPCALLVPKIGIINMKIKKSDQGLSMDPKRIKVIPEWPTPSNVKERIHEFQEPLDLRSNPFQGGGNDAILPPKGIG

SEQ ID NO: 132345 - protein, 149 aa, Glycine max
  Coding DNA Sequence Number=SeqID_40660
MSIHVAQLIADAIYLFAGMAPTRHPLDLDKSNRALGFPALITGLCQSFGVPVAPSKVIQPPITRAFIKKYCTQRQAQGDAPQAADAPPPHQAGPAGSFDTEEYLWHLVRQQAANHRAHAPAEAPDEADEAREDEEMTDLLDFLGGSGAT

SEQ ID NO: 132346 - protein, 100 aa, Glycine max
  Coding DNA Sequence Number=SeqID_40661
MGVFIVGARSRYRGQNKFGCQGVGLGPNFHIIPQGTRDNDDLKTTCKISHGYSQVDTQAFHLWPYDTTVGNLHKQTQCFQIMFSHQFNEFIHSYFGYFGK

SEQ ID NO: 132347 - protein, 98 aa, Glycine max
  Coding DNA Sequence Number=SeqID_40662
VPVNPKRIKVTPEWPTPPTPLIELVRNHVPSWEDAQEMGVEGRSPKYEEPRDLRSNPFQVLASHLKEVSLAIRELLKEVFSKKLLKEVFSRKLLKEAT

SEQ ID NO: 132348 - protein, 178 aa, Glycine max
  Coding DNA Sequence Number=SeqID_40663
  Homolog annotation: Hit_ID=Q6UUU1; Match level="QueryCoverage=65%, HitCoverage=97%, E-value=3e-37, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRRLSHSTPDTQFRVGSSLQAGLYARTPRSVRPLRLI

SEQ ID NO: 132349 - protein, 88 aa, Glycine max
  Coding DNA Sequence Number=SeqID_40664
MDYAAMLFDASSIGACRPRIFFINGFLCFLEDEWQRNGERERERRRHFKEKMSLEEAHHHRGPWIRAWRKKEMNEGRGREEHEILCSK

SEQ ID NO: 132350 - protein, 45 aa, Glycine max
  Coding DNA Sequence Number=SeqID_40665
MLSMFDQQGRPSGKESIHWLTDDEKDSIHVHVLINCAEVKPYLEL

SEQ ID NO: 132351 - protein, 133 aa, Glycine max
  Coding DNA Sequence Number=SeqID_40666
  Gene Ontology: Biological process=transposition, DNA-mediated
  Homolog annotation: Hit_ID=Q1J7G7; Match level="QueryCoverage=24%, HitCoverage=47%, E-value=1e-11, Identity=96%"; Hit description =Transposase
MGKVGTSYVPINVSFSPKVWPRASRYQQGHQDLFILRSDLPSQVLQWLLFLSAVPPVQLLTGWCVTAKAPPDISAGKCSGHAAGRVPFAIQAAQLLGRAIGAGLFPITPAGERGMCCKPIKLGNARVFPVTTL

SEQ ID NO: 132352 - protein, 64 aa, Glycine max
  Coding DNA Sequence Number=SeqID_40667
MAPYKALYGRRCRTPLCWLDPKENLTLEHEVANKAPKRRGKEIPLVKVIWGGASGEDITWELEI

SEQ ID NO: 132353 - protein, 55 aa, Glycine max
  Coding DNA Sequence Number=SeqID_40668
MGEDSWSHEYMNLFGGTERFEQLKLSLLVDGFSKVSVDKWMDITDIGYVIASRFI

SEQ ID NO: 132354 - protein, 174 aa, Glycine max
  Coding DNA Sequence Number=SeqID_40669
METCLGVEELLQRMIDQGRQEVGSEGREEQHICMQSTDGSIVAKPKPLVIYFTKGTASQKPGHPLAAKPVPFPYQNSHAVPWRYTPPRGKEEEAPDVSSLSAKVTNITGLSGVTRSGRVFAPADLPVQPANVKGKAKVVEEEDDEAPLTSNKDISAKGLPEKKDGKKEVSLEEA

SEQ ID NO: 132355 - protein, 331 aa, Glycine max
  Coding DNA Sequence Number=SeqID_40670
  Gene Ontology: Mol. function=unfolded protein binding; Cellular component=plasma membrane; Biological process=response to stress
  Homolog annotation: Hit_ID=Q02FR1; Match level="QueryCoverage=97%, HitCoverage=50%, E-value=1e-173, Identity=97%"; Hit description =Chaperone protein dnaK
  Pfam annotation: Domain name=HSP70; Domain location=8-331; Score =312.9; E_value=6.1e-91; Accession=PF00012.11; Description=Hsp70 protein
  Pfam annotation: Domain name=MreB_Mbl; Domain location=75-331; Score=- 264.3; E_value=0.0069; Accession=PF06723.4; Description=MreBMbl protein
  Pfam module annotation: Pfam domain module=HSP70::MreB_Mbl; Domain location=8-331::75-331
PGYHQLWVGILENGYVKVIENAEGARSTPSIIAYTNDGETLVGQPAKRQAVTNPQNTLYAVKRLIGRRLEENVVQKDIQMVPYSIVKADNGDAWVEVKGQKMAPPQISAEVLKKMKKTAEDYLGEPVTEAVITVPAYFNDSQRQATKDAGRIAGLDVKRIINEPTAAALAYGLDKAKGDHTVIVYDLGGGTFDVSVIEIAEVDGEHQFEVLATNGDTFLGGEDFDIRVIDYLVDEFKKESGINLKGDPLPMQRLKEAAEKAKIELSSTQQTDVNLPYVTADASGPKHLNVKVSRAKLESLVEDLVQRTIEPSRPALKYAGLDVSDIHEVIL

SEQ ID NO: 132356 - protein, 113 aa, Glycine max
  Coding DNA Sequence Number=SeqID_40671
MDNKCFELGVEGPGRTGAGAEGGRADVDVDEADVEEAEEGGAEEDVTSYPLPLDLRVPQKVTEGSSRFQQFFLTYAKLMAGLKLLKVKESEVTPRALHKAVMRVGKPSLEESC

SEQ ID NO: 132357 - protein, 97 aa, Glycine max
  Coding DNA Sequence Number=SeqID_40672
MGDQTKSMQQSSTDRSNEHVLHLLFNRNPQLRVLAFHGKEAPFTIKKGNQEKSLACTEGGMSLPPLGTSQSLKSSLISLKVDNLAPCSASSFSTVHT

SEQ ID NO: 132358 - protein, 106 aa, Glycine max
  Coding DNA Sequence Number=SeqID_40673
THLLLEVASPLSLPSPFRCHLSSKKQRNQLMKKILGLQAPMELASWTLADGGHCAQGTPSCLPKSKAPARWIVIKYFNDPRPLEPERLKALQIQWAHYYLRVRDQT

SEQ ID NO: 132359 - protein, 44 aa, Glycine max
  Coding DNA Sequence Number=SeqID_40674
RELYLRFEEGISTSYVDKSGAFAPTYPPLERKSDLRSSYLCVKQ

SEQ ID NO: 132360 - protein, 41 aa, Glycine max
  Coding DNA Sequence Number=SeqID_40675
MSWNFTDCLTMGVKFLEAVKQRLHAIKQWSPDEIRGLIRQE

SEQ ID NO: 132361 - protein, 94 aa, Glycine max
  Coding DNA Sequence Number=SeqID_40676
DIQNYPVDVVNKAISFFEEYKKEKLKIVQTPIGWQAPPHGVYKINTDAAIFNLQGIGCLLHPALPSLTARAIDLDELAVAALFSFLKQGISFHS

SEQ ID NO: 132362 - protein, 43 aa, Glycine max
  Coding DNA Sequence Number=SeqID_40677
MAEINQGKTMTDHDWPCIFVSYLQVSSPGRAELAWASNPCTKI

SEQ ID NO: 132363 - protein, 55 aa, Glycine max
  Coding DNA Sequence Number=SeqID_40678
VDSRGSPGRPLGSGYLDHVIDWCFLKKMKRRNLSERRYGKKIAIIFFRHDNTSLK

SEQ ID NO: 132364 - protein, 51 aa, Glycine max
  Coding DNA Sequence Number=SeqID_40679
MLLTPYDVAPCRAWEWRRKKDDWRCHFKEKMSQAQAHHHRKPWIRASRRRR

SEQ ID NO: 132365 - protein, 215 aa, Glycine max
  Coding DNA Sequence Number=SeqID_40680
  Gene Ontology: Mol. function=motor activity; Cellular component=cell projection
  Homolog annotation: Hit_ID=UPI00016621D1; Match level="QueryCoverage =98%, HitCoverage=40%, E-value=2e-20, Identity=32%"; Hit description =UPI00016621D1 related cluster
GLHAITFRELHVLAIRGPHVLAFRGLHALSFRGLHTLAFRGLHLLTFRGLHVLAFRGLHVLAFRRLHVLAFRGLHIFAFRGLHILSFKGLHVLAYRGLHVLAYIGLHILTFRGLHALTFIGLHALAFRGLHVLAFRGLHVLAFRGQHALAFRGLHILTFRGLHVLAFRGLHVLAFKGLHVLAFRGLHAFTFRGLHALAFIGLHALTFRGLDVLAF

SEQ ID NO: 132366 - protein, 239 aa, Glycine max
  Coding DNA Sequence Number=SeqID_40681
  Gene Ontology: Mol. function=hydrolase activity, hydrolyzing O -glycosyl compounds; Cellular component=cell outer membrane; Biological process=polysaccharide catabolic process
  Homolog annotation: Hit_ID=A5FD25; Match level="QueryCoverage=98%, HitCoverage=22%, E-value=2e-69, Identity=52%"; Hit description=TonB -dependent receptor, plug precursor
MQIRIRGTRSLTGDNNPLIVLDGIPFVGSLGDISSSDIKSIDILKDASATAIYGSRGANGVILVTTNRGAKGQKPRFTYNTFTGVQTLFSKYPMMDGPKFAQLRAYAIPAGNTTPLYSNGADESNSVNTDWQSLYYKPAMMTSHDIGVSGGTDGGNYNVGLSYFKQDALIPIQSYERFALRMAIDQQVGSVFKFGFTSNTNYSISEGNGVNPGAVLGFSPIANPYNADGSPKRVMSTAG

SEQ ID NO: 132367 - protein, 61 aa, Glycine max
  Coding DNA Sequence Number=SeqID_40682
ISFRLFNYSRLLHRRAKLGYQVMQSYLVRALDRRLQVNWARDPREGPRVLMSLRVDFGPMG

SEQ ID NO: 132368 - protein, 29 aa, Glycine max
  Coding DNA Sequence Number=SeqID_40683
MALNILFSSMCELSRNAYKALGRLVVIPL

SEQ ID NO: 132369 - protein, 85 aa, Glycine max
  Coding DNA Sequence Number=SeqID_40684
  Subcellular localization annotation: CTP_CleavageSite=63; ConfidenceScore=5.14e-01
MGKTLTLKEGGDMVNVSLKQKKKCRKWPRGSLPQRGPGRIRRPKELVPLLSMTVTVLGARYTSSASRPSKGMVISPRATRPAQGR

SEQ ID NO: 132370 - protein, 498 aa, Glycine max
  Coding DNA Sequence Number=SeqID_40685
  Gene Ontology: Mol. function=L-aspartate oxidase activity; Cellular component=cytoplasm; Biological process=pyridine nucleotide biosynthetic process
  Homolog annotation: Hit_ID=Q8XA23; Match level="QueryCoverage=96%, HitCoverage=89%, E-value=0.0, Identity=79%"; Hit description=L -aspartate oxidase
  Pfam annotation: Domain name=DAO; Domain location=10-296; Score= -25.6; E_value=0.00053; Accession=PF01266.15; Description=FAD dependent oxidoreductase
  Pfam annotation: Domain name=FAD_binding_2; Domain location=10-392; Score=452.4; E_value=6.2e-133; Accession=PF00890.15; Description=FAD binding domain
  Pfam annotation: Domain name=FAD_binding_3; Domain location=8-296; Score=-156.7; E_value=0.027; Accession=PF01494.10; Description=FAD binding domain
  Pfam annotation: Domain name=HI0933_like; Domain location=9-405; Score=-261.9; E_value=0.014; Accession=PF03486.5; Description=HI0933- like protein
  Pfam annotation: Domain name=Pyr_redox_2; Domain location=10-381; Score=-10.4; E_value=0.00015; Accession=PF07992.5; Description =Pyridine nucleotide-disulphide oxidore
  Pfam module annotation: Pfam domain module=DAO::FAD_binding_2::FAD _binding_3::HI0933_like::Pyr_redox_2; Domain location=10-296::10 -392::8-296::9-405::10-381
MNPIPDHSCDVLIVGSGAAGLSLALRLAPHYKVTVLSKAQISEGSTLYAQGGIAAVFDENDSIESHVEDTLIAGAGLCDRETVNFIASNARPCVQWLIDNGVAFDREPQDNGKARYHLTREGGHSHRRILHSADATGRAVETTLVSQALSHPNIRVIERANAVDLILSDKIGLPGTRRVVGAWIWNRNREQVETCRARSVVLATGGAAKVYQYTTNPDVASGDGIAMAWRAGCRVANLEFNQFHPTCLFHPQAQNFLLTEALRGEGAWLLRPDGSRFMPDFDARAELAPRDIVARAIDHEMKRLGVDCMYLDISHQPASFVRAHFPMIYDKLLTFGLDLTQQPIPIVPAAHYTCGGVMVDQHGRTDVDGLYAIGEVSYTGLHGANRMASNSLLECLVYGWSAAEDIVRRLPQMHAVDHLPAWDESRVDDADERVVIQHNWHELRLLMWDYMGIVRTTKRLERALRRITLLQHEIDEYYAHFRLSNNLLELRNLVQWQS

SEQ ID NO: 132371 - protein, 340 aa, Glycine max
  Coding DNA Sequence Number=SeqID_40686
  Gene Ontology: Mol. function=nucleotide binding; Cellular component =intracellular; Biological process=cellular process
  Homolog annotation: Hit_ID=Q56057; Match level="QueryCoverage=88%, HitCoverage=99%, E-value=1e-148, Identity=88%"; Hit description=GTP -binding protein era
  Pfam annotation: Domain name=AIG1; Domain location=36-204; Score= -100.5; E_value=0.043; Accession=PF04548.7; Description=AIG1 family
  Pfam annotation: Domain name=Dynamin_N; Domain location=36-152; Score= -22.8; E_value=0.00061; Accession=PF00350.14; Description=Dynamin family
  Pfam annotation: Domain name=GTP_EFTU; Domain location=36-200; Score=- 42.6; E_value=6.1e-05; Accession=PF00009.18; Description=Elongation factor Tu GTP binding domain
  Pfam annotation: Domain name=KH_2; Domain location=258-322; Score =86.5; E_value=8.5e-23; Accession=PF07650.8; Description=KH domain
  Pfam annotation: Domain name=MMR_HSR1; Domain location=34-152; Score =141.9; E_value=1.7e-39; Accession=PF01926.14; Description=GTPase of unknown function
  Pfam annotation: Domain name=Miro; Domain location=36-152; Score=4.6; E_value=0.0038; Accession=PF08477.4; Description=Miro-like protein
  Pfam annotation: Domain name=Ras; Domain location=36-200; Score= -88.1; E_value=0.01; Accession=PF00071.13; Description=Ras family
  Pfam module annotation: Pfam domain module=AIG1::Dynamin_N::GTP _EFTU::KH_2::MMR_HSR1::Miro::Ras; Domain location=36-204::36-152::36 -200::258-322::34-152::36-152::36-200
MAEPVVGVGSSRRKAEQAAAEQATRMSELETYSGFIAIVGRPNVGKSTLLNQLLGQKVSITSRKPQTTRHRIMGIHTEGAYQAIYVDTPGLHMEEKRAINRLMNRAASSSIGDVELVIFVVEGTRWTPDDEMVLNKLRDGKVPVVLAVNKVDNIQDKSILLPHLQFLSQQMNFLEIVPISAETGKNVDAIAEIARKRLPLSDHHFPEDYITDRSQRFMASEIIREKLMRFLGAELPYSVTVEIEQFVSNERGGYDINGLILVEREGQKKMVIGNKGAKIKTIGIEARKDMEEMFEAKVHLELWVKVKSGWADDERALRSLAKVRDASASLPRAHARAVPS

SEQ ID NO: 132372 - protein, 259 aa, Glycine max
  Coding DNA Sequence Number=SeqID_40687
  Gene Ontology: Mol. function=phosphopantetheinyltransferase activity; Cellular component=cytoplasm; Biological process=macromolecule biosynthetic process
  Homolog annotation: Hit_ID=Q6D222; Match level="QueryCoverage=43%, HitCoverage=89%, E-value=1e-44, Identity=79%"; Hit description=Holo -[acyl-carrier-protein] synthase
  Pfam annotation: Domain name=ACPS; Domain location=72-136; Score =79.3; E_value=1.2e-20; Accession=PF01648.11; Description=4' -phosphopantetheinyl transferase superfamily
GHLVSLFIDADQRQIEAAVAQRAATFAASRGLKGECWPRSDISQRPADCCAAGNARAEYWPRDYWSCAVQRDIVEIERIAGVIERSGDRLARRVLSEAEWQQYQAHQQPVRFLAKRFAVKEAAAKAFGTGIRGGLAFNQFEVYNDALGKPGLRFFEQAKVIASQLGVQHVHVTLADERHYACATNSVINRADALTGRLIIMTHAFSAAVSVDLIDRFTHANRLVRALRLAHVAVNAALSNYQCHCISSSVACFHCMFHG

SEQ ID NO: 132373 - protein, 105 aa, Glycine max
  Coding DNA Sequence Number=SeqID_40688
MPAASRKNRNRKALRGLKLGAFTMPTMISEQEMIMLTIERPVSKLHSAFLSGSAINQVIFFSGAKVILVLASTSLNSTSGRTFASTSAITMPNPSINISLITALR

SEQ ID NO: 132374 - protein, 29 aa, Glycine max
  Coding DNA Sequence Number=SeqID_40689
MTAFAPARDAGYTVEQVSPRLEKGVGLTK

SEQ ID NO: 132375 - protein, 388 aa, Glycine max
  Coding DNA Sequence Number=SeqID_40690
  Gene Ontology: Mol. function=transporter activity; Cellular component= outer membrane-bounded periplasmic space; Biological process=transport
  Homolog annotation: Hit_ID=A8GI11; Match level="QueryCoverage=73%, HitCoverage=57%, E-value=1e-101, Identity=64%"; Hit description =Lytic transglycosylase catalytic
  Pfam annotation: Domain name=SBP_bac_3; Domain location=150-372; Score=102.5; E_value=1.3e-27; Accession=PF00497.11; Description =Bacterial extracellular solute-binding proteins, family 3
MVPGRGVTSNRRPCGTCSAREGPYFSRRCRRACCSALSDERPESGSAVCLHEMPTERANHAEFPSLKISRLRSAGRRFMGRNRENGRYYREMARTEACEPLRDNYLKRLKLNYLFIGLITVLLALALWPSIPWYGGGKDALSQIKSRGVLRISTVNSPLTYYTINNAPAGMDYELAKRFADYLGVKLEVTVRPNLGDLFDDLDDGKADLLAAGLIYNSERLSRYQSGPSYYSVSQQLVYRIDKPRPKNLGDLKGRLIVQSGSAYLSTLRSAKADSYPDLDWAISTDMGQKALLEAVADGKLDYTVGDSVTIGLLQRIHPQLAVAFDITDEEPVTWYLPRNDDDSLNAAMLDFYSQMGEEGTMARLEEKYLGHVGTFDYVDTRTLPAGD

SEQ ID NO: 132376 - protein, 117 aa, Glycine max
  Coding DNA Sequence Number=SeqID_40691
  Subcellular localization annotation: CTP_CleavageSite=28; ConfidenceScore=5.27e-01
MASRFNTRLLQQTKPCFKINSRSRLAIKQSAFKTCKALAESFVGPKCLILSKENERDSKRTSLSNALSKETIGQTPTNPLRVYPWTSIVISFSSRENSSFFLFVQRDCLKDRASLKL

SEQ ID NO: 132377 - protein, 168 aa, Glycine max
  Coding DNA Sequence Number=SeqID_40692
HPGKILRKDLTTLTQVWSVLSYSNLALTSHTLDLTVDRARLIFGLVSQLDMNVGALISGQITSMTQSNSSRLGFPALITTLCRSRGVAYDSLVFERLSPIINLAYIRKNYWNLDDLTVSIRGARRARARPIELPSTSAAPTPAFTSASPSVPAQSNSQRFEAMLQSIH

SEQ ID NO: 132378 - protein, 206 aa, Glycine max
  Coding DNA Sequence Number=SeqID_40693
MAKYDPEIVMEFYGNAWPTEEEIMDKCSWGRGQWIPYNEDAINQFLGHLLILEEGQRCEYAKKRSQVSGFDEEAIGPATIWMMLLLSNIIPNDHNFDLPLPKCQLVYIILTQGQCSCSTAYLGCHLPVCRYCTSETPMDSKKSNRALGFLALITGDEDKARNKGKKPLEGLGGPMARARTKKAKEALQQVLTMLFEFRPKLQVEKL

SEQ ID NO: 132379 - protein, 104 aa, Glycine max
  Coding DNA Sequence Number=SeqID_40694
MAKFDPEIVLKFYANAWPTKEGVRDMRSWVRGQWIPFDADALSQFLGDPLVLEEGQESEFSQRRNRADGFDEEAIAQLLCTLGQDFDRTAAGKRVTVTTRLVAT

SEQ ID NO: 132380 - protein, 152 aa, Glycine max
  Coding DNA Sequence Number=SeqID_40695
MVGYTPSSFADLVFAGEMIEVGLKRGKSDNHALIKKTGANEEGESEGETHAATTIPIQPSFPPTQQCHYSANNNPSPYPPPNYPQRPSLNQPQSLSTTQPMLNTTFSTNQNTNKERNFAAKKPIEFALIPVSYDDLLPYPLNNSMVAITPTK

SEQ ID NO: 132381 - protein, 213 aa, Glycine max
  Coding DNA Sequence Number=SeqID_40696
  Subcellular localization annotation: CTP_CleavageSite=34; ConfidenceScore=5.24e-01
GYTSSPSEDYTPSPFRGLHILTFQRTTQRPRLHRATHVLTFRGLHVLPSRGHRPSPSEDYTSSLSEDYTFLAFRGVHALAFRGLHALTFRGLHILAFRGLHALTFRGRHVLAFKGLHGLTFRGLHALTLKGLQGYTPSPLEDCTPSPSEDYMSSPSEEYISSPSEEYTSSPLEDYTCSPSEDYTSLPSDGDTPSPSEDYTSSPSEDYTSSPLE

SEQ ID NO: 132382 - protein, 48 aa, Glycine max; identical to SEQ ID NO: 130494
  Coding DNA Sequence Number=SeqID_40697

SEQ ID NO: 132383 - protein, 77 aa, Glycine max
  Coding DNA Sequence Number=SeqID_40698
MAITFAPERKLRAHSRHLLKDPNSQIMDKCLVKLLTKFREDPAVNEGWASFLPMQLHVASSRSFIKRLLQEASPWLF

SEQ ID NO: 132384 - protein, 530 aa, Glycine max
  Coding DNA Sequence Number=SeqID_40699
  Gene Ontology: Mol. function=two-component sensor activity; Cellular component=membrane; Biological process=two-component signal transduction system (phosphorelay)
  Homolog annotation: Hit_ID=A4W9Q6; Match level="QueryCoverage=58%, HitCoverage=74%, E-value=1e-117, Identity=65%"; Hit description =Diguanylate phosphodiesterase
  Pfam annotation: Domain name=BLUF; Domain location=193-266; Score =47.4; E_value=5.1e-11; Accession=PF04940.3; Description=Sensors of blue-light using FAD
  Pfam annotation: Domain name=EAL; Domain location=329-530; Score =85.4; E_value=1.8e-22; Accession=PF00563.11; Description=EAL domain
  Pfam annotation: Domain name=HTH_3; Domain location=6-60; Score=63.6; E_value=6.8e-16; Accession=PF01381.13; Description=Helix-turn-helix
  Pfam annotation: Domain name=Peptidase_S24; Domain location=121-174; Score=8.4; E_value=0.1; Accession=PF00717.14; Description=Peptidase family S24
  Pfam annotation: Domain name=Phage_CI_repr; Domain location=4-68; Score=26.3; E_value=0.00012; Accession=PF07022.4; Description =Bacteriophage CI repressor helix-turn-h
  Pfam module annotation: Pfam domain module=BLUF::EAL::HTH _3::Peptidase_S24::Phage_CI_repr; Domain location=193-266::329-530::6- 60::121-174::4-68
SGGDRIRQRRKALKLTQQALANGIGVSHVAVSQWEKEETVPRGEHLLRLAELLQCSAAWIIDGDGQPFASTHASPALTAVPLVTLVQAADWLDEQRLQWQQQAVHFLYSDEALSDSALAVTLEDDAMNPAYRAGDRLIFDPQRVPQPGDVVLARVDNVAMSEKYAGTDWHAGGNAAARQPLKQQKTRHAAAAVTQFIEQRHAALVLTVGTDNMPFGRHFFQLLEGPDQAVQGIYDRICRDARHHNLVELMHDFAPARRFGNVGMELFDLREHDKSSVLQAVLDKGTSRYQLTYDDRALQFLRTFVEAREKENYFEIPPANTWEFITDAESQRQLESLQHYVQDCRFAFQPIVDPFSRRITAYEALIRTPDGGSPQEYFSAFGGDAIYHADIQSKSLAFNLAKNLGLGEQTLTINLLPMSLVTVPNAVDFLLQEIAANGLVPEQIVVEVTENEIISRAEEFTAEVRKLKAAGISLALDDFGAGFAGLSLLSKFQPDKIKIDREIISDVHKSGPKQAIVHAIIKCCASLEIA

SEQ ID NO: 132385 - protein, 111 aa, Glycine max
  Coding DNA Sequence Number=SeqID_40700
MSLCQFTESLSPPGKVIMSLTNQAFIKKYCDPRQAQGRDTTTAWGWPAAGNKCTATTSRAPQLIHKKVRVLPTTHGRPIGDQVQSQRRPAQDVKEALLGGNLVPFKSLLVI

SEQ ID NO: 132386 - protein, 154 aa, Glycine max
  Coding DNA Sequence Number=SeqID_40701
DKSNRALGFPTLITGLCQSFGVPVTPSKVIRPPITRAFIEKYCTTRQAQGGDAQALDAPPPPPQADPAGSFDTERYLRHLVRQQAANHRAHSQGFPSFPCPTPDQFREEVAWPGDWPEAQAGEAPAEAPGDADKARMDKEMTNLLDFLGGSGAT

SEQ ID NO: 132387 - protein, 44 aa, Glycine max
  Coding DNA Sequence Number=SeqID_40702
DKWSINELMTMCVQEEERLIMEEGEKGMESLRKPVESEQCIYSE

SEQ ID NO: 132388 - protein, 172 aa, Glycine max
  Coding DNA Sequence Number=SeqID_40703
  Gene Ontology: Mol. function=catalytic activity; Biological process =metabolic process
  Homolog annotation: Hit_ID=Q0WRB0; Match level="QueryCoverage=23%, HitCoverage=8%, E-value=3e-10, Identity=70%"; Hit description=Acyl CoA reductase-like protein
MKHFTDTLISANIGTKAGTGPPLEVDGIDKLDDERYDISLGLNTFGVKYVINFAKKCTKLKVLVHVSTAYVCGEGGREGLILEIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 132389 - protein, 256 aa, Glycine max
  Coding DNA Sequence Number=SeqID_40704
MLSFDFRHVTELHELPNDGCQVPRSGQTRVASQQTNGPRTKLGYDRDATAEGSSAALEFNSHHFRSIEHQQRFEAIRGWSFHKERRVQLREDEYTDFQEEIARRPWTLLVTPIAKFDPEIVLEFYANAWPTEEGVQDMHALNQLLGDPLVLEEGQQCEFSQRRNRVDGFDEEAIAQLLCTPGQDFTRTAAGRQVQIMRTSMTTLTQTWMTLLLSNVLPSNHNSDLPLPKCQLVYAILTRMSIHVAQVWHLPGTLWT

SEQ ID NO: 132390 - protein, 111 aa, Glycine max
  Coding DNA Sequence Number=SeqID_40705
MTPDHALDPLPDGHAPQPRVVPQAPQTDISHVLEPGALSTSARPAVEEPRHAVEVCDEIAERLERHLSLGVVTSGSSTHEVIEECLRMARSVTQDHLVYVRSRRRRRTDQA

SEQ ID NO: 132391 - protein, 54 aa, Glycine max
  Coding DNA Sequence Number=SeqID_40706
MTPVNRKAGTGERTMEPPGGNAWGAEPTEKRLCRGPLTSLLSMFPAYSRKCPPR

SEQ ID NO: 132392 - protein, 102 aa, Glycine max
  Coding DNA Sequence Number=SeqID_40707
  Subcellular localization annotation: CTP_CleavageSite=34; ConfidenceScore=5.44e-01
MLVTLTPAAVKAPFTGGFPLAFQVAQLLGRASVRASSLLRQLTHYRANWKSTKVWVALELVDPPGCRNSIIGKRGRRLPPSSPGRANVAWASWAATSSPFFL

SEQ ID NO: 132393 - protein, 56 aa, Glycine max
  Coding DNA Sequence Number=SeqID_40708
MEKALGDAILPRKEPVTRCMSKRLQEDSARAIEEGPRVGYPRNVGFFSSYILGHLD

SEQ ID NO: 132394 - protein, 224 aa, Glycine max
  Coding DNA Sequence Number=SeqID_40709
MGLLELGGNSHSYDVDQLRNIRVPIEDRITRDSSMVSRGNALAIPRNQPGNRHIIQMLQGQNGPNRGLGLEAIQNPKIIQMMELALNMYCFGIGNAQPPYFVSAFLDYILASELPRVSAPLSREEVNQALEEFKKEEEFPLAEESLVEFLLKKQKVEKEVMLCLCCNVVFDKSTAKAFEASKNSKSFQKVQEANVKEKGKQSISLTASQVQRPYNLSQKKSYVP

SEQ ID NO: 132395 - protein, 168 aa, Glycine max
  Coding DNA Sequence Number=SeqID_40710
  Gene Ontology: Mol. function=nucleic acid binding
  Homolog annotation: Hit_ID=A5AYU6; Match level="QueryCoverage=42%, HitCoverage=12%, E-value=2e-15, Identity=51%"; Hit description =Putative uncharacterized protein
SSWLQTLNTRDQRSLGSLEVARFDSWLITGHKRPTSFVFIARSGYNFLVVITGHKGQTFLEDSGNLKRVAWGLDIGTGCGRTSMNLEHVMELQRLNQNEKEQANICLMTKNHESDEEEPLKKKWYIDSGCSKHMRGDASKFTTISPKKSGHVTYGDNNRGKILGVGKI

SEQ ID NO: 132396 - protein, 85 aa, Glycine max
  Coding DNA Sequence Number=SeqID_40711
MWAWKRCLPLAPKRTPSQVENKPLGHRLVAHMHGDLPYLLFYTERCAVPPIIKLNQSEVCASYYKCGHGTMSNLGSKEDSFSSRK

SEQ ID NO: 132397 - protein, 178 aa, Glycine max
  Coding DNA Sequence Number=SeqID_40712
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=47%, HitCoverage=72%, E-value=3e-24, Identity=70%"; Hit description=LacZ protein
MYRVLIKAPPQVVVSVEPKKLRFKKKGEKKEFRVTLTLKPQTKYTTDYVFGCFISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132398 - protein, 285 aa, Glycine max
  Coding DNA Sequence Number=SeqID_40713
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMKGFVGLSTVIFTTLCFLCGFPHSIVFFFTRFLLLPPATTKRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132399 - protein, 169 aa, Glycine max
  Coding DNA Sequence Number=SeqID_40714
MLASCPSSAPYVEAAEESLETTFQSFEVVSCASMETSPLLPCLSNAALMVAWVMLRHSYEPGMGLGKDSHENADVVDIRGNLYKYGLGYEPGKPGRRNAPSRLQADRAWPGHVSQCFTSAEIMFEEEVEAIGEEAPQDPPSFVRPCHPNFQVGNWHVMSQSEVYAADSM

SEQ ID NO: 132400 - protein, 254 aa, Glycine max
  Coding DNA Sequence Number=SeqID_40715
  Gene Ontology: Mol. function=motor activity; Cellular component=cell projection
  Homolog annotation: Hit_ID=P15305; Match level="QueryCoverage=99%, HitCoverage=71%, E-value=2e-13, Identity=22%"; Hit description =Dynein heavy chain
GLHALAFRGLHVIVLRQLHVLTFKGLHVLAFRGLHVFDFRGLHVLTLRGLHVLAFRGLHTLAFRGLHVITLRGLDALGFRGLHVLAFRGLHVLALRGLDMATCPSLQRNTCPPLQRATHPHLQMTARLHALTFRGLHVLALRGLHALTFKGLYILAFRGLHVLALRGLHVLAFRGLHVLAFRGLHALTFRGLHILAIRGLHVLAFRGLHALAFSRLHVIVLRRLHVLTFKGLHVLAFRGLHVLTFGGLHVLAFR

SEQ ID NO: 132401 - protein, 241 aa, Glycine max
  Coding DNA Sequence Number=SeqID_40716
MASRKRKSIGTRPIAQYDTRRFHSFEAWTRYTDNVLGRHILPKRKVEIYHTELGEFKAELERRNFHKRLTNLVDNIIDLALVKEFYANLYSSEGPSPKQVRVRGHLVRIDADNLNTFLETPVVLAEEGHPGKILRKDLTTLAQVWTVLSYSNLAPTSHTLDLIVDRARLIFGLVSQMDMNVGTLIFGQITSMDQSNSSRLGFPTFIIALCKSRGVASDSLVFERLSPVINLAYIRKNCWEP

SEQ ID NO: 132402 - protein, 76 aa, Glycine max
  Coding DNA Sequence Number=SeqID_40717
MNRPTRGERRFAYWALAECILAYYVGTDEGICDTGYIPLPRSLTRYARVVRLRRAEMAYERGGDFLEDARKILNRE

SEQ ID NO: 132403 - protein, 48 aa, Glycine max
  Coding DNA Sequence Number=SeqID_40718
MACTYIPVEAKMIHKRFSSNFSQPASIKLCTLRFKVIQCSMECPGTPP

SEQ ID NO: 132404 - protein, 112 aa, Glycine max
  Coding DNA Sequence Number=SeqID_40719
VVSNPWRFTVGNWLCDSDLVSPTGIERVLTEKDLLADSYSDLEASILDEKEFLLLKVISTFPELSCLICSMVGAGRGIDGFNRTLDAQVFMTLYWILYIKAAGIDPSFMSRP

SEQ ID NO: 132405 - protein, 65 aa, Glycine max
  Coding DNA Sequence Number=SeqID_40720
MGVQIATRPTWALQKIPPEGCCFLRKQPCSLGRAELAWASWEFREGFRPFFNVLHSFFIVLQSST

SEQ ID NO: 132406 - protein, 126 aa, Glycine max
  Coding DNA Sequence Number=SeqID_40721
  Subcellular localization annotation: CTP_CleavageSite=48; ConfidenceScore=5.15e-01
MPIFPCGSISWDHAHKTPSGPGEVQQGPGVSRSGYGPLSVLLGARPPSEVMPSDRARKTPSGPEEFQQGPGVSSSDYGPLSVLRSAHRPSKVIRPLTNRSFMKKYCAPRQAQGETPQQLGNAGSGQ

SEQ ID NO: 132407 - protein, 38 aa, Glycine max
  Coding DNA Sequence Number=SeqID_40722
MLSGMEASSILQTSSLRSQRSDCGHGVSLAPTYSSNCE

SEQ ID NO: 132408 - protein, 255 aa, Glycine max
  Coding DNA Sequence Number=SeqID_40723
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSGGGGQPVVVHLLVALLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132409 - protein, 120 aa, Glycine max
  Coding DNA Sequence Number=SeqID_40724
  Homolog annotation: Hit_ID=A7ZH17; Match level="QueryCoverage=31%, HitCoverage=100%, E-value=2e-10, Identity=81%"; Hit description =Putative uncharacterized protein
  Subcellular localization annotation: CTP_CleavageSite=54; ConfidenceScore=5.52e-01
MYNVGRLGFFVRSSSDILFQSSLSIPSTSRGGPVPAFVPFSEAHCPLSSRETCRASCINESANARGEAVCVLGASGSVYWLTMLALMRVSVKCFMWQEKKGCTGASAEYVIQDIFRFLAH

SEQ ID NO: 132410 - protein, 20 aa, Glycine max
  Coding DNA Sequence Number=SeqID_40725
MGGPLEKLIEGSKVNFEKDG

SEQ ID NO: 132411 - protein, 308 aa, Glycine max
  Coding DNA Sequence Number=SeqID_40726
  Homolog annotation: Hit_ID=Q2HW90; Match level="QueryCoverage=93%, HitCoverage=61%, E-value=4e-30, Identity=29%"; Hit description =Putative uncharacterized protein
MGTNQTGKRFYQVKVKSLDTTSIKELGRLMEPLQMQAFRKTYGKILELTLGEVSIEAIASLTQYYDQPLRCFTFGDFQLVPTIEEFEEILGCPLGGRKPYLSSGCLPSLSRIATVVKDSARRFGQHKTDSERHSGPTTEVPRKTRQGDGLVDLAAIDAFLAYHHSKESPVVAVLADLFDTFDRRCEKSSARIICCLPALCVWLVSHLFQQDARHPCPLLSHRSCTEKRRIDWDQLLAGIGGRTISWFPRWKEGKEGVLFSCGGYPNIPLVGTRGCINYNPTLAIRQLGYPMRGAPTEESMSPFLVRDL

SEQ ID NO: 132412 - protein, 100 aa, Glycine max
  Coding DNA Sequence Number=SeqID_40727
MVAITPTKVPQPPYDSNATCAYRGGALGHSIEHFTMLNDMDKMDILVPHPLTNACLLIQLFTGMWVQAIGLFAQRPALLSVDFQDCSIRDYSSCTLVGVP

SEQ ID NO: 132413 - protein, 94 aa, Glycine max
  Coding DNA Sequence Number=SeqID_40728
  Homolog annotation: Hit_ID=UPI00006A17C9; Match level="QueryCoverage =87%, HitCoverage=98%, E-value=2e-08, Identity=32%"; Hit description =UPI00006A17C9 related cluster
  Subcellular localization annotation: CTP_CleavageSite=64; ConfidenceScore=5.49e-01
MRMRSPLKARACNPLKLKTCRPLKARACSPLKVSTCNPLKARACSPLKGRTYSPLKARACSPMKARTYSPLKARTCSPLEGRACSPPKVRVLVP

SEQ ID NO: 132414 - protein, 128 aa, Glycine max
  Coding DNA Sequence Number=SeqID_40729
  Gene Ontology: Mol. function=protein serine/threonine kinase activity; Biological process=protein amino acid phosphorylation
  Homolog annotation: Hit_ID=Q2HV72; Match level="QueryCoverage=78%, HitCoverage=14%, E-value=6e-37, Identity=71%"; Hit description =Protein kinase
MNIVNDDANKKMISVFELMLQQTRFNKSIIVPVFYSCSGNIYQHNTPYTASKNDTYYELVKETFQGLTTCQAMMGHNYYAPVNIVIGAKLTVPMLYACLIENQTARGITSLLVYLVNYGGTIESIGSL

SEQ ID NO: 132415 - protein, 248 aa, Glycine max
  Coding DNA Sequence Number=SeqID_40730
  Homolog annotation: Hit_ID=A5B939; Match level="QueryCoverage=27%, HitCoverage=40%, E-value=5e-08, Identity=51%"; Hit description =Putative uncharacterized protein
RCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKFLNRDVAADGNPAHPGNGSAGVGPAAGEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLK

SEQ ID NO: 132416 - protein, 187 aa, Glycine max
  Coding DNA Sequence Number=SeqID_40731
MAYTSWHLGMGRVVILVRMIRTRLPAAVRAKSCPGIHNSWGDGLLIEPIRPVPPLAILAFLALFQYHRISQELADSVGIERDPLTPNPGSHVTHALLYWPSIGIKLKDYFWIKLGHGSNQWCPPPAPYFLLEISILVVPELDASLPEKRPSLDGFEALLVYNAPKAVTVVLRGGTSSFGRLVLPGPL

SEQ ID NO: 132417 - protein, 84 aa, Glycine max
  Coding DNA Sequence Number=SeqID_40732
MATIALSSRYGSKLAYDTGIGVNSTGFLAAKFTSWLVFLTDFVVDLGMAFVDTWVVGKEKEWQSQHGFLPYPHPLYLPQFSQSS

SEQ ID NO: 132418 - protein, 86 aa, Glycine max
  Coding DNA Sequence Number=SeqID_40733
  Homolog annotation: Hit_ID=A0ST23; Match level="QueryCoverage=29%, HitCoverage=51%, E-value=3e-07, Identity=100%"; Hit description =Putative reverse transcriptase
MWWHSFIMHTGNHWWTFLWRMLFNFHLLFPLVRVNFELGVIMVIAVSFGKPVVPAALMNRPTRGERRFAYWALAECILAYYVGTDE

SEQ ID NO: 132419 - protein, 148 aa, Glycine max
  Coding DNA Sequence Number=SeqID_40734
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGNNTVAVGTTSNNVSSKRKNSR

SEQ ID NO: 132420 - protein, 110 aa, Glycine max
  Coding DNA Sequence Number=SeqID_40735
MTRGNLSDLQPFDPEIDRTFHILVRHHFIPFDHLEHSITGESVQSVIGDFEHPDFEHYNFEHSDSEHSDFEHSKTMAQPPPRERTLREMAAPDFTYESLCIQYPDEDVPY

SEQ ID NO: 132421 - protein, 176 aa, Glycine max
  Coding DNA Sequence Number=SeqID_40736
  Subcellular localization annotation: CTP_CleavageSite=39; ConfidenceScore=5.08e-01
MSGRHRPTDTFAGGDWHAVAGQNIANMHSSSVIASLSSCARTVGAPPISGGQRTLNYLKVWIWSPLKVRIRSPLKVRACSPFKARMCSPLEVRACSPLLVRTCSPLKARTCSPLKARTCSPLNGEGRVVLSRRGRVVLSTVRARTCSPLMVRACSPLMVRTRSPLKARTCSPLNGE

SEQ ID NO: 132422 - protein, 67 aa, Glycine max
  Coding DNA Sequence Number=SeqID_40737
MRLLFNYQGVSGLLGSGVFGEIYHQRLRPSKTSLIWGLDTYMPLFPPLIADFQSALIYHLLQKVLHC

SEQ ID NO: 132423 - protein, 393 aa, Glycine max
  Coding DNA Sequence Number=SeqID_40738
  Homolog annotation: Hit_ID=Q84VH5; Match level="QueryCoverage=95%, HitCoverage=59%, E-value=0.0, Identity=83%"; Hit description =Envelope-like protein
PGSPSVPSSPSSTKAPSHQERPEFTIQPIQMIPGQAPVPEKLVPKRQQRVKISENPSLATSPREVDTEMDKKIRSIVSNILKDASVPDADKDVPTSSTPNVSVPDAEKDVPTSSTPNAEVLSSSSKERSTEEDDQATEETPAPRAPEPAPGDLIDLEEVESDEEPIANKLAPGIAERLQSRKGKTPIKRNSSSDSDYDVELDVPDIKRAKKSGKKVPGNVPDAPLDNISFHSIGNVERWKFVYQRRIALERELGRNALDCKEIMDLIKAAGLLKTVSKLVDCYESLVREFIVNIPSDITNRKSDEYQKVFVRGKCVRFSPAVINKYLGRPTEGVVDIDVSEHQIAKEITAKRVQHWPKKGKLSAGKLSVKYAILHRIGVANWVPTNHTSTVAT

SEQ ID NO: 132424 - protein, 95 aa, Glycine max
  Coding DNA Sequence Number=SeqID_40739
  Homolog annotation: Hit_ID=A5B715; Match level="QueryCoverage=98%, HitCoverage=18%, E-value=2e-30, Identity=69%"; Hit description =Putative uncharacterized protein
MDIDYAIRKDEPLGITETNTLDIVDLYEKWERSNRLSVMFIKTNISASIRSSVDQHEKVKDLLKAIDDQFITSDKALASTHIMQLSSLKVQGIRD

SEQ ID NO: 132425 - protein, 116 aa, Glycine max
  Coding DNA Sequence Number=SeqID_40740
  Gene Ontology: Mol. function=chloramphenicol O-acetyltransferase activity; Biological process=response to antibiotic
  Homolog annotation: Hit_ID=P62577; Match level="QueryCoverage=68%, HitCoverage=36%, E-value=2e-40, Identity=100%"; Hit description =Chloramphenicol acetyltransferase
  Pfam annotation: Domain name=CAT; Domain location=6-111; Score=70.3; E_value=2.2e-18; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDANPWVSFTSFDLNVAIWTTSSAPVFTMANIIRKATRC

SEQ ID NO: 132426 - protein, 252 aa, Glycine max
  Coding DNA Sequence Number=SeqID_40741
  Gene Ontology: Mol. function=transporter activity; Cellular component= integral to membrane; Biological process=transport
  Homolog annotation: Hit_ID=A3TL20; Match level="QueryCoverage=47%, HitCoverage=28%, E-value=4e-19, Identity=41%"; Hit description=Major facilitator superfamily protein
GGGPPSTCSPPLTTAYPRARGTVPRDSGDGAAEGGGMGLAELPALDPAVDPRRLLARCSGRDRRLGDGWTVPGLGVVLLAGVGAATAFVLRKITARSMVLFGTSALAIGTLLSLIALAVGSLPFYLVAAGVTGMGFGTAFSGVVASLAPRIPATERADTFAVIYLLAYLAFGVPAVIAGALVGIVGLEAVCIGYGVVVIALAAVAFTLRDRGAPSRPRHRCRRDVDDPEREGAHDGPGSGVELLERDRVEPH

SEQ ID NO: 132427 - protein, 405 aa, Glycine max
  Coding DNA Sequence Number=SeqID_40742
  Homolog annotation: Hit_ID=Q2HW90; Match level="QueryCoverage=82%, HitCoverage=65%, E-value=1e-41, Identity=33%"; Hit description =Putative uncharacterized protein
MGPLQRQAFRKVYGKILDLAAAEIFTEAVVSLAQYYDQPLSCFTFGDFQMVPTIEEFEEILGCPLGGRKPYLFSDFLPSLSKIAAGVGDSAKELDRTKQTRNGVVGLPRKYLEGKARDMASQEKWGPFADILALLIFGVVLFPNVDGLVDLAAIDAFLAYYHSKESPLVAILADLFDTFDRRCEKNSARIVCCLPALCVWLISHLFQQDTRHPCLLQSYRSCAEKGKVDWDQHLAGIGGSVINWFPRWKEGKEGVLFSCGDYPNIPLIGTRGCINYNPALAIRQLGYPMRGAPTEESLSPFLVRNLGAQSLKAIQRFHKAWRSPLRKDKELRGIRNGVIGDYHGWLRIHTWGLDWLSKLKVIDEEDFEASEEDEEVRALKLELGKARLAKEKFKSAATHIRKECT

SEQ ID NO: 132428 - protein, 161 aa, Glycine max
  Coding DNA Sequence Number=SeqID_40743
MHTGSGFFPDRCREAGADHAHQHDHLDPDVDDVAAQQCPAQYATYQAADTPPPPHQADPAGSFGTKRYLQHLVRQQAANHRGQVQIHECLYQLSLSQQSQGFTPFACPTPDQFRAEVAWLGDWPEAQVGEAPAEAPGDAEEARMDEEMTDLLDFLGGSGAT

SEQ ID NO: 132429 - protein, 58 aa, Glycine max
  Coding DNA Sequence Number=SeqID_40744
GEPLGTSTLVSRGLYILALRGLHVLTIRGMHTLTSRGLHVLALRGLHALTLGTSYPHR

SEQ ID NO: 132430 - protein, 90 aa, Glycine max
  Coding DNA Sequence Number=SeqID_40745
MAYSELWPSLLENHLVVAIPGRVFQPPYPKWYDPGAKCEYHSGAPGHNINSCLSFRGASVNAVEEGGPSRAKRLGEVATSRRFIYQSLQA

SEQ ID NO: 132431 - protein, 73 aa, Glycine max
  Coding DNA Sequence Number=SeqID_40746
MTIICLCVPPDSIVSGWQKGVRDDHNLSAQSDHNLSLRATGLDRLWMAERCADYHNLSPYVIGLAALDDKRAN

SEQ ID NO: 132432 - protein, 227 aa, Glycine max
  Coding DNA Sequence Number=SeqID_40747
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=22%, HitCoverage=50%, E-value=1e-23, Identity=100%"; Hit description=LacZ protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANISKINLPRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132433 - protein, 133 aa, Glycine max
  Coding DNA Sequence Number=SeqID_40748
MPLYGLILPEGRCLELVQIGISSLALELRFNPSLFENHQAKLFKLYQHDFVADYQQQFKRPCNHVHGLTPEALLNYYSSRLQPGICVELTILCPTTISNAMCRNLPFGGRATRDSRDACSTKGIRAESPPTFI

SEQ ID NO: 132434 - protein, 168 aa, Glycine max
  Coding DNA Sequence Number=SeqID_40749
  Subcellular localization annotation: CTP_CleavageSite=44; ConfidenceScore=5.43e-01
LSSLGTDVWDANTFPVRKYNSRTFHFKVRRSCLFRFFRRFPQINVGGDSARIPFVEHASRESRVALPPKGRLRHMALDMTMDMVAWPLKLLLVISHKIMLIELKQLCLVVLKKGRGEKVVSLEKLVKGLCTIKQEEVEFRGLGNVLVGCGKRESVLNKGVCGKKGDHG

SEQ ID NO: 132435 - protein, 125 aa, Glycine max
  Coding DNA Sequence Number=SeqID_40750
  Homolog annotation: Hit_ID=Q8S8J9; Match level="QueryCoverage=65%, HitCoverage=10%, E-value=5e-09, Identity=32%"; Hit description =Putative Athila retroelement ORF1 protein
DLEAAATPKEEPRSSEASSSFPIAGHSHIEPVEDLIMAEEPRRLIQNNLFHGLPNEDPYAHLATYIEICNTIRLAGNSQKSWDEVVEKFLKKYFHESKTVEGKAAISSFHQFPDESLSEALERFR

SEQ ID NO: 132436 - protein, 124 aa, Glycine max
  Coding DNA Sequence Number=SeqID_40751
MKLDRFRLLSLAEIAYSGWSFASLTLLRKVEEEPQLLVVFVVIAAAVVVATLEEEHMACLDQRHSEKEGQAVVFVKDLSISDLDDSSNLDCIYCLKGHNYYVVVGFAAEEVYYKCLQHKLQVAH

SEQ ID NO: 132437 - protein, 108 aa, Glycine max
  Coding DNA Sequence Number=SeqID_40752
MLAIVSRYQEELNLATTHEHRVADEYAQVYVEKEDRGRVIDSLHQEATMWMDRFAITLNGSQELPQLLAKAKAMADTYSAPEEIHGLLRKNTITKRAPRHPYRTRSKS

SEQ ID NO: 132438 - protein, 63 aa, Glycine max
  Coding DNA Sequence Number=SeqID_40753
FYGVPVAPSKVIRPPTNRAFIKKYCVPRQVQGETPQYPGDGRQWATDALPSPLEFTSAHPQKG

SEQ ID NO: 132439 - protein, 195 aa, Glycine max
  Coding DNA Sequence Number=SeqID_40754
  Gene Ontology: Mol. function=helicase activity; Biological process =viral genome replication
  Homolog annotation: Hit_ID=Q2A9E0; Match level="QueryCoverage=94%, HitCoverage=12%, E-value=1e-45, Identity=52%"; Hit description =Putative uncharacterized protein
MMFAFTSAGIKFDKSINHYRGPPTIRIQGQPCHRIGSMLPMPVKEPKFAQLYIFDTENEVQNRINAISPHNQIQEHIVSQLSEMLDEYNVHAKTFRMARDRLQDVQVDNIKLKLIANREKDGRTYNVPIVPEVAALIVGNFDANSKRDIIIETQHGQLQRIHELHSSYLALQYPILFPYGEDGYRPDILHSSRSD

SEQ ID NO: 132440 - protein, 113 aa, Glycine max
  Coding DNA Sequence Number=SeqID_40755
MSVSSRGITRHGNLPHGGRVTSTAHGLGECDRLPGPSTPPIVPKPTSFSYQSNKVVPWKYTPPAFGERVATEVDSLSAKVTNITGLSGVTRSGRVFAPPHSAELPSKGKAPMI

SEQ ID NO: 132441 - protein, 73 aa, Glycine max
  Coding DNA Sequence Number=SeqID_40756
MEMLRQMSIRESMDKNEVLKVHQHIARFWYQAAIGQYGPHLPTSSYHDIRVPLLKKEVEYTENLMKGHREQWV

SEQ ID NO: 132442 - protein, 154 aa, Glycine max
  Coding DNA Sequence Number=SeqID_40757
  Subcellular localization annotation: CTP_CleavageSite=14; ConfidenceScore=5.02e-01
MVKVGTSYVPINVSFSPKVGPGLPGSNRDTRIYLFCEVIFPSQVLQWLLFLSAVPSCSATDGVVRNGKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 132443 - protein, 125 aa, Glycine max
  Coding DNA Sequence Number=SeqID_40758
HVWGLTPAQCRKVKEVGDLMTGEPTTEAPVNGGRNYNGPKGKEGLLLGGPEPSVRYHSGRARILTLCQDLRAEGQSQASQKVTEACKGFLGPDGRLALECKGRRELDCKTHSVEQGRKSALVIPT

SEQ ID NO: 132444 - protein, 136 aa, Glycine max
  Coding DNA Sequence Number=SeqID_40759
MRTARPHLQRATRPHLQRAACPHLQRAARPHLRGLQVLAIRGLHALTFRGLHVLTIRGLHALTFRGLHVLAIRGLHTLTFKGITRPRLQRVTRPRHRRATRPHLQRATCPRLQRTTRPRHQRAARPHRQKATRPHL

SEQ ID NO: 132445 - protein, 60 aa, Glycine max
  Coding DNA Sequence Number=SeqID_40760
  Subcellular localization annotation: CTP_CleavageSite=20; ConfidenceScore=5.16e-01
MVKVGTSYVPINVSFSPKVLAQGFPGGVIRHNSTQAYRAGHQRGKCSLGSKTLTLTSHPP

SEQ ID NO: 132446 - protein, 98 aa, Glycine max
  Coding DNA Sequence Number=SeqID_40761
GDRALIIDYQLGVIDYTVLPATVEPVQVIEVSSSEEDLEEDPEELPPEPAVDALDFPEDDEDPLPDVDSPKDVMSASEADSTEESDPGGTTNSDDSSS

SEQ ID NO: 132447 - protein, 108 aa, Glycine max
  Coding DNA Sequence Number=SeqID_40762
MAPKKLSTKRSRRDVTAEGSSAAPEFDSHHFRSAVHQQRFEAIKGWSFHRERRVQLREDEKASSASSARGGTGPTGSTRRPLPNCYAHRGRISPGPLQGGRCGSCAPA

SEQ ID NO: 132448 - protein, 116 aa, Glycine max
  Coding DNA Sequence Number=SeqID_40763
MFESFQQQNQMSVLELYIEKDVAGGSMFHSANSLTSCENNLSNNEAQPPTNVSNLHSDDDDDDYLVSNSYVEESLDEDDSVDDISDTDDEVADIIQPVRIVHSAEGVQGIENPFWE

SEQ ID NO: 132449 - protein, 179 aa, Glycine max
  Coding DNA Sequence Number=SeqID_40764
MLAIITKYQEELSIATTHEHRVADEYAQVYAKKEARGRVIDSLHQEATMWMDRFALTLNWSQELPRLLAKAKAMAKTYSAPEEIHGLLDYWKNTITKRAPRHPYRTRSKSRMMGDQEETQEQMKADMSALKEQMASMMEAMLGIRQLMEKNVATAATVSSTAEADPTLLATAHHPPPSA

SEQ ID NO: 132450 - protein, 130 aa, Glycine max
  Coding DNA Sequence Number=SeqID_40765
MRGAPTEESISPFLVRDFSAQNFKVVQAIHKAWETPLRKDQELRGIRNGIIGGYHEWLKVHIRGLDWLAKLKVVSEESFEAPEEDEEVRALKSELGKAKLAQEKFKLAATHIRKECAGLREENAIHRTSP

SEQ ID NO: 132451 - protein, 351 aa, Glycine max
  Coding DNA Sequence Number=SeqID_40766
  Homolog annotation: Hit_ID=Q6WAY6; Match level="QueryCoverage=42%, HitCoverage=33%, E-value=5e-19, Identity=33%"; Hit description =Putative uncharacterized protein
IPHMASQGDWVPFMDVLALLIFGVVLFPNIDGLVDLAAIDAFLAYHHSKESPVVAVLADLFDTFDRRIGGRAINWFPRWKEGKEGVLFSCGGYPNIPLIGTRGCINYNPALAIRQLGYPMRGAPMEESMSHFLVRDFGAQNFKAIQRIHKAWETPELGKAKLAKEKFKLAATHIRKECARLREENATTARALEQETKRARKEEYGRNKFRGALWGSNSELKLRREERDQSRAHSMVLKEELVSCSRSKRNLSQRLRETETNMLAIIAKYQAELGLATAHEHRVADEYAQLYTEKEARGRVIDSLHQEATMWMDRFALTLNGSQELPRLLAKAKAMADTYSAPEEIDGLLGY

SEQ ID NO: 132452 - protein, 123 aa, Glycine max
  Coding DNA Sequence Number=SeqID_40767
MAAQLIHDRVVMECLEVHPEQPARTLQQPVEWILPTPTPYRLVEPVQVIEVSSSEEDLEEDPKELPPEPGMDAPDLPEHDEDPLPDVDSPEDIMSASEADSTEESGPRGTANSDDSSSYQTAP

SEQ ID NO: 132453 - protein, 21 aa, Glycine max
  Coding DNA Sequence Number=SeqID_40768
DSVEFFIVLHRSSSVLRSFFN

SEQ ID NO: 132454 - protein, 274 aa, Glycine max
  Coding DNA Sequence Number=SeqID_40769
MGAKYLETVKQRLHAIKQWSPDEIRIDVKIGFVAMLQVQEAKNKLDVPKNAKEKVCDETKGHKLDITGDKDVQILDDTKSSRRSGTSTMDDEAIRLSGPNRRPHFEITKNSKRGNVKANMETDNLDSVQESKLETQLNTVPRKRGRKPNSLMNAEEAYDHSWISQETKPGKSANPERLAIAALLIHLLKNILLERISCIECLKLSSRFKSIYFLTLSSGPSHELRAVKEDENIAGNFKWARCKGRTTKNKARVRVGLAVKVQRKKEERLPRSEL

SEQ ID NO: 132455 - protein, 66 aa, Glycine max
  Coding DNA Sequence Number=SeqID_40770
MLTKKKPCRNVPFCERARARLTGALSKGGKMRGVATNVDKSGALAPTYPLSKRKSDLRSSFLGVNQ

SEQ ID NO: 132456 - protein, 120 aa, Glycine max
  Coding DNA Sequence Number=SeqID_40771
  Gene Ontology: Mol. function=helicase activity
  Homolog annotation: Hit_ID=Q8RV60; Match level="QueryCoverage=73%, HitCoverage=6%, E-value=2e-23, Identity=50%"; Hit description =Putative uncharacterized protein At2g05640
MLMDLTKNQMLGKVIAYEIDQIIAAEIPSQQDHPELHSLVKNHMVHGPCGTSNPRSPCMKEGNCSHFYPKIFQSHTVLDADGYPVYRRRNNGHTIEKNGVIIDNKLSQHALLRASEGEAH

SEQ ID NO: 132457 - protein, 90 aa, Glycine max
  Coding DNA Sequence Number=SeqID_40772
MSILEMFDRSHPGHASFLRPRSVIFSWPTSASIFFDQYRKCSIGVIGGDAFDFWTSIGHLSWTTSAIVFLNQCRRIMVVLPRWVNVFLAE

SEQ ID NO: 132458 - protein, 252 aa, Glycine max
  Coding DNA Sequence Number=SeqID_40773
  Homolog annotation: Hit_ID=Q84VH5; Match level="QueryCoverage=81%, HitCoverage=39%, E-value=9e-68, Identity=92%"; Hit description =Envelope-like protein
MDLIMAAGLLKTVTKLGDCYESLVREFIVNIPSDITNRKSDEYQRVFVRGKCVRFSPAVINKYLGRPTDGVVDITVSEHQIAKEITAKQIQHWPKKGKLSAGKLSVKYAILHRIGAANWVPTNHTSTVATENRLYPLHYKLFEGTHVPDIVSTSRKAAASGAVSKDALIAELKDTCKVLEATIKATTEKKMELERLITRLSESGIDDEEAAEEEEEAAEEDKEAAEEEEEAAEEEEDAAEETESDDDSEATP

SEQ ID NO: 132459 - protein, 75 aa, Glycine max
  Coding DNA Sequence Number=SeqID_40774
MTKCPSTTNFNFWWSVEGTTPTEWIHGRPNRQLPIWALQKVPPEGGCFWRKQPCSPGRAELAWASWAASISPILL

SEQ ID NO: 132460 - protein, 160 aa, Glycine max
  Coding DNA Sequence Number=SeqID_40775
  Homolog annotation: Hit_ID=UPI00006A2939; Match level="QueryCoverage =75%, HitCoverage=65%, E-value=2e-07, Identity=30%"; Hit description =UPI00006A2939 related cluster
MSKSCGFGMTGPLDESISCFLIRVDPWVLVPITFRGLHVLANRGLHALTFRGLHVLALRGLHALTLGLHVLALRGLHVLTIRGLHALTSRGLHVLALRGLHALTLGTSYPHRQRGLHVLALRGLHVLTIRGLHALTSRGLHVLALRGLHALTLGTSYPHR

SEQ ID NO: 132461 - protein, 126 aa, Glycine max
  Coding DNA Sequence Number=SeqID_40776
MTRRDKIWSFCTLVSSRGGGPDDTRRYLTIIRTLLSSRGGGPDDKQRQQCGHSVPLCHPEAAGPMTRGDTLRLSAPFCHPEGGGPDDTQRTLRSIRTLLSSRGGGPDDTRRTITVIRTLLSSRGPR

SEQ ID NO: 132462 - protein, 229 aa, Glycine max
  Coding DNA Sequence Number=SeqID_40777
MASMMEAMLSMKQLIEKNAATAAAVSSAAEADPTLLATTHHPPSNIVGRGRDTLGHDGSPHLGYNRAAYPYGLPPNYSPPVLQEDAGHIASPVHEREPPQHPDEVHKDPQDYARRDVEFYPPIPEGPAPGTLPQPNIAAPPIVLSMEGPPPATEERRKLDLLEERLRAVEGFGDYPFADMTDLCLVPDVVFPRSSKCRTSTSIKGRLVPKIISRCTAVRWAPTLKMKSY

SEQ ID NO: 132463 - protein, 222 aa, Glycine max
  Coding DNA Sequence Number=SeqID_40778
  Pfam annotation: Domain name=zf-CCHC; Domain location=200-217; Score =22.6; E_value=0.00058; Accession=PF00098.14; Description=Zinc knuckle
MSHHSSSVNGEGTSHKDPLSRILDELSTLKLWKEKQERKEKGKKRVEEISQDERKKIREEERRKIMKEMKREKHASYSSHNSCKSLSEELRDYYEGRHRSHLRPHSHRREKERKPQEANINLSYFRGKDNVEANLDWEIRVEQKLKKKSPSKSYGSHSYSKKDQGQGILRVAPSKPKDDKGKTIEKQPPKASMQEKTSSIKCFKCLGRGHITSQCPTKKPRL

SEQ ID NO: 132464 - protein, 39 aa, Glycine max
  Coding DNA Sequence Number=SeqID_40779
MENWRIALGNDIRGAPHSKAIMKHSSNLEGGGHMNSTRQ

SEQ ID NO: 132465 - protein, 71 aa, Glycine max; identical to SEQ ID NO: 111537
  Coding DNA Sequence Number=SeqID_40780
  Subcellular localization annotation: CTP_CleavageSite=26; ConfidenceScore=5.14e-01

SEQ ID NO: 132466 - protein, 174 aa, Glycine max
  Coding DNA Sequence Number=SeqID_40781
TPCPHHQQGCTPSPPEDYTGLHVLANRGLHALTLRGLHRATRPRHPEDCVSPRLERATRPHLEDCVYLTFRGLHALAFRGACPYLQRTTRPRRQRACAFTFVGLHALTFRGLHDSLPRLRKADTSYFTVRGYTPRLERTTRPHHQRAPISTRGLHVLALRGLHALTLGTSYPHR

SEQ ID NO: 132467 - protein, 277 aa, Glycine max
  Coding DNA Sequence Number=SeqID_40782
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVIFRHSGFCFYQLSLPVQLLTGWCVTAKAPARTSALASVAVTAARRVPFAIQAAQLLGRAIGAGLFAITPAGERGMCCKAIKLGIRCDAAVAFEEVVRVHGYGGEINPLGGARYQLLFPLVRVNFELGVIMVIAVSFGKPVVPAALMNRPTCGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132468 - protein, 90 aa, Glycine max
  Coding DNA Sequence Number=SeqID_40783
  Subcellular localization annotation: CTP_CleavageSite=38; ConfidenceScore=5.12e-01
MRLTQSYNSVILPQQVAILAYRGQLARCLTTVSIGPPSSRMRRESVALVSLVREQAAHLHGDSKCLNNPCYSMRFGIPRAIVSDQGTLFL

SEQ ID NO: 132469 - protein, 46 aa, Glycine max
  Coding DNA Sequence Number=SeqID_40784
MVSVKKIEAEVLPYRFRDVSVSKSVKVFCRSSPFFIDSSFVLRSST

SEQ ID NO: 132470 - protein, 323 aa, Glycine max
  Coding DNA Sequence Number=SeqID_40785
  Gene Ontology: Mol. function=helicase activity; Biological process =viral genome replication
  Homolog annotation: Hit_ID=Q2A9E0; Match level="QueryCoverage=95%, HitCoverage=22%, E-value=3e-76, Identity=46%"; Hit description =Putative uncharacterized protein
MPGKEPKFAQLYIYETENEVQNRINTMSHYNEIEAHIVSNLQKMLDENNAHAKSFRMARDRLTDTEVHNVRLKLIAGDIDANSNRDIIVETQNGQLQRIHELHCSYLALQYPLLFPYREDGYRPDILHRDTLSGTKRKRNRLTMREWFAYRLQCRPNEGQTLLHSRKLFQQFVAEGYTMIESERLSYVRNNQKKLRVDKFYSLQQSSDAGNTEGLSQGKRIILPSTFVGNPRYMDQLYFDGIAICSHVGFPNLFITFTCNPNWPEIHRLLTPLNLTSIDRPEIISQIFKLKYEQMLSDLTKNHLLGKVVACNLMLIPFSATNR

SEQ ID NO: 132471 - protein, 139 aa, Glycine max
  Coding DNA Sequence Number=SeqID_40786
  Gene Ontology: Biological process=transposition, DNA-mediated
  Homolog annotation: Hit_ID=Q1J7G7; Match level="QueryCoverage=29%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRLTFVAFPHMDTTITFH

SEQ ID NO: 132472 - protein, 34 aa, Glycine max
  Coding DNA Sequence Number=SeqID_40787
VLDRRLQEDWTRAVKEGPKVLMNLRVDFLSTWAK

SEQ ID NO: 132473 - protein, 194 aa, Glycine max
  Coding DNA Sequence Number=SeqID_40788
  Homolog annotation: Hit_ID=Q6WAY4; Match level="QueryCoverage=86%, HitCoverage=30%, E-value=4e-21, Identity=35%"; Hit description =Putative uncharacterized protein
MGTNQTGKRFYQVKIKGLDITSIKELGQLMGPLQMQAFRKAYEKILDLTIAEISTEAIATLAQYYDQPLRCFTFGDFQLVPTVEEFEEILGCPLGGRKPYLFFGFLPSLRKIAIVVRDLARGLDRVKQTRNDIVGLSRKYLEGKARDMANQDEWVPFMDVLALLIFGVVLFPNVDGLVDLAAIDAFLAYHRGIL

SEQ ID NO: 132474 - protein, 167 aa, Glycine max
  Coding DNA Sequence Number=SeqID_40789
  Homolog annotation: Hit_ID=A5BZZ9; Match level="QueryCoverage=76%, HitCoverage=13%, E-value=5e-09, Identity=33%"; Hit description =Putative uncharacterized protein
MVTRSTSKLINVLNEDSDQKSENAAEIGSRKDIDYPWKQDIIGNPTTNVITNWQVKDGELIQSELPPTTQYQLPNIKDSNNKPVMAIPFKTKDVNEEVTSRDIKSLMEQANYTNKYLQALGETIKTKVVPKQKSIEEASPSVPIEKPLFKPFKLVIRLNEKLGNLEN

SEQ ID NO: 132475 - protein, 48 aa, Glycine max
  Coding DNA Sequence Number=SeqID_40790
  Gene Ontology: Mol. function=oxidoreductase activity; Biological process=metabolic process
  Homolog annotation: Hit_ID=P0AFG9; Match level="QueryCoverage=100%, HitCoverage=5%, E-value=6e-18, Identity=85%"; Hit description =Pyruvate dehydrogenase E1 component
MGDTAEGKNIAHQVKKMNMDGVRYVRDRFNVPVADADIGKLPFVTFPE

SEQ ID NO: 132476 - protein, 214 aa, Glycine max
  Coding DNA Sequence Number=SeqID_40791
TSKTSVYVQDPGDSRYSVVLQGRPSGLNDTHDGSTRDICETTPFSTKIPSTNDSLHVDEVQANHNDHDEGLWETNNHGNTTSIPSQSNQQSEAMSRNTRRLTRLRMLTRRTLDQPRPIVTVDAATGWKDVPDTLKELVWNEILAKFDIPEALDAKKKVMSTMATRWRQFKSSLTSKFVFSISEDQHKEDPSVRYGFDAQIWEEFAATRKTPSWQ

SEQ ID NO: 132477 - protein, 106 aa, Glycine max
  Coding DNA Sequence Number=SeqID_40792
MPPPHQAGPDGPFDSEQYLRHVVRQQAANHRAYMQTHDCLYQLSLNLQSQGFTSFPCPTSDQFRAEVAWPGDWPEAPAEAPDEADEARENEEMIDLLDFLGGSGAT

SEQ ID NO: 132478 - protein, 77 aa, Glycine max
  Coding DNA Sequence Number=SeqID_40793
TLASIATPLGLEFIPQVKKLLDEAPLIELVRNHVPSWEDAQEMGVEGRSPRYEEPRYLRSNPFQGGGNDAILPRKGI

SEQ ID NO: 132479 - protein, 256 aa, Glycine max
  Coding DNA Sequence Number=SeqID_40794
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.15e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDTNTNTEAVSNQPQCRCWLMVVPQLNLPLKKALDRLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 132480 - protein, 69 aa, Glycine max
  Coding DNA Sequence Number=SeqID_40795
MENVLPLHKRCLPFINKMRQHEGQPFSQNFGHNFIDTSYERYGSIVIKRLRVFDLWDESYKRCIAAFWK

SEQ ID NO: 132481 - protein, 101 aa, Glycine max
  Coding DNA Sequence Number=SeqID_40796
MVKPSKSAKELRVIVSGILGHRKLQFLPPFPLGHYSHQRNSVHEKAPSFSSIQVSEKVFRNFFSPRKPYCFCFRLKLTTVIDYHNSVIDLQAVISGKVALW

SEQ ID NO: 132482 - protein, 89 aa, Glycine max
  Coding DNA Sequence Number=SeqID_40797
MEMIRKDELVLWVLQMVRGGDGQQQQWWRTFPFASSMIFPFDEVLTNFNWWNLNMSENDEDWALRDVIWLRIEGDMKAAVIDYRLSVLV

SEQ ID NO: 132483 - protein, 20 aa, Glycine max
  Coding DNA Sequence Number=SeqID_40798
GNTGFNKNKRRSLKVYQSHT

SEQ ID NO: 132484 - protein, 79 aa, Glycine max
  Coding DNA Sequence Number=SeqID_40799
MEQSSSASRDRSIFQNATHNTVDLLIHLRVYFPRTCCKAREQGLDQESFVWVGYGIQVVPGLMVLWWMMEMMVQRVNQR

SEQ ID NO: 132485 - protein, 233 aa, Glycine max
  Coding DNA Sequence Number=SeqID_40800
  Gene Ontology: Mol. function=helicase activity
  Homolog annotation: Hit_ID=A2Q378; Match level="QueryCoverage=67%, HitCoverage=12%, E-value=1e-34, Identity=38%"; Hit description =Putative uncharacterized protein
MVHGPCGILRPASPCMKEGKCSRFYPKKFQATTIIDGDGYPVYRRRNTGRTITKNGYDRVTVVMVHDDNETVPHANTPNDEMKEYMDCRYISPCESTWRIFGFPIHGRKPSVERLQFHLPGQHSVLYQDHDDIDDLLSNPSIYESKFIAWMNTNQAFVEEDQSHLKISEQLMVLNILHIEKQVLLWVFLQDDREFIAAIQEAKDWGLAPYLRNLFALLLLTDNQTLQVGLHIA

SEQ ID NO: 132486 - protein, 140 aa, Glycine max
  Coding DNA Sequence Number=SeqID_40801
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=74%, E-value=2e-24, Identity=67%"; Hit description=LacZ protein
  Subcellular localization annotation: CTP_CleavageSite=8; ConfidenceScore=5.07e-01
MVHQTQIQVDSKTSCVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132487 - protein, 58 aa, Glycine max
  Coding DNA Sequence Number=SeqID_40802
MPISPYERIAPAGHPVDPKKVPITPNKVIRPRINRAFIKKYCAPRQAEGETPQQPGDG

SEQ ID NO: 132488 - protein, 48 aa, Glycine max
  Coding DNA Sequence Number=SeqID_40803
  Subcellular localization annotation: CTP_CleavageSite=22; ConfidenceScore=5.30e-01
MPGRSSTRQFPSWKSGRHGRTKSNASFTFLSPTRALTTALPSPDASFH

SEQ ID NO: 132489 - protein, 70 aa, Glycine max
  Coding DNA Sequence Number=SeqID_40804
MGPITSRQFDLEGLVEGLPKVQKKPISAFMRDEDQHVSHHQQVQRIIKSSHGPRAQSGRRVCPSVRGKGG

SEQ ID NO: 132490 - protein, 52 aa, Glycine max
  Coding DNA Sequence Number=SeqID_40805
MGVQIAPRPIWALQKIPPEGGEEGKKEGESRKAFNRSSTFFIRSSSFFDLQR

SEQ ID NO: 132491 - protein, 200 aa, Glycine max
  Coding DNA Sequence Number=SeqID_40806
MALRKLASKRSRKDKAAEGTSSAPGYDSHRFRSAEHQQCFEAIKGWSFLRERRVQLRDDEYADFQGEIVRRRWASLVTPMAKFDPDIVLEFYANAWPTEEGVRDMRSWVRGQWIPFDADAISQFLGYPLVLEEGQECEYGQRGTGPMVLMRRSSPSCCVYRAGFCPDCCREASANHAHQHDHPDPDMDDVAAQQHPAQRS

SEQ ID NO: 132492 - protein, 174 aa, Glycine max
  Coding DNA Sequence Number=SeqID_40807
MEAMKEKMATMMEAMMSMKKIMEANAVTIAATSTVAKVNPMPPSGLNQMNHPTSAMVGKIWEVRAAPMMCKSKTSTPSRHMACLFNYTPPNVAYTPNKNTLEIPHHNLADFEPCLRYATKEQAVGGIPLQNTLEGPQYHPQLHLLHSTKSKTPHAMAEMGKLDHLEERLRASEG

SEQ ID NO: 132493 - protein, 126 aa, Glycine max
  Coding DNA Sequence Number=SeqID_40808
MELDTQNEILAQNKLLMQQIEALTKQIANFLSNITKHLVMDNKKMRPIICRTKPDLNKTFKEATKAIGVAQVQISLMAGDHIIMRTLVQITLRLQVLLTTLMEVLQIRVHNNNKLNQIDCPRWKIH

SEQ ID NO: 132494 - protein, 142 aa, Glycine max
  Coding DNA Sequence Number=SeqID_40809
MGEVEEMQEKMEAIKEQMATMMKAMMSMKKIMEANAVIVAAISAVAKVNPMLPSGLKQMNHPTSNMIGKDLGSTDDPMMCKFKTSTPSHHMACLPTIHHPMWHTLSMKISITPLRYSLRTNNLIRHISLKPWGRHMKFPTTI

SEQ ID NO: 132495 - protein, 182 aa, Glycine max
  Coding DNA Sequence Number=SeqID_40810
  Homolog annotation: Hit_ID=A5B7B4; Match level="QueryCoverage=67%, HitCoverage=8%, E-value=2e-10, Identity=31%"; Hit description =Putative uncharacterized protein
GNLGDLQPFDLEIDRTIDRLVRHSVHPGHFVHFEHFEHSKYSVAGDSEYSNFEHSTTNFHTENMAQPPPRERTLKEMATPDFTYESLCIQYHDEGVPHVLKIGLIHLLPKFHGLAGEDPHKHLKEFHIVCSTMKPPDVQEDHIFLKAFPHSLEGVAKDWLYYLAPRQLSGESLYEYWERFKK

SEQ ID NO: 132496 - protein, 112 aa, Glycine max
  Coding DNA Sequence Number=SeqID_40811
  Homolog annotation: Hit_ID=A0PAV3; Match level="QueryCoverage=33%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFRLRNCWEGRSVRASSLLRQLAKGGCAAKAIKLGNAKGFPSHDVVKRTAKWKL

SEQ ID NO: 132497 - protein, 53 aa, Glycine max
  Coding DNA Sequence Number=SeqID_40812
MGRLGVHNKTHHTMVRVTLFCENVPTIWDHHRLKGALKPSVSLPPGPRLRRIR

SEQ ID NO: 132498 - protein, 195 aa, Glycine max
  Coding DNA Sequence Number=SeqID_40813
MSRGSGDLGDARWGAIAQNQAWPILTQPEHSQSVRTCDVPKQASSWQSTNKRTKVHKARRLVWRLASYLSCVLSEKFPLGVWETLEGNERCRFRGTIQLTATSLVHPEQPACTLQQPLEWILPTPTPYRLVEPVQLIEVSLSEEDFEVDPEELPPEPAMDAPDLPEGDEDPLLILQRILCQHLRQTLQRRVALEG

SEQ ID NO: 132499 - protein, 152 aa, Glycine max
  Coding DNA Sequence Number=SeqID_40814
  Homolog annotation: Hit_ID=Q6WAY4; Match level="QueryCoverage=86%, HitCoverage=24%, E-value=5e-13, Identity=35%"; Hit description =Putative uncharacterized protein
MGTNQTGKRFYQVKIKGLDVSSLKELGRLMGPLQMQAFHKAYGKILHLTISEIFTEAVVSLTQYYDQPLRCFTFGDFQLVPTVEEFEEILGCPLGGRKPYLFSGFLPSLSKIAIVVRDSARELDRVKQTRNGVVGLPRKYLEGKARDMANQE

SEQ ID NO: 132500 - protein, 17 aa, Glycine max
  Coding DNA Sequence Number=SeqID_40815
LEGPSHPLKNAMRVVGK

SEQ ID NO: 132501 - protein, 89 aa, Glycine max
  Coding DNA Sequence Number=SeqID_40816
  Subcellular localization annotation: CTP_CleavageSite=54; ConfidenceScore=5.41e-01
MVKVGTSYVPINVSFSPKVGPGLPGINRDTRIYSFLTSSPPSQRCAHSHPPRLCAATGTLSAIAAFKVNRQLCAKGDRCGPFAYYASWR

SEQ ID NO: 132502 - protein, 88 aa, Glycine max
  Coding DNA Sequence Number=SeqID_40817
  Gene Ontology: Mol. function=nucleic acid binding
  Homolog annotation: Hit_ID=Q2AA09; Match level="QueryCoverage=72%, HitCoverage=23%, E-value=2e-09, Identity=45%"; Hit description =Retrotransposon gag protein
  Pfam annotation: Domain name=Retrotrans_gag; Domain location=29-88; Score=1.7; E_value=0.037; Accession=PF03732.8; Description =Retrotransposon gag protein
MADEQPRRVTLEDYSIRIAGVPEDVVRINLFSFSLSGEAKRWLHSFKGNSLRTWDEVVEKFLKKYFSESKTAEGKAVISSFHQFPDKS

SEQ ID NO: 132503 - protein, 92 aa, Glycine max
  Coding DNA Sequence Number=SeqID_40818
GASHSPFRLRNCWEGRSVRASSLLRQLAKGGCAARRLSWVRQCFPSHDVVKRRPVNCNTTHYRANWSSTAVAAALELVDPPGCRNSMVQRLK

SEQ ID NO: 132504 - protein, 138 aa, Glycine max
  Coding DNA Sequence Number=SeqID_40819
MVKVGTSYVPINALIFAKSWPRASRYVLGDAYRYRATSGVSPLTHHTRRLNCACATGLLPSPFGCATVREGPDRCRWRIGEKSSHRGGGRSELVDPPGDRKFRFFTPHLTPYARSFDAASGNGLRTGRRFPGRCQEDT

SEQ ID NO: 132505 - protein, 122 aa, Glycine max
  Coding DNA Sequence Number=SeqID_40820
MTTQLIHDRVVMECLEGVWETLEGNERCRFRGTIRITATSLVHLEEPARTLQQPVEWILPTPTPYRLVELVQVIEVSSSEEDLKEDPEELPPEPAVDALDFPEDDEDPLPDVDSPKDVHVSI

SEQ ID NO: 132506 - protein, 75 aa, Glycine max
  Coding DNA Sequence Number=SeqID_40821
MVNNPSEFNIHRKVESKRKAINIPCLKKEKIAGAGSLDIQTWNWKGGLVSSLEEFESISKGPTTLRAIGLRSTPN

SEQ ID NO: 132507 - protein, 126 aa, Glycine max
  Coding DNA Sequence Number=SeqID_40822
GGGAYGKTALPRPSHFPVKYLPGIFQEISAPPFPFCHIVKSYYNSLDTAYNVSANIHSPFRQRWPIHNSEGPHRSALPEQLRTEWRMGRAVAAALSAAGVVVSCSVCTPGYTCHADVRRVCLCAEL

SEQ ID NO: 132508 - protein, 173 aa, Glycine max
  Coding DNA Sequence Number=SeqID_40823
  Homolog annotation: Hit_ID=A5BEV8; Match level="QueryCoverage=99%, HitCoverage=33%, E-value=2e-15, Identity=27%"; Hit description =Putative uncharacterized protein
MVSRDALNQIASEVDRLRYLDTNPSSCGCVMRSTHGLPCACELSSNSPVKRSASCFEPPQPTRIIPMLDQFAPFIQGFIRDVVDVKADINYGYRSIAALLGMREDSWPLVSVDKWMDITEMGYVIASRYNVFLVSLSRQQSMTFFPLRSQPPPDSSGHRMICVGHVFGNHFVQ

SEQ ID NO: 132509 - protein, 122 aa, Glycine max
  Coding DNA Sequence Number=SeqID_40824
  Homolog annotation: Hit_ID=Q2HW90; Match level="QueryCoverage=54%, HitCoverage=13%, E-value=5e-07, Identity=46%"; Hit description =Putative uncharacterized protein
MANQEEWVPFADILALLIFGVVLFPNVDGLVDLAAIDAFLAYHHSKESPVVAILADLFDTFDRRCEKNSARIVCCLPALCVCLDSRFLQDQALPHNERFQVIQGTCNRLPIHVIDYQWFESV

SEQ ID NO: 132510 - protein, 280 aa, Glycine max
  Coding DNA Sequence Number=SeqID_40825
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLGTLWTQISPTGAPGIPRTDHRTLPVGQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 132511 - protein, 298 aa, Glycine max
  Coding DNA Sequence Number=SeqID_40826
  Homolog annotation: Hit_ID=Q84VI1; Match level="QueryCoverage=100%, HitCoverage=47%, E-value=1e-132, Identity=78%"; Hit description =Envelope-like protein
MATSSKETAASGSPSVPSSSHQEQPELNIQPIQIIPGQASVPEKLVPRRPQGVKIAENPSPATSPREVDTEMDKKIRSIVSSILKDASVPEADEDVPTSSNPNVSVPDVKKDVPTSSAPNAEALPSPSEEGSTEEDDQAAEETPAPRAPEPAPERLQSRKGKTPLKRSGRIKTMAQKKSTPITPATSRRSKVAIPSKKRKEISSSDSDDDVELDVSTSKRAKKSGKKVPENVPDAPLDNISFHSIGNVEKWKYVYQRRLAVERELGRDALDCKETMDLIKAAGLLKTVTKLGDCYEGL

SEQ ID NO: 132512 - protein, 289 aa, Glycine max
  Coding DNA Sequence Number=SeqID_40827
  Homolog annotation: Hit_ID=A5AFX7; Match level="QueryCoverage=22%, HitCoverage=28%, E-value=3e-10, Identity=57%"; Hit description =Putative uncharacterized protein
MSDSLVRVSRRAEWGAHRPTPGARRCRGTPRARAAIHNRDDDVLHEHINSPGLGHHRNPRRSMSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLSRSLAVTKGILVSFFPPLMICLNSAGRRALGLMASGATCVQRLDGSRDSAIHTKYRISLRSSSMQEPRYPLPRVIVCKCCVVTTPAGHRLRAPGSRT

SEQ ID NO: 132513 - protein, 171 aa, Glycine max
  Coding DNA Sequence Number=SeqID_40828
  Homolog annotation: Hit_ID=Q6L477; Match level="QueryCoverage=41%, HitCoverage=11%, E-value=2e-09, Identity=33%"; Hit description =Putative uncharacterized protein OSJNBa0009L15.8
  Subcellular localization annotation: CTP_CleavageSite=47; ConfidenceScore=5.43e-01
MATPPASPPPPPLDTSASPSTLKRTRKATRLRSLVTIPLGAERHVVNVDPATGKADGPHKKKLRTYLGIVARDKVDVTYDTWKEVPTAQKDLIWEDIQAEFEIPEASDSRTKKKILQIVDERWRQFKSDLTRKWALAADKDGVDDIVCEKYDISKEKCTQFCQTRRDPSWE

SEQ ID NO: 132514 - protein, 113 aa, Glycine max
  Coding DNA Sequence Number=SeqID_40829
MDPWVLVPIAFKGLHVLTFRRIHVLAFRGLHVLAFRGLHVLAFRGLHVLAFKGLHALTFRGLHAPAFRGLHVLAFRGLHALPFSYTPLPSEDYTSSPSEDCTSSPSEDCTSSP

SEQ ID NO: 132515 - protein, 306 aa, Glycine max
  Coding DNA Sequence Number=SeqID_40830
  Gene Ontology: Mol. function=nucleotidyltransferase activity; Biological process=transposition, DNA-mediated
  Homolog annotation: Hit_ID=A7MRB8; Match level="QueryCoverage=24%, HitCoverage=54%, E-value=3e-29, Identity=85%"; Hit description =Putative uncharacterized protein
  Pfam annotation: Domain name=DUF86; Domain location=88-160; Score =21.4; E_value=0.00031; Accession=PF01934.8; Description=Protein of unknown function DUF86
DLPSQVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQAHADVPWRSMRNMRNRMAHGYFDINLDVVWETVQEWLPALLQQLPAVRQDADDEDRNDNWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132516 - protein, 57 aa, Glycine max
  Coding DNA Sequence Number=SeqID_40831
AVHVFSIIKCEASGDWEARYSVVFQIGSFANPETSQKSKGSRLARSVKFRNVEEVEK

SEQ ID NO: 132517 - protein, 100 aa, Glycine max
  Coding DNA Sequence Number=SeqID_40832
  Subcellular localization annotation: CTP_CleavageSite=35; ConfidenceScore=5.46e-01
MHTQSFTIPHFPRIGLTHKNNPQWSRQLSQPTLLRASEARLTGASSEGGKCVESPPTFICGKRQKNRRKPVMKNIPDSGVVFTFEEGISTSHVCPKEQQP

SEQ ID NO: 132518 - protein, 176 aa, Glycine max
  Coding DNA Sequence Number=SeqID_40833
  Gene Ontology: Mol. function=aspartic-type endopeptidase activity; Biological process=proteolysis
  Homolog annotation: Hit_ID=A5BXN6; Match level="QueryCoverage=55%, HitCoverage=9%, E-value=6e-11, Identity=37%"; Hit description =Putative uncharacterized protein
MEEVEKEILERFRKVEVSIPLLDAIKQIPRYAKFLKELCTNKRKLKGSERISMGRNVFALIGTLSMEFGDITVHFNILDAMKHPSEDLSVFCVEIIDHIVDEYMTDLHPNLHACHSSCIESEFAHDHMSKFDAESESEFDIDYMSGDVLPLEIDFIESDRTNHVSGSTHTFDFLYE

SEQ ID NO: 132519 - protein, 16 aa, Glycine max
  Coding DNA Sequence Number=SeqID_40834
PTLILSLVKTISSKLE

SEQ ID NO: 132520 - protein, 135 aa, Glycine max
  Coding DNA Sequence Number=SeqID_40835
MGEVEEVQEKMKAYMEAMKEQMAMMMEAMMIMKKIMEASAVAVVATSTVAKVNPMPQSGLNQMNHPTSAMVGKDLGSMGAPHDVKIQNEHAFPPCGLPLNYTPPNMAYTPNKNVNNSTPIPIESQQPQTDHAHVS

SEQ ID NO: 132521 - protein, 56 aa, Glycine max
  Coding DNA Sequence Number=SeqID_40836
MGRGRGRGRRKKGEREGERQEKEEEGYTKAESECWERRKWEYTCTALPPFLLLLTF

SEQ ID NO: 132522 - protein, 77 aa, Glycine max
  Coding DNA Sequence Number=SeqID_40837
MDMTGMGGCGKAVWRKISCFEWFCVYSLILDLVVSTPWILIYQILPFVSTFGKISNGCDWHGRLWKSCVAEDFCVKP

SEQ ID NO: 132523 - protein, 21 aa, Glycine max
  Coding DNA Sequence Number=SeqID_40838
MALRRDRAGLDNCVWTRSARI

SEQ ID NO: 132524 - protein, 97 aa, Glycine max
  Coding DNA Sequence Number=SeqID_40839
  Homolog annotation: Hit_ID=A9PC27; Match level="QueryCoverage=44%, HitCoverage=93%, E-value=4e-07, Identity=72%"; Hit description =Putative uncharacterized protein
MAKGIRNLSSWMEVAPAPIIFPTKPSNSPALETITEEVAEDDEASMNTLLKRYSVMFMQNKYVFVLAYVWFKRKGKERKSEEGKMVESESFHCLEQS

SEQ ID NO: 132525 - protein, 66 aa, Glycine max
  Coding DNA Sequence Number=SeqID_40840
MVYVCCSGIYDEFWSVFVAGEEEMHEDQWMYDSMMSEEVDMNVENEEDAGVKVEHVDCSDAFNTSQ

SEQ ID NO: 132526 - protein, 347 aa, Glycine max
  Coding DNA Sequence Number=SeqID_40841
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q599J6; Match level="QueryCoverage=96%, HitCoverage=100%, E-value=1e-137, Identity=74%"; Hit description =Beta-3-glucuronyltransferase
  Pfam annotation: Domain name=Glyco_transf_43; Domain location=122 -329; Score=271.9; E_value=1.3e-78; Accession=PF03360.7; Description =Glycosyltransferase family 43
MGSLERSRKKVMLWKKAMVHFSLCFVMGFFTGFAPTGKSIFHSHVDYSNRSEFAPQPIEMSQKTLTNVNRSWIAPTARSLVHKQNTKLHVKIVPQLKPRRLIIIVTPTSTKHPFQTVILTRLANTIKLVPQPLLWIVVEGQTDSTELWKMLRKTGIMYRHLVSKENFTDLEAELNHQRNLALKHIVHHRLSGIVHFAELSNVYDLEFFQQLRHIEVFGTWPTALLAANMKKVIIEGPVCDSSQVIGWHLRNMNNETDTITPPIHISSFAFNSSILWDPERWGRTSSLQDTSQNSIKFVKEVVLEDEAKLKGIPPEDCSRILLWRFNFHARTTSNHKFLTTTSGVIRK

SEQ ID NO: 132527 - protein, 48 aa, Glycine max
  Coding DNA Sequence Number=SeqID_40842
MASMKRAAEHTDMVLRTYDACEIELICGGARFEVKRCLEDATGYSNIA

SEQ ID NO: 132528 - protein, 55 aa, Glycine max
  Coding DNA Sequence Number=SeqID_40843
MTIDLKYRKEFEPDPCEFVLAFFVGSEKKNPASLRSQQNNNNNNEDIAEDEERIS

SEQ ID NO: 132529 - protein, 58 aa, Glycine max
  Coding DNA Sequence Number=SeqID_40844
  Homolog annotation: Hit_ID=A7PT40; Match level="QueryCoverage=63%, HitCoverage=16%, E-value=7e-09, Identity=75%"; Hit description =Chromosome chr8 scaffold_29, whole genome shotgun sequence
METHAEIRVSKFKRVCVFCGSSPGKKRSYQDAAIELGMNWWKCLNFIIYDVLNGLVPL

SEQ ID NO: 132530 - protein, 104 aa, Glycine max
  Coding DNA Sequence Number=SeqID_40845
MDMDYKPDEAWIKDEKGSKKGIGKRKSVPLSGSDQGKKPKESSPEMLPEGEALGAKWRRRGAEEGEKGNELLKKKVLEGERDGAKENLNVEKHIAAAEVSAIGT

SEQ ID NO: 132531 - protein, 71 aa, Glycine max
  Coding DNA Sequence Number=SeqID_40846
MSFKKAFLEVHLHTFGKLLEKVLMAAVSEGKGLVEGVGGGAGIFVSIQVCFGATRSKKVVQEVKSATELGN

SEQ ID NO: 132532 - protein, 110 aa, Glycine max
  Coding DNA Sequence Number=SeqID_40847
KRKSAQYANRLSPRVGRFINAAGTTGFPTGKRAVSATQLIYDHDYEFELGTTSINKQNQQSKCVEKEQTYLDGGAARMLVVNGTESRRRRSVEENSSAEEEVYGNSAGCT

SEQ ID NO: 132533 - protein, 1423 aa, Glycine max
  Coding DNA Sequence Number=SeqID_40848
  Gene Ontology: Mol. function=nucleocytoplasmic transporter activity; Cellular component=membrane; Biological process=intracellular protein transport across a membrane
  Homolog annotation: Hit_ID=A7QFQ9; Match level="QueryCoverage=56%, HitCoverage=90%, E-value=0.0, Identity=62%"; Hit description =Chromosome undetermined scaffold_89, whole genome shotgun sequence
MGTGSTLAGKEVPIVGSDAVRWIDLSVPSSSNIAAVDGVAALPTTDDRASCFVIGDPPTYLIWRIHKAQPQSLELLELAASKEFPRVGLRFTFPDALCPFAFIGKNEISGASRFPYLLYVLTVSGVAYLLKIRNVSAYTSVSVFPVDELLEVNVRDYIPNHATAITTVMATVGGLVVGTSDGSVFCFQLGVVDPSAPGFMHELRDEAGISRLWGLISRGKMVGTVQELVILELHEKKFVFVLHLDGTLRIWDLASRSRVFSNNMGTVTMAAGLIVKDENLEMISLYSILYNFGDRIVFSMDPSVQSIPLEEGRCLDVKLTLDKIWILKDDELVSHTFSTNIDELLLPGVHHNATLYATLLEYSRHLGESELQTLTADGLKKEILSLIEHEVGSEKVSLLHCWKCFFTRYFHNWCKNNALYGLLVDSSSDAIGLIRKNSISLFRSLEDIERIVEVGSSEEVSELTGLVDIFNDDLDCDILIELLRCVISFSQQLGKTASSIFYESLLTTSVISSEDIVRYIVKILETGYCMSGPVLQTSTSGDHIVVLEKELADHKSLRKLSIDMFLSLQGLHKKASAWGRILKIAKVMFESAWDFLLFLSYLVDISGQSWLTELNAYTSDVVLTFLGMVQITTWGNDYGMRSLADMTLHWLIHSCSTLETGGSSTFLTRSIDLAFILFKHDQYGAAEQLLMIAEAHLLKEKTSQSIQDDDGGWCIRHHLLGCCLLAQVQCGLHATQKDKKVSEAIRCFFRSSSGNGASEALQSLSDDLGIPYLGFSEYCYGCTSIAAWKLQYYQWAMQLFERYSISEGACQFALAALEQVDEALYMKDDKCTNNSVNESVTTIKGRLWANVFIFVLDLGRYYDAYCAIISNPDEESKYICLRRFIIVLYEQGAIKILCSNKLPLIGLVEKVEQELAWKAERSDISAKPNLYKLLYAFQLHRHNWRRAASYMYLYSARLRTEAALKDSVGSSLMLQERLNALSSAVNALHLVHPAYAWIDSLAEGSYLVNEYYPSKKAKRTPDEHSAADNDAEPQGWQSSIDIEKLENEFVLTSAEYMLSLVNFKWTFSGKHGALSDLADLLVQNNLYDMAFTILLRFFKGSGLKRELERVLSAISLKCCLDKVESSWVEEHSHLLTSSKHEMVAHGSPATVSTTPQTDRNSCWATLKLYLEKYKEFHGRLPIIVAETLLRTDPKIELPLWLVQLFKEGQKERLWGMAGRESNPASLFQLYVSYDRYAEATYLLLDCIDSFASMGFKMYEESFWVLFCVNGTQGKVVFQEGYSSLYYPMNDQGCHQLATECLGQSFWPLPDLGATKDVTDSVLLYGVLSFSYGDSFLLKWVAISSPVMLIFMTRPADIIRRKRPLAVWFPYTTIERLLYQLDELIRMGRMVDHCDKLKKMLHDSLQNHLKMLKVDSDDAVSVSS

SEQ ID NO: 132534 - protein, 52 aa, Glycine max
  Coding DNA Sequence Number=SeqID_40849
  Homolog annotation: Hit_ID=A0MDV0; Match level="QueryCoverage=92%, HitCoverage=62%, E-value=2e-12, Identity=70%"; Hit description =Putative uncharacterized protein
MSVLMHVMMTKIHPVGKVYHFRAKRQMAESLGQIAKFRRRFGLENSEGNEKK

SEQ ID NO: 132535 - protein, 72 aa, Glycine max
  Coding DNA Sequence Number=SeqID_40850
  Homolog annotation: Hit_ID=A7PT74; Match level="QueryCoverage=84%, HitCoverage=72%, E-value=3e-13, Identity=58%"; Hit description =Chromosome chr8 scaffold_29, whole genome shotgun sequence
  Pfam annotation: Domain name=Auxin_inducible; Domain location=1-68; Score=3.5; E_value=1.7e-05; Accession=PF02519.5; Description=Auxin responsive protein
MSIYFYEFNYKRQEIKGEETKRFIVGLDYLHDPAFLGLLDKAQEEYGFRQKGALALPCRPQELQKILDGPKA

SEQ ID NO: 132536 - protein, 132 aa, Glycine max
  Coding DNA Sequence Number=SeqID_40851
  Homolog annotation: Hit_ID=A7PT74; Match level="QueryCoverage=78%, HitCoverage=74%, E-value=5e-21, Identity=55%"; Hit description =Chromosome chr8 scaffold_29, whole genome shotgun sequence
  Pfam annotation: Domain name=Auxin_inducible; Domain location=13-113; Score=40.0; E_value=2.1e-09; Accession=PF02519.5; Description=Auxin responsive protein
MDFKMLRSFVEKIEKGLSLIAPKKPGLNYFNENQVETTTNVVPEDVVSKGYFAVVAIKDGEIKRFVVELDYLANPAFLGLLDQAGEEYGFKQQGTLAVPCRPQELQKILDGWRVIPDNSKGAGRAIYFPKFL

SEQ ID NO: 132537 - protein, 123 aa, Glycine max
  Coding DNA Sequence Number=SeqID_40852
  Homolog annotation: Hit_ID=A7PT74; Match level="QueryCoverage=65%, HitCoverage=74%, E-value=6e-21, Identity=59%"; Hit description =Chromosome chr8 scaffold_29, whole genome shotgun sequence
  Pfam annotation: Domain name=Auxin_inducible; Domain location=10-122; Score=45.5; E_value=1.8e-10; Accession=PF02519.5; Description=Auxin responsive protein
MCMCSASIQINQNLAEKDNIKGILLYEKGVSHFVHKNPPLRYLNEATTTSVVPDDVREGYFAVLTTNGGESKRFIVGLHYLNDPAFLGLLDQAEEEFGLRQKGALAIPCQSQELQKILECCRV

SEQ ID NO: 132538 - protein, 287 aa, Glycine max
  Coding DNA Sequence Number=SeqID_40853
  Gene Ontology: Cellular component=chloroplast
  Homolog annotation: Hit_ID=A9PJV2; Match level="QueryCoverage=53%, HitCoverage=69%, E-value=7e-76, Identity=90%"; Hit description =Putative uncharacterized protein
MMFEAGLGLLLKVELMAADAKADVVGEGKMMMAHSHYLLHIPSLSSLSASLTSPPRSLLPVRTLQPKTLSCRVPSFPTRTPWHFKPLHFALSGALSLGLLFGVVELKLKVSNFVGIGVAEAAKVGVNKPELLPKEFSTVIDVAGFLSDGQEKRLAEEIAALEADTGFKLRVLAQNYPVTPGLAIKDFWQVDDRTVVFVADPTFGNILNFNVGATVDLDVPRSFWNRLAGKYGNIFYWKEKGEDASIEAAVMAISSCLREPVGPNNCSEEVTGFVILVSSWKVTDTWN

SEQ ID NO: 132539 - protein, 136 aa, Glycine max
  Coding DNA Sequence Number=SeqID_40854
  Homolog annotation: Hit_ID=A9PDV8; Match level="QueryCoverage=52%, HitCoverage=65%, E-value=7e-19, Identity=61%"; Hit description =Putative uncharacterized protein
MVEEPENNPAPPKPPIPSAPDAAKEIAAPATTSQPSAEVADPLALASKRQRHPSVHLGEIGDQHKGLLKITEEEFSGPPLNVVIEVTLGLVFCMWAALTVPGKFLSIHPHSEENRTSKDPMKDDMLPLTLGMNIVI

SEQ ID NO: 132540 - protein, 649 aa, Glycine max
  Coding DNA Sequence Number=SeqID_40855
  Gene Ontology: Mol. function=transcription factor activity; Cellular component=plastid; Biological process=regulation of transcription, DNA-dependent
  Homolog annotation: Hit_ID=Q9LD95; Match level="QueryCoverage=87%, HitCoverage=100%, E-value=1e-125, Identity=45%"; Hit description =Sigma factor-like protein
  Pfam annotation: Domain name=Sigma70_r1_2; Domain location=319-355; Score=11.9; E_value=0.025; Accession=PF00140.11; Description=Sigma -70 factor, region 1.2
  Pfam annotation: Domain name=Sigma70_r2; Domain location=410-483; Score=13.8; E_value=0.017; Accession=PF04542.5; Description=Sigma-70 region 2
  Pfam annotation: Domain name=Sigma70_r3; Domain location=487-568; Score=45.6; E_value=1.7e-10; Accession=PF04539.7; Description=Sigma -70 region 3
  Pfam annotation: Domain name=Sigma70_r4; Domain location=581-634; Score=87.8; E_value=3.5e-23; Accession=PF04545.7; Description=Sigma -70, region 4
  Pfam annotation: Domain name=Sigma70_r4_2; Domain location=575-632; Score=13.4; E_value=0.029; Accession=PF08281.3; Description=Sigma-70, region 4
  Pfam module annotation: Pfam domain module=Sigma70_r1_2::Sigma70 _r2::Sigma70_r3::Sigma70_r4::Sigma70_r4_2; Domain location=319 -355::410-483::487-568::581-634::575-632
MRERDGDVIAGVAVEGGRCCREGWLPKEMPSQGGVKIERMKKGGVRIGRWEDSSPKLLSQLKLVELDRNRARSSRIPQAMEFARTMFCSSPPFPPRTHHPWSTLPSSSSTSSAQNFPASVLLPEQRDEYRPLLHMSKEDKTSQAMLSTRQMDTVTVHEENNTENADQVVLDFRKHLHHWPNLQYLLTSSQIGEVAASSTLEHVSVDLERRPNGVQFNGVSLAKKALSTSKQESSVVEDLKSIKADDDSIPFGLASTSLADPSIGRNKTVRSTRLLERRSKQRKVPKSKVIDDETYLARKDDAQEKLRAEKKKNEELDQDDPLRLFLWGPETKQLLTLEQESQLISQIQDLLRLEEVKTNLQSQFGREPTMAEWAEGAGLNCRLLQSQLHSGLTTGSLLEIKDLPFPVAKAVQCLHGFPVNQDSWLFLNVKEIHQDKKTIDEGSMGLMKSVEKFNPLAGSRFGNYAFWWIRQAIRKAVFRHSRTIRLPEKVFILLGKVMEAKKLYIQEGNLHPTKEELARRVGVTVEKIDKLLFSARIPISMQQTVWADQNTTFQEITADPTVEATDVTVEKQLMRRHVLNVLSVLHPKERRIIRLRYGFEDGEQKSLSEIGDIFGLSKERVRQLEIRALYKLKKCLVKQGLDAYVDLLL

SEQ ID NO: 132541 - protein, 134 aa, Glycine max
  Coding DNA Sequence Number=SeqID_40856
LLPNKPTYNSKPQETQHKDAQAKVEYVKRLYDQVKVQIAKKNESYAKQANKNRKEVVLEPGDDPGHLRANAFQEGGNDENPETAQIQAKGPSGKGRRPKWRRMKAQVEKDEGSGAETLSRLLIVAEGPDEFEGP

SEQ ID NO: 132542 - protein, 125 aa, Glycine max
  Coding DNA Sequence Number=SeqID_40857
  Gene Ontology: Mol. function=protein binding; Biological process =auxin mediated signaling pathway
  Homolog annotation: Hit_ID=Q9SJK4; Match level="QueryCoverage=100%, HitCoverage=100%, E-value=3e-28, Identity=50%"; Hit description =Putative auxin-induced protein
  Pfam annotation: Domain name=Auxin_inducible; Domain location=17-114; Score=77.5; E_value=4.2e-20; Accession=PF02519.5; Description=Auxin responsive protein
MKSRFLRGCLNKCKKMCLNKCISCEDCCEWALWSSSNFHEACSNNIPSDVPKGHLVVYVGENHKRYVIKVALLHHPLFRALLDQAQEEYDFIADSKLCIPCDEHLFLSVLRCASSPQNQRVCLCL

SEQ ID NO: 132543 - protein, 40 aa, Glycine max
  Coding DNA Sequence Number=SeqID_40858
MVGIKGGKDAQGGVGGEVIAVVRLRGRISGSPCATWHFQM

SEQ ID NO: 132544 - protein, 78 aa, Glycine max
  Coding DNA Sequence Number=SeqID_40859
MTVTTSVGMTIAIVITITVMTVIVVITVAATTANNNVDDGGGDNDNHDDYCNGSHGGGNDGDEGHDSKGDLKCHYMKH

SEQ ID NO: 132545 - protein, 105 aa, Glycine max
  Coding DNA Sequence Number=SeqID_40860
MDQDEVQNQPMQKEIKRNLIRLANIAKRKVILHLDAGKNLMLSAMSAIKWDMKLLFVETRINHMVKLQGLLIKRKRTTKGQEKSTLEIAGAYKQEDTIEREKCKN

SEQ ID NO: 132546 - protein, 94 aa, Glycine max
  Coding DNA Sequence Number=SeqID_40861
  Homolog annotation: Hit_ID=A2I5F0; Match level="QueryCoverage=98%, HitCoverage=49%, E-value=1e-27, Identity=65%"; Hit description =Polynucleotidyl transferase
MEAWNRLHDIFQDNKHSCVVTLEYDFTHTTMEAFSSVSAYCQHLKSLSDQLKNVGFPIDNSRLVLQLVSSLTEPYKGVTTLIRQSDPLPQFYQA

SEQ ID NO: 132547 - protein, 201 aa, Glycine max
  Coding DNA Sequence Number=SeqID_40862
  Gene Ontology: Mol. function=metal ion binding
  Homolog annotation: Hit_ID=Q2HV40; Match level="QueryCoverage=53%, HitCoverage=32%, E-value=2e-17, Identity=46%"; Hit description=Zinc finger, RING-type
MGNIGSSGSNSRWRHGGGGGSGRRIHPPPPPVMSPPEVTANRFVYPPAATPYHNYPGYYPPPTTMPAPLPAPYDHHHRPAVDPMWVRYPPAAPPAPAPYVEHQKAVTIKNDVNIKKETLRIEPDDENPGCFLVSFTFDATVSGREVKKLLILFCMGFCYLLEIESEVDQCTLMANEVVTVIDWLRMEGGHIRGESDNFVVV

SEQ ID NO: 132548 - protein, 70 aa, Glycine max
  Coding DNA Sequence Number=SeqID_40863
MQVCARHEIGSQICMKWLRKSFSRRDLEESPFDSHRFQSVMHQQRFEAIKGWSFHRERRVQLREDEYKNF

SEQ ID NO: 132549 - protein, 72 aa, Glycine max
  Coding DNA Sequence Number=SeqID_40864
MHESLILVPALQSHWLMMHVTLLEDPTLFSAIYFYGEFKKLQYKRKPLWAEIGRHAALRKQCYEHLGSSPKE

SEQ ID NO: 132550 - protein, 254 aa, Glycine max
  Coding DNA Sequence Number=SeqID_40865
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132551 - protein, 53 aa, Glycine max
  Coding DNA Sequence Number=SeqID_40866
MEYLLVGDEQKRKTESKMRKMMTPRAANSGVSYPNFVRGPLLDDMRPFFGPRE

SEQ ID NO: 132552 - protein, 65 aa, Glycine max
  Coding DNA Sequence Number=SeqID_40867
QKNVYTDNHSGISARQRDSKVSMTDLVSAEDDVNLRVSSGPPPLDDKRAQNDHNLSLRAIGHDCV

SEQ ID NO: 132553 - protein, 98 aa, Glycine max
  Coding DNA Sequence Number=SeqID_40868
  Gene Ontology: Mol. function=phosphoprotein phosphatase activity
  Homolog annotation: Hit_ID=A7PFP6; Match level="QueryCoverage=71%, HitCoverage=20%, E-value=1e-11, Identity=40%"; Hit description =Chromosome chr11 scaffold_14, whole genome shotgun sequence
MSVAWCAVVPLICFHVVEWHQPDRVLRQFGMQQPIPESPSQPQNIHGLTLKGKQDENWFQLLAPMISQWNNRADFRVDIYPRQEGLFSFNSDYMSFKQ

SEQ ID NO: 132554 - protein, 186 aa, Glycine max
  Coding DNA Sequence Number=SeqID_40869
  Gene Ontology: Biological process=transposition, DNA-mediated
  Homolog annotation: Hit_ID=Q1J7G7; Match level="QueryCoverage=20%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISYRLRDPIKLIDTVDLEGGPVGKPVVPAALMNRPTRGERRFAYWALAECILAYYVGTDEGVSEVLHVAGEKRLH

SEQ ID NO: 132555 - protein, 118 aa, Glycine max
  Coding DNA Sequence Number=SeqID_40870
MALARASVKNFVTIMKEDIGHLRPHSHRREKERKPHEANINLPYFYGKNNVEAYLDWEIRVEKQLKRKSTSKSYGSHSYPKKDQAKMRLLLHLPIVKVKKQKGKNPVKKSTPKKKDNL

SEQ ID NO: 132556 - protein, 109 aa, Glycine max
  Coding DNA Sequence Number=SeqID_40871
  Subcellular localization annotation: CTP_CleavageSite=55; ConfidenceScore=5.41e-01
MDVWGANTFPVRKYNSRTFHLKVRRSRLFRFFRRFPQINVGGDSARIPFVEHASRESTRRPPAEGNDSHSIGSSLLLILFICLKLPIHQSRIIKFASSQTHFDPFVGEN

SEQ ID NO: 132557 - protein, 210 aa, Glycine max
  Coding DNA Sequence Number=SeqID_40872
  Gene Ontology: Mol. function=nucleic acid binding
  Homolog annotation: Hit_ID=Q2AA09; Match level="QueryCoverage=71%, HitCoverage=51%, E-value=1e-09, Identity=31%"; Hit description =Retrotransposon gag protein
MERSMIDAASGGALGDMTPAEARNLIEKMASNSQQFSTRNDAIVIRGVHEVATNPSASSETKKLEGKLDALKSVPVAKVCGLCSSADHHTNLCPSMQQPGAIEQPEAYAANIYNRLPQPQQQNQPQQNNYDLSSNRYNPGWRNHPNLRWSSPQQQQQQPALSFQNAAGLSRPYIPPPIQQQQQPQKQPTVETPPQPSLEELVRQMTMQNM

SEQ ID NO: 132558 - protein, 525 aa, Glycine max
  Coding DNA Sequence Number=SeqID_40873
  Gene Ontology: Mol. function=nucleic acid binding; Cellular component= plasma membrane; Biological process=intracellular protein transport across a membrane
  Homolog annotation: Hit_ID=A1FWN3; Match level="QueryCoverage=100%, HitCoverage=57%, E-value=0.0, Identity=98%"; Hit description =Preprotein translocase, SecA subunit
  Pfam annotation: Domain name=Helicase_C; Domain location=191-303; Score=4.7; E_value=0.017; Accession=PF00271.22; Description=Helicase conserved C-terminal domain
  Pfam annotation: Domain name=SecA_DEAD; Domain location=1-125; Score=- 103.2; E_value=2.9e-10; Accession=PF07517.5; Description=SecA DEAD -like domain
  Pfam annotation: Domain name=SecA_PP_bind; Domain location=1-81; Score=115.8; E_value=1.3e-31; Accession=PF01043.11; Description=SecA preprotein cross-linking domain
  Pfam annotation: Domain name=SecA_SW; Domain location=341-525; Score =190.9; E_value=3.1e-54; Accession=PF07516.4; Description=SecA Wing and Scaffold domain
  Pfam module annotation: Pfam domain module=Helicase_C::SecA _DEAD::SecA_PP_bind::SecA_SW; Domain location=191-303::1-125::1 -81::341-525
MEHAEQLLVEAGILDGETEGLYAPQNLTVVHHLNAALRAHAIYQRDVDYIVRDGEVVIVDEFTGRTLSGRRWSDGLHQAVEAKEGVPVQRENQTLASITFQNLFRMYKKLSGMTGTADTEAFEFQSIYGLEVVVIPTNRPTIRKDSPDQVFLNRKGKFNAVLADIEECAKRGQPVLVGTTSIETSEMLSEHLRKAGVKHEVLNAKQHDREATIVANAGRPAAVTIATNMAGRGTDIVLGGSLEAEIHELGEDATDEQKAAVKAEWQKRHEAVKAAGGLHIVGTERHESRRIDNQLRGRSGRQGDPGSSRFYLSLEDNLMRIFASDWVQKAMRMMGMKEDDVIEDRLVSRQIEKAQRKVEAHNFDIRKNLLDFDDVNNDQRKVIYAQRDELLDAESVKDNVDGIRDDVIFDVVARFVPPNSIDEQWDLRGLEATLESDFGLQMSLTDLVKSHEELDAEAIAAKVQERVNQHFAEKEAGVGEETMRALEKHVMLTVLDQSWKEHLARMDYLRQGIYLRGYAQKQPKQ

SEQ ID NO: 132559 - protein, 144 aa, Glycine max
  Coding DNA Sequence Number=SeqID_40874
MSLHWKRGSGHFMFLHHPLLLYNNFFLLLLLMGRLFGLDLSLLLPKDAFNLYSKAKSFQSLVFISNSLGQFLLPLLLNVILVHWRNNDEVALVDNGLLGVIIHSFEDMEDLVFQKNFVDEGGIVDVIHSSQSLHIPQDVDLDCV

SEQ ID NO: 132560 - protein, 112 aa, Glycine max
  Coding DNA Sequence Number=SeqID_40875
LGRIDGDLVLRETRIRATWEYVSSVEGGQQGMVGLYVICGCGELFCTIARPPPSTTCDGVVPRDMSQGSRDLGDIRRAPGSQQIIGTKTTKQGGLCGGWPAVNFECYMGYGL

SEQ ID NO: 132561 - protein, 189 aa, Glycine max
  Coding DNA Sequence Number=SeqID_40876
YMMNSVITILYFNGRVYEETDGVIFEGSKKAIQIKRGISFNALKKIGDKVKLEDNEIISAISCRFLDFEKYVALQICDDEDVETMLESFQQQNQMSILELYIEKDVAGGSMFHSANSLKSCENNLSNNEAQPPTNVSNLHGDEDDDDYLVSNSYVEESLDEDDSVDGISDTDNEVTDMIQPVRIVHPTE

SEQ ID NO: 132562 - protein, 118 aa, Glycine max
  Coding DNA Sequence Number=SeqID_40877
LKYLLQKADSKPRLIRWIPARFKSFDYRRSFPVNALDLPAVHDQRCIPDHRRLSFKVAFAFFHTSRRSPGLFKGQLAKCLTVRAFIDPPSTEMCGRFVALVSRSESKKCIGDCPCSEN

SEQ ID NO: 132563 - protein, 70 aa, Glycine max
  Coding DNA Sequence Number=SeqID_40878
  Subcellular localization annotation: CTP_CleavageSite=53; ConfidenceScore=5.13e-01
MIVKKAFMFGQKVLFYNSRLGLMSVGIKSDSTNKSFKVNGHRLKLFLPNLFLVAVVVEKTSFLHPPLPPP

SEQ ID NO: 132564 - protein, 110 aa, Glycine max
  Coding DNA Sequence Number=SeqID_40879
  Subcellular localization annotation: CTP_CleavageSite=86; ConfidenceScore=5.34e-01
MGKDRTHKTPSGPGKVQQGPGVSSSGYGPLSVLQGARTPPAKLCHHSSTEYLSPPARSSGPLLIELSSRGTAPSGRRRARHHSSIRMAGSGAIDAPPPPLEFTSAHPQKS

SEQ ID NO: 132565 - protein, 72 aa, Glycine max
  Coding DNA Sequence Number=SeqID_40880
  Homolog annotation: Hit_ID=A0ST23; Match level="QueryCoverage=37%, HitCoverage=55%, E-value=2e-08, Identity=100%"; Hit description =Putative reverse transcriptase
MGDFISRLSFPGRRIVFHSKIKLIDTVDLEGGPVGKPVVPAALMNRPTRGERRFAYWALAECILAYYVGTDE

SEQ ID NO: 132566 - protein, 86 aa, Glycine max
  Coding DNA Sequence Number=SeqID_40881
MTDDRWMHFSDYVVAVGELCVVPGQDDYEGYEVITERLECVLNLRTVIVGIELHDIMQDCLRIARGVPVQMEVLGLDKDDAQSIDD

SEQ ID NO: 132567 - protein, 65 aa, Glycine max
  Coding DNA Sequence Number=SeqID_40882
MMMQSYPARSLDRDPREGPRVLMSLRLSSSFFRNLLKEASQGGELSYEKKLLKEVFSRKLLKEAT

SEQ ID NO: 132568 - protein, 141 aa, Glycine max
  Coding DNA Sequence Number=SeqID_40883
MTLLLSNILPSDRNANHPLQKYQLVYVVPTWGSHPQDTQWTRKSPTGPWGFQLWLRASISPIGCPYPPGKGSRLQDTQWTRRSPTGSWSCQALITGLCQFYGVPVTSSKGIRPPTDRAFIKKYCVPRQAQGETPQQHWDGR

SEQ ID NO: 132569 - protein, 104 aa, Glycine max
  Coding DNA Sequence Number=SeqID_40884
MGLKSRTHMSNQLNFKICTNSKTKGENLYDDKGDDKKLKDQSKNNSSESKINQRTTQVNQEEFKTQEESLESRIKIQGSISQESRSRFKTQDSRIKRRLNQDKY

SEQ ID NO: 132570 - protein, 203 aa, Glycine max
  Coding DNA Sequence Number=SeqID_40885
  Gene Ontology: Cellular component=mitochondrion
MDDVGASSQSSLPTVNPTPDPAAPAEPQAPDPDLSLPLLDDNARRAELNERGGFLHFGDLSDQQKDKVLNAQVKIERAIEKALLSDGYSRDELSQRNKRDEIRGFLFYRNGKLLSMKTYDSYVKEVELGTHRSQPYKFLFERGYPQIITRPVPEMGRGRRSGHVGLPSLDYLGCPFGFLSKLTNPINVHKSTYAFHTYPETAT

SEQ ID NO: 132571 - protein, 205 aa, Glycine max
  Coding DNA Sequence Number=SeqID_40886
  Gene Ontology: Mol. function=hydrolase activity, acting on carbon -nitrogen (but not peptide) bonds; Cellular component=cellular _component; Biological process=N-acetylglucosamine metabolic process
  Homolog annotation: Hit_ID=A8GB40; Match level="QueryCoverage=100%, HitCoverage=54%, E-value=1e-108, Identity=95%"; Hit description=N -acetylglucosamine-6-phosphate deacetylase
  Pfam annotation: Domain name=Amidohydro_1; Domain location=16-190; Score=-15.5; E_value=8.8e-05; Accession=PF01979.11; Description =Amidohydrolase family
MVEPHVIKQLTEAGIVVSAGHSNATYDQARTGFAAGISFATHLYNAMPYITGREPGLMGAIFDTPEVYTGIIADGHHVAWASIRNAKRLKGDKLVLVTDATAPAGADIDQFIFAGKTIYYRDGLCVDENGTLSGSALTMIEAVQNSVEHIGIALDEALRMATLYPARAIGVEHRLGTIEAGKVANLTAFTRDFKITKTLVNGNEV

SEQ ID NO: 132572 - protein, 135 aa, Glycine max
  Coding DNA Sequence Number=SeqID_40887
  Homolog annotation: Hit_ID=Q6UUU1; Match level="QueryCoverage=52%, HitCoverage=46%, E-value=4e-19, Identity=71%"; Hit description =Putative uncharacterized protein
MTGLPGEFSDDMESSNNEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDTLTG

SEQ ID NO: 132573 - protein, 118 aa, Glycine max
  Coding DNA Sequence Number=SeqID_40888
  Homolog annotation: Hit_ID=Q9JKS4-3; Match level="QueryCoverage=83%, HitCoverage=11%, E-value=2e-07, Identity=32%"; Hit description =Isoform 3 of Q9JKS4
MTGPLKESISCFLIRVDPRVLVLSPIEGYTPSPSEDYMSSPSEDCTSSPSEAYAPSPSEDYTSSPFEGCMPSPSEGYTSLPSEDYTSSPLEGYTPSPSEDYTSSPSEGYVSSPLVGIL

SEQ ID NO: 132574 - protein, 111 aa, Glycine max
  Coding DNA Sequence Number=SeqID_40889
MEIYVSDRLGKIVIIEKGEIVEAKLHEESRLIQRCFDDNKDDDKGDNEKLKGQSKNEFKMFKIESSTLQDSRGKLISRIKNQDSRIKLPRIKIKIQESREDLIKISMKRFF

SEQ ID NO: 132575 - protein, 76 aa, Glycine max
  Coding DNA Sequence Number=SeqID_40890
MHLRDQGSLLNNKEKNKMKDCKNTSGEDVSFISRISQSLTNSSQALKPAPASSSGLYRSSHNKISQNSLELGPFYL

SEQ ID NO: 132576 - protein, 119 aa, Glycine max
  Coding DNA Sequence Number=SeqID_40891
MVVPSSPRVSIKEICVDPSGNDPKTDDSDKCRLYIEANPPCLVALGRVFEGSTIHNIPLLPGHVKVGVEEVKDAQAPVPVPTDEATVSPAKPPQRPDPEVDDPLYLMTLTIPELFLKPF

SEQ ID NO: 132577 - protein, 77 aa, Glycine max
  Coding DNA Sequence Number=SeqID_40892
  Gene Ontology: Mol. function=phosphate binding; Cellular component =integral to membrane; Biological process=protein stabilization
  Homolog annotation: Hit_ID=Q2PMQ6; Match level="QueryCoverage=70%, HitCoverage=73%, E-value=3e-23, Identity=100%"; Hit description =Photosystem II reaction center protein H
  Pfam annotation: Domain name=PsbH; Domain location=20-71; Score =112.3; E_value=1.5e-30; Accession=PF00737.11; Description =Photosystem II 10 kDa phosphoprotein
MDVKLARSQEMMERLKPQWQEEQGDLLKPLNSEYGKVAPGWGTTPLMGVAMALFAIFLSIILEIYNSSILLDGISMN

SEQ ID NO: 132578 - protein, 82 aa, Glycine max
  Coding DNA Sequence Number=SeqID_40893
MENSSLTVNHLIQPYFNLLSENQLRVVNTRLGTTYTRKTARKPHYKRNLKESWASSSKGNNTRKSSLPWIQTENAMKHEAET

SEQ ID NO: 132579 - protein, 87 aa, Glycine max
  Coding DNA Sequence Number=SeqID_40894
  Subcellular localization annotation: CTP_CleavageSite=64; ConfidenceScore=5.10e-01
MPDGDIRFTLATTLVAAIATALASIIFFTLIMASIIAAICSFMASMSASIYSCTSSALPITLALAQERGAMSNATNEGNGCMRMMQN

SEQ ID NO: 132580 - protein, 69 aa, Glycine max
  Coding DNA Sequence Number=SeqID_40895
MFAHSIKGCRPLGRDVWGANTFPGKLPGNHITNETSKRVGLRPQKETTPEKLAFHRFKQKTQMKHETET

SEQ ID NO: 132581 - protein, 28 aa, Glycine max
  Coding DNA Sequence Number=SeqID_40896
MASVDISAMAVNLDLIKPFASLICPHVY

SEQ ID NO: 132582 - protein, 40 aa, Glycine max
  Coding DNA Sequence Number=SeqID_40897
MPLSRDVPKEDEHSTTWMNSLSAGMLANASYALSEFIVFS

SEQ ID NO: 132583 - protein, 120 aa, Glycine max
  Coding DNA Sequence Number=SeqID_40898
MGYGLWQQVVEASGNRLPVCVIDYTEEWVTGNRLPDEPARTLQRTVEWILPTPTPYRLVEPVQLIEVTSSEEDPEEDPEELPPEPAVDALDFLEGDEDPLPEVDSPEEVMSASEGRTLRR

SEQ ID NO: 132584 - protein, 182 aa, Glycine max
  Coding DNA Sequence Number=SeqID_40899
MAPRKLSSKRSRKEAAAAGTSAAPEFDSHRFRSAEHQQRFKAIKGWSFHRERRVQLRDDEYTDFQVRSRYSSRVLRQCLACRGGRTGPPVMVLEQGQECEYGQRRNWADGFDEKAIAQLLCIPGQDFAWTAAWRRVRIMRTNMTTLTQTWMTLLLSNILPSDHNSDLPLPKCQLVCHLSGTL

SEQ ID NO: 132585 - protein, 68 aa, Glycine max
  Coding DNA Sequence Number=SeqID_40900
MREHRGIGDDPGGGGSNRNGAIERAMGQLLYAAPAEHDPTLRDQLLLHQAPKVSLRRPALGFMTNLYS

SEQ ID NO: 132586 - protein, 116 aa, Glycine max
  Coding DNA Sequence Number=SeqID_40901
  Gene Ontology: Mol. function=ketol-acid reductoisomerase activity; Biological process=branched chain family amino acid biosynthetic process
  Homolog annotation: Hit_ID=A8A6N0; Match level="QueryCoverage=100%, HitCoverage=23%, E-value=1e-53, Identity=92%"; Hit description=Ketol- acid reductoisomerase
  Pfam annotation: Domain name=IlvC; Domain location=1-110; Score=68.2; E_value=2.7e-17; Accession=PF01450.10; Description=Acetohydroxy acid isomeroreductase, catalytic domain
MVDSGIIEESAYYESLHELPLIANTIARKRLYEMNVVISDTAEYGNYLFSYACVPLLKEFMTTLQTGDLGKAIAEGAVDNAQLRDVNEAIRSHQIEKVGHKLRGYMTDMKRIAVAG

SEQ ID NO: 132587 - protein, 106 aa, Glycine max
  Coding DNA Sequence Number=SeqID_40902
  Subcellular localization annotation: CTP_CleavageSite=44; ConfidenceScore=5.10e-01
MFVGASSKGGKCTESPPTFICGKRQKNRRKPVMKNIPDSGVVFTCEEVFEVDKSGALALTYPPSKRKSDLRSSFFKGESSDSFYLECGLFKALDLKNDPFLLGKKN

SEQ ID NO: 132588 - protein, 227 aa, Glycine max
  Coding DNA Sequence Number=SeqID_40903
  Gene Ontology: Mol. function=hydrolase activity, hydrolyzing O -glycosyl compounds; Cellular component=cytosol; Biological process =carbohydrate metabolic process
  Homolog annotation: Hit_ID=A5FEH0; Match level="QueryCoverage=100%, HitCoverage=28%, E-value=3e-81, Identity=64%"; Hit description =Glycoside hydrolase, family 3 domain protein precursor
  Pfam annotation: Domain name=Glyco_hydro_3_C; Domain location=1-88; Score=-56.7; E_value=0.041; Accession=PF01915.13; Description =Glycosyl hydrolase family 3 C terminal domain
MPWIKEVPTIVQSWYLGSEAGNSIASILAGDANPSGKLPFTFPVKLEDNSAHQLGEYPGQKDQLAAGKGKDQKNPINITYNEGIFVGYRWHDTKNIKPLFSFGHGLSYTTFEFGKAKADKTTISQDDKITFTVPVKNTGKKAGAEVVQLYISDLKSSVPRPAKELKGFEKVFLNPGEQKEVSISIDKTALSYFDGDKHDWVAEPGDFEALIGNSSDAIKTKVKFTLK

SEQ ID NO: 132589 - protein, 41 aa, Glycine max
  Coding DNA Sequence Number=SeqID_40904
MTQESGGMRRHPMRPESPVACGDTLRLSAPRHSETPSPIDK

SEQ ID NO: 132590 - protein, 198 aa, Glycine max
  Coding DNA Sequence Number=SeqID_40905
MGSSQAPSLKKRFYQVKVKSLGEILGCPLGGRKQYLFSGFYPSLARISKIVQISTQELDHRKQVKKGVVGVPRKCLEAKARVLAGKGEWAPFMDILALFQMWMGWWTRQRLTLFSPFMNARKARHSYFVQRISNTNAEALQKVRKAWEMVEKKDKELRGSSNGGYHRWLKAYTQVLDWLPNLRTTKGVAVEAPEEGKE

SEQ ID NO: 132591 - protein, 76 aa, Glycine max
  Coding DNA Sequence Number=SeqID_40906
  Homolog annotation: Hit_ID=Q2HUM1; Match level="QueryCoverage=76%, HitCoverage=74%, E-value=6e-08, Identity=51%"; Hit description =Putative uncharacterized protein
MWDTLQVTHEGTTYVKREWQPKVTTITKSRDLTNMSFATLFGKLQEHKMELMRLNQHEENDKKKKAITLKASSSIQ

SEQ ID NO: 132592 - protein, 293 aa, Glycine max
  Coding DNA Sequence Number=SeqID_40907
  Homolog annotation: Hit_ID=Q6UUU1; Match level="QueryCoverage=32%, HitCoverage=82%, E-value=1e-23, Identity=55%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPEFDVIVEETTNAVELIELVINSYLLNCRSLNGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPRALSVPAFRFTGVIPLLWPRLSHSTPDTQFR

SEQ ID NO: 132593 - protein, 96 aa, Glycine max
  Coding DNA Sequence Number=SeqID_40908
MGKAVASGGSNLARLGELGGNHLPYFAIDRGGSEEEKGPALRHFSLFEFAWKIVSVKKSKPRCFRTFRNVFREDFVRFQPFFDVLHSFFIVLRSSR

SEQ ID NO: 132594 - protein, 142 aa, Glycine max
  Coding DNA Sequence Number=SeqID_40909
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=67%"; Hit description=LacZ protein
  Subcellular localization annotation: CTP_CleavageSite=5; ConfidenceScore=5.02e-01
MHISSSAVRWGIHTSCVRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132595 - protein, 66 aa, Glycine max
  Coding DNA Sequence Number=SeqID_40910
MGRIKRILRLCRFEFFDKGEGRHKRIQAGEENEKMNSTSFQALENQKNSESFWYKEEEEVQRDSRL

SEQ ID NO: 132596 - protein, 68 aa, Glycine max
  Coding DNA Sequence Number=SeqID_40911
MGASQHRTPELGEFYRLFHCKIHFLVGVLTGFAVDLGMAFVDNWVVGKEKVCYWLSNDIVGLVGNLAV

SEQ ID NO: 132597 - protein, 57 aa, Glycine max
  Coding DNA Sequence Number=SeqID_40912
MKRPTKGKKSIALKASSSMQEEEEEEEEEEEEEEEESDDEEDFSLFVKKFQKFIKNR

SEQ ID NO: 132598 - protein, 39 aa, Glycine max
  Coding DNA Sequence Number=SeqID_40913
MTHGRLAGYQVQSQRTHLVAHDPRDLNKTSASSEGSEIP

SEQ ID NO: 132599 - protein, 87 aa, Glycine max
  Coding DNA Sequence Number=SeqID_40914
MKNVEERLKPFAGNSSAENVTETFRKRLGLDFLHGNNFSKQIRKRENKIGEVLARPARPGEPGCFLQKQQPSGGPKWAWVLFAPPFY

SEQ ID NO: 132600 - protein, 274 aa, Glycine max
  Coding DNA Sequence Number=SeqID_40915
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLFADTGLSSWKRLFPAFRPQEQPHFCPLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132601 - protein, 96 aa, Glycine max
  Coding DNA Sequence Number=SeqID_40916
  Homolog annotation: Hit_ID=A0ST23; Match level="QueryCoverage=28%, HitCoverage=55%, E-value=2e-08, Identity=100%"; Hit description =Putative reverse transcriptase
WVGDPEDDDVVFLITGSGRARRTSFPLLTIKLIDTVDLEGGPVGKPVVPAALMNRPTRGERRFAYWALAECILAYYVGTDEGVSEVLHVAGEKRLH

SEQ ID NO: 132602 - protein, 140 aa, Glycine max
  Coding DNA Sequence Number=SeqID_40917
ERVPFAIQAAQLLGRAIGAGLFAITPAGERGMCCKAIKLGNARVFPVTTLLASGSPRPPNNFMVKKPTCLGKLQLPQSDPLPINRRPRGVLNGSKVQKLRELREERKKKKEEETKLRRYQIATGIISYIVPCPVFFVQLL

SEQ ID NO: 132603 - protein, 177 aa, Glycine max
  Coding DNA Sequence Number=SeqID_40918
MHRSPNGNLVPLDLEIEVSLRRSRVERRRKLLQDRTIASIIEEEAQSSDSTSSDSLASRESAIYLSEASVMADEHQQRITLEDYSSSSVSQFFTSISRPEVQDHNINYPHSLIHLIQGNLFHGFIRLILFSFSLEEVVEKFLKKFFPESKTVEGKVVISSFHQFPEESLSEALERFR

SEQ ID NO: 132604 - protein, 82 aa, Glycine max
  Coding DNA Sequence Number=SeqID_40919
MASGQGKYHRWAMAILVDDKDFRSRGRLPCGRDSHLRGRCVGLQVSPYVVARGPQVYPSNPPNRTCMRLFDSKIFEGNLLIR

SEQ ID NO: 132605 - protein, 110 aa, Glycine max
  Coding DNA Sequence Number=SeqID_40920
LPALSAPSSLSRFSLTCAKCENAAKQAFEDRKLFLRLKLEKSSKSSKREANSERRKQNKGAKQSKEAKNLNFQEDLRFRGVALRWKAKYLCWEILLKLDANFDETSENEV

SEQ ID NO: 132606 - protein, 105 aa, Glycine max
  Coding DNA Sequence Number=SeqID_40921
MMHLLRPPSLKPFIFEAGETQVRQEAATPERSPQISPNPSSPMVDQSSLQQPADLPTPVHEMPADPSTPVLGLTTTPSATPVLHLTDEEDTQDEDTQSQDLSQEF

SEQ ID NO: 132607 - protein, 146 aa, Glycine max
  Coding DNA Sequence Number=SeqID_40922
MIRGDTLWLFAPFCHPEAAGPMTSRDQVWSFCTLVSSRGGGPDDTRRYLMVIRTLLSSRGGGPDDKQRPKAAGPMIRGDTLRLFAPFCHPEAAGPMTSRDQVWSFCTLVSSRGGRADDTRKYPSGYPYKTFLLLSVRQNALIACRG

SEQ ID NO: 132608 - protein, 171 aa, Glycine max
  Coding DNA Sequence Number=SeqID_40923
  Gene Ontology: Cellular component=mitochondrion
  Homolog annotation: Hit_ID=O63700; Match level="QueryCoverage=57%, HitCoverage=35%, E-value=9e-07, Identity=38%"; Hit description =Putative uncharacterized protein
MDDVGASSQSSLPTVNPTPDPAAPAEPQAPDPDLSLPLLDDNARRAELNERGGFLHFGDLSDQQKDKVLNAQVKIERAIEKALLSDGYSRDELSQRNKRDEIRGFLFYRNGKLLSMKTYDSYVKEVELGTHRSQPYKFLFERGYPQIITRPVPEMGRGRRSGHVGLLHLTI

SEQ ID NO: 132609 - protein, 107 aa, Glycine max
  Coding DNA Sequence Number=SeqID_40924
GQDIYSSQDEATTSPSSSESEKAKGEESSEEIYPQEEGQPLVVKEKCKEALASIATPLGLEFIPQVKKLLDEGVEGRSPEYDETRDLRSNPFQGGGNDAILSRKGIG

SEQ ID NO: 132610 - protein, 77 aa, Glycine max
  Coding DNA Sequence Number=SeqID_40925
MKQARKASRLRSLSTRPPSAERPVVHVDPAISKADGPHRKKLRTYLGIVARDKVDVTDENWKKVPTAQKDLIWEDIQ

SEQ ID NO: 132611 - protein, 138 aa, Glycine max
  Coding DNA Sequence Number=SeqID_40926
MARAGDNGGVYHQLDGCQRLFLDGMSTQMQRLFNRNKEDLYRRIAKSSFFTLKPLSPREVCDDQIRMREKREQEKENSEAPQKNMKKKSDTPKEKSDTHKRESDTHERKFNYFAEASEVRKVLPAHEPLNLQYCKDRI

SEQ ID NO: 132612 - protein, 135 aa, Glycine max
  Coding DNA Sequence Number=SeqID_40927
  Subcellular localization annotation: CTP_CleavageSite=87; ConfidenceScore=5.25e-01
MNGDAAFNNNNNRYNPGWRNNLNLRWSSPQQQQHQPAPSFQNVAGPSRPYVPPPVQQQQQQQQQHQQRQQSTTEASPQPSLEELETRASIQSLTNQMGQMATQLNQAQSQNSNKLPSQSVQNPKNVSAITLRSGK

SEQ ID NO: 132613 - protein, 84 aa, Glycine max
  Coding DNA Sequence Number=SeqID_40928
MAGIFFLLKQQSNLENYEREWEESKEFSDCVVLNSLTREKGDTKEFRRLVLCSFGKGRRETQKEFRRLVLGEFFLAKGEENEKG

SEQ ID NO: 132614 - protein, 67 aa, Glycine max
  Coding DNA Sequence Number=SeqID_40929
MMVARVMLGHGYESRMGLGKNNGGRTSLRAKEPPPCHNSRSFISAGLRHEGQVAGICNDDSTRRSDL

SEQ ID NO: 132615 - protein, 22 aa, Glycine max
  Coding DNA Sequence Number=SeqID_40930
MLTSPERAQMTTLGSGHQSHFG

SEQ ID NO: 132616 - protein, 111 aa, Glycine max
  Coding DNA Sequence Number=SeqID_40931
  Subcellular localization annotation: CTP_CleavageSite=61; ConfidenceScore=5.07e-01
MGIAPTKTPSGPEEVQQGPGVSSSGYGPLSVLQGARTPLARDRARETSSGPEEVQQGPRVSSSNYGPLSFLQSARRPQQVHQAPINQAFIKKYCVSRQAQGKTPQQPGDGR

SEQ ID NO: 132617 - protein, 173 aa, Glycine max
  Coding DNA Sequence Number=SeqID_40932
  Homolog annotation: Hit_ID=Q5XM22; Match level="QueryCoverage=47%, HitCoverage=46%, E-value=7e-22, Identity=66%"; Hit description =Resistance-like protein HAAS-2
ERPDLKLVSHGRKVTLIGRPVPEIEDLVAATGLSPLIDCSVITGDPGLISAFVERWHSETSTFHLPFPRSFYGGGQIFADEVAGSVCRGGQSRDNTHMWSISRAYLLHLVGCTLFANKSATYVHVVHLDAFRDLARSSGYAWGVAALVHIYDQLDEACRTTTRQLAGYLTLLQ

SEQ ID NO: 132618 - protein, 25 aa, Glycine max
  Coding DNA Sequence Number=SeqID_40933
MVVQIAIGMGDFLVCKSPDQMATLP

SEQ ID NO: 132619 - protein, 55 aa, Glycine max
  Coding DNA Sequence Number=SeqID_40934
MNLRGRQVEIADPLCPFCNNLDEDAAHLFFNYSKEPYLWDPIYVQSTSGTSSLFT

SEQ ID NO: 132620 - protein, 241 aa, Glycine max
  Coding DNA Sequence Number=SeqID_40935
GQWIPFDADALSQFLGYPLVLEEGQDCEYGQRRNRADGFDEEAIAQLLCILGQDFAWTTAERRVRIMRTKMTTLTQTWMTLLLSNILPSDHNSDLPLPKCQLVYSILTRMSVHVAQFIADAIYLFAGTPPTRHPQDPDKSNSKVIRPPITRAFIEKYCIARQAQGGDPQAPDAPPPPPQADPARRPTTGRTCRPTLSTSLASACRARAAEAPAKAPSEVDDPREDEEMTDLLDFLGGSRAT

SEQ ID NO: 132621 - protein, 70 aa, Glycine max
  Coding DNA Sequence Number=SeqID_40936
MASNSQQFSARIDAIVIRGVHKVATNSSGETKKLEDLLNLSSKISHNRIIMTSPATGTIPNGGIIPTLDG

SEQ ID NO: 132622 - protein, 191 aa, Glycine max
  Coding DNA Sequence Number=SeqID_40937
  Pfam annotation: Domain name=G-patch; Domain location=1-42; Score =12.6; E_value=0.0057; Accession=PF01585.14; Description=G-patch domain
MVTRVMLKHEYEPGMGLGKVGLGNADVVNIKGNPYKCGLGYEPGIREGGMRRQDSGRIGHGPATLANVSPVPESYSTKRWQQSERSASRPAKFRAAMPSRLPSGELACDKPVRDMRVDSLSILTTREAPWHIIWPSNPSRIICRCTPSSQMKISWPLGAILVSLDDECIPFTVRLGFDCTYNMAEYEACAL

SEQ ID NO: 132623 - protein, 269 aa, Glycine max
  Coding DNA Sequence Number=SeqID_40938
  Homolog annotation: Hit_ID=A5BSR3; Match level="QueryCoverage=46%, HitCoverage=40%, E-value=6e-13, Identity=39%"; Hit description =Putative uncharacterized protein
AEFDIPEASDNLTRKWALAADQDGVEDTVCDKYGISKEKWAQFCQTRRDPSWEDVRMKAQAIQKQNTAPTFCLMGVDGVIDPPSPVRRHVKWKMARMKKTGEMTTEAAKEIAEKIDSFEEQATQGSFVPHGCQDVLAAAIGRLEHPGRVRGIGAGVTIKQYFGSAPRTSRSASSLPPDELHQLTQQIRDQLEESIIEKVTRQVMASFSHLQSQMQSQGLAVPLEPLVGLGPSGPRVSTKGSCVDPSGNDPETGDSDRCGLYIEADPARL

SEQ ID NO: 132624 - protein, 170 aa, Glycine max
  Coding DNA Sequence Number=SeqID_40939
  Subcellular localization annotation: CTP_CleavageSite=39; ConfidenceScore=5.33e-01
MALRKLASKRSRKDKALLPNMTATVLGVLSTSSALRPSRDAHFSGSDAYSSGTTNIVLEFYANAWPIEEGVRDMRSWVRGQWIPFDADALSQFLGYPLVLEEGQECEYGKRRNQSDGFDEEDFARTDAGRRVRIMRTNMTTMTQIWMTLLLSNIQPSDHNFDLPLPKCQL

SEQ ID NO: 132625 - protein, 80 aa, Glycine max
  Coding DNA Sequence Number=SeqID_40940
MALNTPPPWLASGARHFSMEWPGVFPWYAQVALGSYHFRKGGWKIFPGVITEYPRSRHQRLFEENVGKTGKDAIYELLGE

SEQ ID NO: 132626 - protein, 90 aa, Glycine max
  Coding DNA Sequence Number=SeqID_40941
MLSDIEINSTHSGHTDVRIYVSSIFGQDVLDIVSDIVDPAQSVKDITDLCVQYFRAGCPGHCIRHRGSCSFNSSFDFYLALCIVQPDLVP

SEQ ID NO: 132627 - protein, 66 aa, Glycine max
  Coding DNA Sequence Number=SeqID_40942
  Subcellular localization annotation: CTP_CleavageSite=32; ConfidenceScore=5.24e-01
MAVSCDMNLANNSERPRKPRTCSLSRVLAFISRMFRGSSILLSFGFTRGNISGFDPKVIGVVLIVK

SEQ ID NO: 132628 - protein, 91 aa, Glycine max
  Coding DNA Sequence Number=SeqID_40943
  Subcellular localization annotation: CTP_CleavageSite=53; ConfidenceScore=5.22e-01
GAKRHKHRRTSALASVAVTLRVTSTPAALNAPLQGESPSPIRLRNCWEGLSVRASSILRQLAKGGCAARRLSWVTPGFYQSRRCKTTASEL

SEQ ID NO: 132629 - protein, 71 aa, Glycine max
  Coding DNA Sequence Number=SeqID_40944
MAMKWRRKRERRCHFKEKMSLEEVRHYRQPWIRAWRKKEMNEGRGREEHEILYMVQPTNPRSSPRFSTKCA

SEQ ID NO: 132630 - protein, 172 aa, Glycine max
  Coding DNA Sequence Number=SeqID_40945
MDNEEGVQEQMKADLSALKDQMASISEVMLKLQKTIEDKATATASSTVREAEPVLQPALNPGLGRNTAVFGRTYSPQAYPYGLPPDFNPCATPEDLSQALTFEGQLPPYEDYPGQDDGEGDTHLGPLLHLKDPSPHELPQPNIVRHIPASPTPVKESVPFAEDKGKIEVLEE

SEQ ID NO: 132631 - protein, 243 aa, Glycine max
  Coding DNA Sequence Number=SeqID_40946
  Gene Ontology: Mol. function=nucleic acid binding; Cellular component= ubiquitin ligase complex; Biological process=protein ubiquitination
  Homolog annotation: Hit_ID=Q9FNZ1; Match level="QueryCoverage=76%, HitCoverage=46%, E-value=3e-56, Identity=53%"; Hit description=Zfwd2 protein
  Pfam annotation: Domain name=WD40; Domain location=105-141; Score =9.5; E_value=2.1; Accession=PF00400.23; Description=WD domain, G -beta repeat
  Pfam annotation: Domain name=WD40; Domain location=150-186; Score =36.7; E_value=8.1e-08; Accession=PF00400.23; Description=WD domain, G-beta repeat
  Pfam annotation: Domain name=WD40; Domain location=190-226; Score =33.5; E_value=7.6e-07; Accession=PF00400.23; Description=WD domain, G-beta repeat
  Pfam annotation: Domain name=WD40; Domain location=47-84; Score=22.8; E_value=0.0012; Accession=PF00400.23; Description=WD domain, G-beta repeat
  Pfam module annotation: Pfam domain module=WD40::WD40::WD40::WD40; Domain location=105-141::150-186::190-226::47-84
MVQRKHCLEIMEIEEMQQGLLRLSRNHHQGYVNTGSTTIVYMVNNACICIHVIEFYNVITGIALPVGSDKLYSGSTDGTVRIWDCHTGQCAKVINLGAEAWNIQTMLEFTLDGPKGRVRAMTVGNNTLFAGAEDGVIFAWRGSSKADSPFELVASLTGHTKAVVCLAVGCKMLYSGSMDQSIKVWDMDTLQCTMTLNDHTDAVTSLICWDQYLLSSSSDRTIKVWACIEAGSLEVIYTHTEEN

SEQ ID NO: 132632 - protein, 75 aa, Glycine max
  Coding DNA Sequence Number=SeqID_40947
MARNVFAPCPYLRGPIRERAKKAFSDNSQGGHISLDVPSGVANCRNLPFGGRATRDSRDASSSKGIRAESPPTFI

SEQ ID NO: 132633 - protein, 158 aa, Glycine max
  Coding DNA Sequence Number=SeqID_40948
  Gene Ontology: Mol. function=selenide, water dikinase activity; Cellular component=cellular_component; Biological process=electron transport
  Homolog annotation: Hit_ID=A6T7R9; Match level="QueryCoverage=98%, HitCoverage=44%, E-value=3e-84, Identity=98%"; Hit description =Selenophosphate synthetase
  Pfam annotation: Domain name=AIRS; Domain location=9-157; Score=33.4; E_value=3e-07; Accession=PF00586.15; Description=AIR synthase related protein, N-terminal domain
MSMSEQAIRLTQYSHGAGCGCKISPKVLETILHSEQAKFVDPNLLVGNETSDDAAVYDLGNGTSIISTTDFFMPIVDNPFDFGRIAATNAISDIFAMGGKPIMAIAILGWPINTLAPEIAREVVEGGRFACQQAGIALAGGHSIDAPEPTFGLAVTGV

SEQ ID NO: 132634 - protein, 47 aa, Glycine max
  Coding DNA Sequence Number=SeqID_40949
MEVGFVVDLGMAFVDKWAVGMAVTAWVSPSSLTLLHLPQFSHSSQAG

SEQ ID NO: 132635 - protein, 163 aa, Glycine max
  Coding DNA Sequence Number=SeqID_40950
  Gene Ontology: Mol. function=aspartic-type endopeptidase activity; Biological process=RNA-dependent DNA replication
  Homolog annotation: Hit_ID=Q69F85; Match level="QueryCoverage=69%, HitCoverage=6%, E-value=7e-13, Identity=34%"; Hit description=Gag -pol polyprotein
MDEPHERAKGYIQIEEMSKFWNEAQARQVPTSLQKARYERYIPLTANRTTILEEAFDLEVPVRLPQMKSLRPGSDATKYCKFHRSIEHNTKDCWALNGKIEELIQAGYLAQFVKRPDHYQAGARPKGHQEEQHKNQEVDRRRVEDRGRQRQQPQRHERPPSPE

SEQ ID NO: 132636 - protein, 143 aa, Glycine max
  Coding DNA Sequence Number=SeqID_40951
MDNEEGVHKQMKADLSALKDPMASISEVMLKLQKTIEDKATATASSTVREAEPMLQPALNPGLDRNTAVFGRRYSPQAYPYGLPPDFTPRATPEDLSQAPTFEGQLPPYEDYPGQDDGEGDTHLGPLLHLKDPSPHELPQPNI

SEQ ID NO: 132637 - protein, 180 aa, Glycine max
  Coding DNA Sequence Number=SeqID_40952
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=3e-20, Identity=30%"; Hit description= UPI00006A17C9 related cluster
  Subcellular localization annotation: CTP_CleavageSite=75; ConfidenceScore=5.59e-01
MARTRSPLKVRACRPLKARTRSPLKVRACSPQMARTCSPLKARVCNPLMARTCSPLKVRACSPLMASACSPLKVRAQSPLKVRACNPLKVRTCSLLKVRACSPVMSRMCSPLKARTYSPMKARTCSPLKARTCSPLKARMCSPLKARACSPLKVRTCSAPKVTACSFLKVRECSAQGQNV

SEQ ID NO: 132638 - protein, 158 aa, Glycine max
  Coding DNA Sequence Number=SeqID_40953
  Gene Ontology: Mol. function=protein binding; Cellular component =extracellular region; Biological process=defense response to fungus
  Homolog annotation: Hit_ID=Q1SWI6; Match level="QueryCoverage=86%, HitCoverage=61%, E-value=2e-33, Identity=53%"; Hit description =Leucine-rich repeat, plant specific
  Pfam annotation: Domain name=LRRNT_2; Domain location=15-55; Score =49.5; E_value=1.2e-11; Accession=PF08263.3; Description=Leucine rich repeat N-terminal domain
  Pfam annotation: Domain name=LRR_1; Domain location=106-131; Score =11.0; E_value=2.8; Accession=PF00560.24; Description=Leucine Rich Repeat
  Pfam annotation: Domain name=LRR_1; Domain location=133-155; Score =14.2; E_value=0.51; Accession=PF00560.24; Description=Leucine Rich Repeat
  Pfam module annotation: Pfam domain module=LRRNT_2::LRR_1::LRR_1; Domain location=15-55::106-131::133-155
MENLEIDLMVESVCIPSERETLLKFKNNLIDPSNRLWSWNHNNTNCCHWYGVLCHNVTSHLLQLHLHTSPSAFYHDYDYQYLFDEEAYRRWSFGGEISPCLADLKHLNYLDLSGNRFLGEGMSIPSFLGTMSSLTHLDLSYTGFYGKIPPQIGNLSNL

SEQ ID NO: 132639 - protein, 121 aa, Glycine max
  Coding DNA Sequence Number=SeqID_40954
  Subcellular localization annotation: CTP_CleavageSite=66; ConfidenceScore=5.09e-01
MFAFSCILIFQTFSSLTSYPELRRSEFLIGGYVGAGASLLSTAPLFVTMTQKMVARGDTLRLSAPRHSMTPSVIDEQRPTSRGQCGHLRPFRRCQHFPVETFSSLTSYLELRRSEFLIEDA

SEQ ID NO: 132640 - protein, 97 aa, Glycine max
  Coding DNA Sequence Number=SeqID_40955
MTHAKWECDNGQMRERYVHYDAEEMFYAVHDMNAFYGHESPENCLFLLAHLGAQCPMCTIKKVIWTFRLPVTKDETNIQCMLEIKCGSDLIHTDFWE

SEQ ID NO: 132641 - protein, 139 aa, Glycine max
  Coding DNA Sequence Number=SeqID_40956
MDNEEGVEEQMKADLSALKDQMVSITEAMLKLQKTIEDNATATASNTAREAEPVLQPAINLGRDRNTMVFGRRYSPQAYPYGLPPDITPRTVPNDLSQAPTFKGQLPPYADYPLQEDDEEDAHLGPLLPLKDPAPHEFP

SEQ ID NO: 132642 - protein, 60 aa, Glycine max
  Coding DNA Sequence Number=SeqID_40957
  Subcellular localization annotation: CTP_CleavageSite=27; ConfidenceScore=5.01e-01
MGPDIAFAVGMLKALRYQSNRSLGPLRAAKKVVVGSTSGYIFMMAGFHGGVLSSLYETTC

SEQ ID NO: 132643 - protein, 182 aa, Glycine max
  Coding DNA Sequence Number=SeqID_40958
MAESDHAILRDRAHIPTKRSLLELSSQDASLAQNKLLSKQLTETLSKLPTQLNYVQPSPYTILQVASCVICGGAHESGCCIPQEETPHEVNYIGNQPRQNFNAGGYSGFQHGQPYNSQQGQWRNHPGNQFNKDQGGPSNRPQQQGPSLYDRTTKLEETLAQFMQVSMSNHKSTKSAIKNLEV

SEQ ID NO: 132644 - protein, 57 aa, Glycine max
  Coding DNA Sequence Number=SeqID_40959
VDSRGSHIIKKLPIGTNFRLTNCKSTPAKPPPYTLTDLVVDVEASIGGRGSGAQCQG

SEQ ID NO: 132645 - protein, 83 aa, Glycine max
  Coding DNA Sequence Number=SeqID_40960
MYIVVVKQGQDHLGLPSGVETKHERQKPIKVLKDECERGWGHDRPIVALLCAKQAENVAARQPRILCILQLSFTICLFQKEKI

SEQ ID NO: 132646 - protein, 189 aa, Glycine max
  Coding DNA Sequence Number=SeqID_40961
MSHHSSSVNGEGTSHKDPLSRTLDELSSLKLWKEKQERKEKGKKRVEEISQDERKKIREEERRKIMKEMKREKHVSYSSHNSCKSLSEELRDYYEGRHRSHLRPHSHRREKERKPQEANINLSYFHGKDNVEANLDWEIRVEQQLKKNSTSKSYGSHSYPKKDQGQGILGVTPSKPKDDKGKAIEKASP

SEQ ID NO: 132647 - protein, 104 aa, Glycine max
  Coding DNA Sequence Number=SeqID_40962
MRVPRKEYARSRHQRLFEENVGKTGKDAIYELFSERFGSCIYARGRRETLRHLTINDLLGFERRETLRCWTINDLLVFERRETLRRWTVNDLLGWSTKAGLLLL

SEQ ID NO: 132648 - protein, 86 aa, Glycine max
  Coding DNA Sequence Number=SeqID_40963
SDLKTNPSQEGENDEDMTKSKGKDPLDGLGGPMTRARARKAKEALQQVLSILFEYKPQGEKSKGPIGNLGISLLGDQMVADLLAVG

SEQ ID NO: 132649 - protein, 113 aa, Glycine max
  Coding DNA Sequence Number=SeqID_40964
MNSLSENAALTLSEELAKRTYCAKRVHPLRMNIHPLAELPVAKPRYTDNVLGRNILPERKVELYHTELDDFKVELERRNFHKCLTNLADRSIDLALVKEFRANLYSSDDRPPK

SEQ ID NO: 132650 - protein, 98 aa, Glycine max
  Coding DNA Sequence Number=SeqID_40965
  Subcellular localization annotation: CTP_CleavageSite=51; ConfidenceScore=5.52e-01
MYSNFNLNSMCLNSIFWKHSSLIFYLNDTVVVSPVVEKGQLLRSFSRISFRSNSSSSSSSRNSNLLNDQDNQTQEVAPKHNLFDEEVLFEDINQNMDD

SEQ ID NO: 132651 - protein, 72 aa, Glycine max
  Coding DNA Sequence Number=SeqID_40966
QGNGGNAACPIISECTIDLGPSPTTPQFNKNKQQFKDKSLTFLSKYMQLRAPKYINGKLESPRMRCLHVGDE

SEQ ID NO: 132652 - protein, 165 aa, Glycine max
  Coding DNA Sequence Number=SeqID_40967
  Gene Ontology: Mol. function=binding
  Homolog annotation: Hit_ID=A5BHS1; Match level="QueryCoverage=96%, HitCoverage=51%, E-value=2e-21, Identity=39%"; Hit description =Putative uncharacterized protein
MEKTSWACTVITQVCLCFALYIALNLGQPQTSDLYFISVKGGFRPFTQQLHLLKQVFLFVDIANYVLLMFNLDGLKMDKVAKAYNASFVVSSSELGEYDSLMQNATQHFPSLRLPWYTTYTTTTSSKTKGQEVGCFSKKITTSNRITSGVIGVDTELLKWIQRLK

SEQ ID NO: 132653 - protein, 441 aa, Glycine max
  Coding DNA Sequence Number=SeqID_40968
  Gene Ontology: Mol. function=inorganic phosphate transmembrane transporter activity; Cellular component=membrane; Biological process=phosphate transport
  Homolog annotation: Hit_ID=A8GEX0; Match level="QueryCoverage=54%, HitCoverage=44%, E-value=1e-101, Identity=77%"; Hit description =Phosphate transporter
  Pfam annotation: Domain name=PHO4; Domain location=240-438; Score= -32.7; E_value=9e-10; Accession=PF01384.11; Description=Phosphate transporter family
PQQHRIRRAEAQPINLLMHTFNHANRAIACADHHLRPAPDPQRRILRAALLFTEGDVIQHRQQRIVLLRQSGARRGRMNLIEKIVIYAEVVLNPALGAGMIQVNVQPEKAAVGGQIHSLRQACYSMMTARAGIIILSYKTRITLQLTGAIRASLIHPGGCVMAENSFPASSSDRGRPNLHPRSGRASRVLFLLLLVAGLLFTGINLFNDVEETGAVVTSYTPFLLLGVALLIALGFEFVNGFHDTANAVATVIYTHSLSPGVAVVWSGLCNFLGVLLSSGVVAFGIISLLPVELILQAGSGHGFAMVYALLCSAIVWNLGTWYFGLPSSSSHTLIGSIIGVGVANALLHGRSGTSGVDWDQAVKVGYALLLSPVIGFICAAVLLLAMKALVRNRQLYQAPEGNQPPPAWIRGLLILTCTGVSFAHGSNDGQKGMGLIMLIL

SEQ ID NO: 132654 - protein, 296 aa, Glycine max
  Coding DNA Sequence Number=SeqID_40969
  Gene Ontology: Mol. function=RNA-directed DNA polymerase activity; Biological process=regulation of transcription, DNA-dependent
  Homolog annotation: Hit_ID=A5BRV3; Match level="QueryCoverage=62%, HitCoverage=12%, E-value=5e-19, Identity=33%"; Hit description =Putative uncharacterized protein
MLQQEEEGSSSKKEETSSAEEEEEDPFYQNKDDCFAIKVPIKTTCLVTNSQIVLVKTTGNYQSQIFGYIRSPQPCCEETLRKDFYSPENEPQRRWFFQHCKGTNRKQIQDKFYEFVERVKINVLFFDWFHAYTIRKDIDYPWKQDIIGDPTTNVITYCHVKDGELIQSELPPATQYQLPNIKDSNNKLVMAIPFKTKDVNEEVTSKDIKSLMEQENYTNKYLQALGETIKTKVVPKQKSIEEASPSIPIEKPLFKPFKVSEKAKRKIREHRKTKSLIEGVGDNHSELLNKIGSLLK

SEQ ID NO: 132655 - protein, 77 aa, Glycine max
  Coding DNA Sequence Number=SeqID_40970
MRNFPPKPIPEFTPIPLTYEDLLPSLIANQMVVITLGKIYQHPFPKWYDPDATCTYHGKTPGHSTENAWPLNTRSNI

SEQ ID NO: 132656 - protein, 84 aa, Glycine max
  Coding DNA Sequence Number=SeqID_40971
MTIICLCVPSDTIVCKWRKGVRNDHNLSLHAIGHDCLQMAKRCGMTIICLCISSGSPPLDDKKAQNDHNFSLRAIGHDCLRMAK

SEQ ID NO: 132657 - protein, 104 aa, Glycine max
  Coding DNA Sequence Number=SeqID_40972
MVISFSLGVRFTRIIYRVCTKLNTKAAQEIQTVIPFHSGKSIQAHNISRCNERTGRGGSRKFKWASNVSLARSVRFRRRRAVSAHSKAVIRLSTESGDNAGKNM

SEQ ID NO: 132658 - protein, 214 aa, Glycine max
  Coding DNA Sequence Number=SeqID_40973
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-18, Identity=26%"; Hit description= UPI00006A17C9 related cluster
  Subcellular localization annotation: CTP_CleavageSite=50; ConfidenceScore=5.62e-01
RIPPLRVRTCSPLKVRACNPLKARTCSPLSVRACSPLKVRMCSPLKVRVRSPLKVKARTPLKVTTCSPLKVKACNPLQSRACSLLKVTTCSPIKVRTCSPLMVRVYNTLKVRARNTLKLRACSPLKVRTCRPLKVRARSPLKVRTSSPLKVRACNPLKARTCSPLSVRACSPLKVRMCSPLKVRVRGPLKVRTYSPLKVRACNLLKARTCSPLK

SEQ ID NO: 132659 - protein, 388 aa, Glycine max
  Coding DNA Sequence Number=SeqID_40974
  Gene Ontology: Mol. function=transporter activity; Cellular component= integral to membrane; Biological process=transport
  Homolog annotation: Hit_ID=P0AEG0; Match level="QueryCoverage=69%, HitCoverage=92%, E-value=1e-136, Identity=82%"; Hit description =Dipeptide transport system permease protein dppB
  Pfam annotation: Domain name=BPD_transp_1; Domain location=201-388; Score=53.9; E_value=5.4e-13; Accession=PF00528.13; Description =Binding-protein-dependent transport s
CAAAKDGSNYSRWCYKPFEDLIQPARATDDHNKRIELYKQAQVVMHDQAPALIVAHSTVYEPVRKEVKGYVVDPLGKHHFENRHPAAVLYSLSERRGDKICEQYRRHATGRASSERIRVMLQFILRRLGLVIPTFIGITLLTFAFVHMIPGDPVMIMAGERGISPERHAQLLAELGLDKPMWQQDFVKSRLPVWDEFVPRFKATLELGVCAMIFATAVGIPVGVLAAVKRGSIFDHTAVGLALTGYSMPIFWWGMMLIMLVSVQLNLTPVSGRVSDMVFLDDSNPLTGFMLIDTAIWGEEGNFMDAVAHMILPAMVLGTIPLAVIVRMTRSSMLEVLGEDYIRTARAKGLTRMRVIIVHALRNAMLPVVTVIGLQRRDYPVVQGGVLL

SEQ ID NO: 132660 - protein, 159 aa, Glycine max
  Coding DNA Sequence Number=SeqID_40975
PFHPGLFVGDAGGFQSPTREPLNVGGLVPPHCSLKSVVSDDACPGACFVQRDATTLSQHRLCLLLWMIHDNSSDRTAFVPATHHSNFCPINFRWEPEGTLPDTKEGSRRANYPILTRGVKKLVVGPWVGSIGPPPVCTGRLVPSAGDALLSLTGRVVPP

SEQ ID NO: 132661 - protein, 258 aa, Glycine max
  Coding DNA Sequence Number=SeqID_40976
MERVYERSTVVHNTPFLSGQVKVSVEEVTDADAPVPVPTDEVSLVGQVLHTFLAWPTHLVKSLSQQVAESPPKPPPKPDPEVDDPLYLMTLTIPELFLRPYQVRWDATVVNVFYIKHEDLFEIAHGGQCLSISVLQLLILHLTETCMRVGNSDIYGFLEPQFIQRSGQSQFESESYIKSWMQSSQRDVYLGAYLNGFHCNRHWQMVVILPKEHLVVWFCSLHNRPDNYLKGIINSAIKGLDDAPQPKSKASARWIVVK

SEQ ID NO: 132662 - protein, 105 aa, Glycine max
  Coding DNA Sequence Number=SeqID_40977
MAVPKLGFRSLPKPQAKLEDSASVEGFLLVWGFNEEQLWFVVANGGCGRWRKCLELLEMALEERKKNEMTFFLSYTKAKAKMLKSEMLLGTEASSTFQTSSQRSQ

SEQ ID NO: 132663 - protein, 47 aa, Glycine max
  Coding DNA Sequence Number=SeqID_40978
EHECAMAMTFMGLREKVENGELANSARQRHSRGSRLEDGGHMNSARQ

SEQ ID NO: 132664 - protein, 372 aa, Glycine max
  Coding DNA Sequence Number=SeqID_40979
  Homolog annotation: Hit_ID=A5BSR3; Match level="QueryCoverage=28%, HitCoverage=33%, E-value=3e-09, Identity=38%"; Hit description =Putative uncharacterized protein
  Pfam annotation: Domain name=Transposase_23; Domain location=156-226; Score=17.9; E_value=1.3e-05; Accession=PF03017.5; Description =TNP1ENSPM transposase
MARTKKTGEMTTEAAKEIAEKIDSFEEQATQGSFVPHGRQDVLAAAIGCPEHPGCVRAAGAGVTIKQYFGSAPRTSRSASSLPPDELQQLTQQIRDQLEESITEKVTRHVMASFSQLQSQMQSQAPSEPLVGPGPSDPWVSTKGSCVDPSGNDPEMGDSDRCGLYIEADPARLVAVGRVYEGSTLVHNTPLLPGQVKVSVDEVKDADAPVPVPTAEVSLVGQALHNLPCLADTSDQVVVSPQKPPPKPDPDVDDSLYLMTLTIPELFLRPYQVRWDATVFGVVNPDFPLYIKHEDLSEIAHGGQCLSISVLQLWILHLTETCMRAGNSDIYGFLEPQSIQRSGQSQFESESYIKSWMQSSQRDVYLGAYLNG

SEQ ID NO: 132665 - protein, 156 aa, Glycine max
  Coding DNA Sequence Number=SeqID_40980
MKDKRDEEEKLEKQKKKKDINALSSKAKGKEKVEKDSSKKIVKKENHFATKGDIKRALLLKQSFYLLLSRETSLSTTIPLELEVIPQVKELLDEGLVRKSLNPCALLVPKIGIINMKFIEKGAEGRSPEYQEPLDLRSNPFQGGGDDAILLPKDIG

SEQ ID NO: 132666 - protein, 188 aa, Glycine max
  Coding DNA Sequence Number=SeqID_40981
  Homolog annotation: Hit_ID=A5AK77; Match level="QueryCoverage=43%, HitCoverage=10%, E-value=3e-09, Identity=39%"; Hit description =Putative uncharacterized protein
CTTRGNPSDLQPFDPKIDRTFHRLVRHHFIPFDHSEHSITGESVHSVIGDFEHPDLEHYNFEHYNFEHSDSEHSDFAHSENMAQPPPRERTLREMAAPDFTYESLCIQYPDEDVPYVLKTGLIHLLPKFHGLAGEDPHKHLKEFHIVCSTMKPPDVQEDHIFLKAFPHSLEGDVQGPSRAGMTLREYY

SEQ ID NO: 132667 - protein, 168 aa, Glycine max
  Coding DNA Sequence Number=SeqID_40982
  Gene Ontology: Mol. function=aspartic-type endopeptidase activity; Biological process=DNA integration
  Homolog annotation: Hit_ID=A5BPN8; Match level="QueryCoverage=60%, HitCoverage=9%, E-value=1e-33, Identity=68%"; Hit description =Putative uncharacterized protein
  Pfam annotation: Domain name=zf-CCHC; Domain location=15-32; Score =13.4; E_value=0.015; Accession=PF00098.14; Description=Zinc knuckle
MKLLRVQHKKQNQGDNCFFCSKPGHVKKKYTKYHAWRAKKGMFLTLACSKVNLTSVPRNIWWLDSGATTNISVSMQGCLSYRKPIDYERWIYVGDASYGESFNTELCGTKRRIDNTNSGALWHKRLGHISKNKKLNDLGQTKSWIPLISQALMFVLNALKVNRSKARN

SEQ ID NO: 132668 - protein, 191 aa, Glycine max
  Coding DNA Sequence Number=SeqID_40983
  Homolog annotation: Hit_ID=A0PAV3; Match level="QueryCoverage=19%, HitCoverage=17%, E-value=9e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMWSPLKVRMRSPLKVRACSPLKARACSPLMVSVATYPSAGGRRVTRGMRVPRKEYAWSRHQHLFEENIGKTKKDAIYELLSERLGSCIYTRGRY

SEQ ID NO: 132669 - protein, 105 aa, Glycine max
  Coding DNA Sequence Number=SeqID_40984
MSVDLEALVYGVAFIYSMQLSFLTKGLIKGIQVSLPSKSICAQTFHKNKIALSKYADGIRTHQQESSQGYCASNQMCPESNNTVLNDLSMMDGSNLLTKVNISSN

SEQ ID NO: 132670 - protein, 146 aa, Glycine max
  Coding DNA Sequence Number=SeqID_40985
MGKAEEVQEMVKADMEAMKEKMATMMEAMMSMKKIMEANAVTIAATSTVAKVNPMPPSGLNQMNHPTLDMVGKDLGSKDGPHDVQTSTPSRHMACLPTIGHPMWRTLPIRMSITPLLYPLRANNPKLIMHMSLKPWGRHMKFPTTI

SEQ ID NO: 132671 - protein, 215 aa, Glycine max
  Coding DNA Sequence Number=SeqID_40986
MIDQGRLEVGSEGREEQHICMQSARESSLAKPKPLVIYFTKGAASQKPRHPLAPKLVPFPYQNSHTIPWKYTPPNKEEEETTDISSLLAKVTNITGLSGVTRSSRVFVPPDLPIQPTNVKGKAKVVEEQDDKTPHTPNEDILAKGPPEKRDGYGKKEVSLEEASEFLRIIQQSEFKGLAVGITHELGTSSGFACKGFEQGPRSPRYLGGRLRRAC

SEQ ID NO: 132672 - protein, 36 aa, Glycine max
  Coding DNA Sequence Number=SeqID_40987
LPVIQNYVGLSSSLRIRRSKSLAFVGRSTISVILAL

SEQ ID NO: 132673 - protein, 76 aa, Glycine max
  Coding DNA Sequence Number=SeqID_40988
MILQEIRRPNSLKTVPSGVANCRNLPFSGKATRGSWVRLPWEEDVRSCHQRLFKENVGKTGKVLALHASVPRDGSL

SEQ ID NO: 132674 - protein, 67 aa, Glycine max
  Coding DNA Sequence Number=SeqID_40989
  Subcellular localization annotation: CTP_CleavageSite=9; ConfidenceScore=5.02e-01
MLATHSGYRATARNPTSNCFFTSSFIFKDVLGFILLSFYFTGGHSGFRDRCGNTCAYLYFPFSTANS

SEQ ID NO: 132675 - protein, 191 aa, Glycine max
  Coding DNA Sequence Number=SeqID_40990
  Gene Ontology: Mol. function=nucleotide binding; Cellular component =intracellular; Biological process=small GTPase mediated signal transduction
  Homolog annotation: Hit_ID=Q57HZ6; Match level="QueryCoverage=100%, HitCoverage=42%, E-value=1e-82, Identity=81%"; Hit description=tRNA modification GTPase trmE
MPLHIIDTADKRDDSDEVESIGIERAWQEIEQADRVLFMVDGTTTSAVDPAEIWPDFIERLPAKLPITVVRNKADVTGEALGLSEVNGHSLIRLSARTGEGVEVLRNHLKQSMGFDTNMEGGFLARRRHLQALETAADHLQQGKAQLLGAWAGELLAEELRLSQQALSEITGEFTSDDLLGRIFSSFCIGK

SEQ ID NO: 132676 - protein, 67 aa, Glycine max
  Coding DNA Sequence Number=SeqID_40991
  Subcellular localization annotation: CTP_CleavageSite=36; ConfidenceScore=5.60e-01
MVSGASVAFVKFPKTLGGSNWAASSSTFLKNGFRVMQSYPARALDRRLQVDWARDPREGPRVLMSLR

SEQ ID NO: 132677 - protein, 141 aa, Glycine max
  Coding DNA Sequence Number=SeqID_40992
MTMIVDTLLVFNYGKRWATPLQSFEDLVFASERIDVGPERGKFDHPNRTTEKTGANEEGEKEGETHAVTAIPIRPSFPPTPTIHNPSQGSSTSISPRIRSNATCACHGEAPGRSIEHGRALKRKVQGLIDAGWLKFEEKNV

SEQ ID NO: 132678 - protein, 314 aa, Glycine max
  Coding DNA Sequence Number=SeqID_40993
  Homolog annotation: Hit_ID=Q6WAY6; Match level="QueryCoverage=99%, HitCoverage=58%, E-value=7e-37, Identity=32%"; Hit description =Putative uncharacterized protein
MPSLKKTFYQVKVKSLRITSLKELGQLMGQLQRQAFRKAYGKIWDLAMVEVSTEAIASLAQYYDQPLRCFTFGDFQLSPMVEEFEEILGCPLGGRRPYLFSRFYPSLARISKIVQISAQELDHRKQVENGVVGIPRKYLEAKARILAGRGEWAPLIDILTLLIFGGVLFPTVNGLVDLAAIDAFLAYHDHKESPVIAMLADLYDTFDRRCKACIEKGGANWDQLLAKKEGASINWFPRWKEGRIRVLILCGGFPNVPLMGTRGCISYNLVLAIRQLGYTMRRAPLEEEIAPVISRGFNKTNVETLQKVCKAWEV

SEQ ID NO: 132679 - protein, 124 aa, Glycine max
  Coding DNA Sequence Number=SeqID_40994
MSLSSSVYFVKMASRKHKSIGARPTAQYDTRRYDLGKNILLERKVEIYHTEFDDFKTELERRNLYKRLTNLADGTIDLALVKEFYANLYSFEGPSPKQARVRGYLVKIDADNLNTFLETPVVLE

SEQ ID NO: 132680 - protein, 93 aa, Glycine max
  Coding DNA Sequence Number=SeqID_40995
  Homolog annotation: Hit_ID=Q10FF9; Match level="QueryCoverage=37%, HitCoverage=20%, E-value=3e-07, Identity=74%"; Hit description =Deoxyuridine 5'-triphosphate nucleotidohydrolase, putative, expressed
MTERVLSDLRAARIPTLYTVDWRSDASALKPPVPTAIWISMEALDRCGSGRDRRGLQGVAQMIIQQIVMPEVVEVQDLDSTLRAEGGFGSTGV

SEQ ID NO: 132681 - protein, 154 aa, Glycine max
  Coding DNA Sequence Number=SeqID_40996
  Gene Ontology: Mol. function=intramolecular transferase activity, phosphotransferases; Cellular component=cellular_component; Biological process=response to DNA damage stimulus
  Homolog annotation: Hit_ID=A7PCD7; Match level="QueryCoverage=82%, HitCoverage=22%, E-value=6e-43, Identity=71%"; Hit description =Chromosome chr2 scaffold_11, whole genome shotgun sequence
  Subcellular localization annotation: CTP_CleavageSite=13; ConfidenceScore=5.21e-01
LSFLIFAPPKGVKLSYGTGGLQSRCITSQSTVYRVGILAALRSLKTRSVIGLMITASHNKVSDNGVKIAYASGGMLSQHWEPFVDALANAPSPQHLLLLINEFVEKEGISVDGDWQVEVLLGRDTRPSGEMLCFKQLNRHEQGFKLQSQFLCAP

SEQ ID NO: 132682 - protein, 124 aa, Glycine max
  Coding DNA Sequence Number=SeqID_40997
  Homolog annotation: Hit_ID=A5BSR3; Match level="QueryCoverage=71%, HitCoverage=28%, E-value=3e-13, Identity=46%"; Hit description =Putative uncharacterized protein
RGGYDYFGSRSSLAEKTKKKLEEAAQSGSVDGIIEPPSPVRRHVKWKMARTKKTGEMTTEAAKEIAEKIDSFEEQATQGSFVPDGRQDVLTAAIGHPEHPGRVRAAGVGVTIKQYIGISSTDVP

SEQ ID NO: 132683 - protein, 83 aa, Glycine max
  Coding DNA Sequence Number=SeqID_40998
  Homolog annotation: Hit_ID=A5C3T2; Match level="QueryCoverage=90%, HitCoverage=7%, E-value=6e-21, Identity=62%"; Hit description =Putative uncharacterized protein
MKGDNYKVWKEIILLHLGWMDNNYAIRRNEPPGITETSEPDVVDLYEKWERSNRLSVMFIKTNISASIWGSFDQYGQRSVESH

SEQ ID NO: 132684 - protein, 192 aa, Glycine max
  Coding DNA Sequence Number=SeqID_40999
EESSEEIYPQEEGQPLVVKEKCKEVSVSSKSLAKKETHFTIKTNIKETFPLRQPPHFLFCKKALASIATPLGLDFIPQVKKLLDEGLVCKSLNPCALLVPKIGGMMNVLSGATLFCKITRTPNIFMVCVHRDPLGSDQGVPMNPKRIKVIPEWPTPPSVEEKGPEFQEPRDLRSNPFQGGGNDAFLPRKGIG

SEQ ID NO: 132685 - protein, 140 aa, Glycine max
  Coding DNA Sequence Number=SeqID_41000
MADFMEYQASSKGYYYSMQQQGTQFERDYSSADYQEGPELQPYYQNEAEREVEAQKESPVKEHESREKDEKHAQQQWEKYSTKRRQGEHEETLSAILSLITNTSPEMIWNVLPDYMKFMEFLAKRRNCKEDVFYVTFMPP

SEQ ID NO: 132686 - protein, 40 aa, Glycine max
  Coding DNA Sequence Number=SeqID_41001
MADQQATKSKAKDKQKTHLVAHDPGDLDKTSASSEGREIP

SEQ ID NO: 132687 - protein, 146 aa, Glycine max
  Coding DNA Sequence Number=SeqID_41002
MQLPQEPLNKKPRRIARKSMAETNSVELCGAATHLYETETNMLAIVSKYQEELNLAMAHEHKVADEYAQVYAEMEARGRVIDSLHQEATMWMDRFALTLNGSQELPQLLAKVKAMADTYSAPKEIHGLLSYCQHMIDLITHIIRNR

SEQ ID NO: 132688 - protein, 210 aa, Glycine max
  Coding DNA Sequence Number=SeqID_41003
EQKVQKAVSAPACYQAFCLTDSKRMGANNHKVSPPYHGCRMTKLGFCVPSDTTVSEWQRGADNRKVSPRIMGISAYHGCRMTKLGLCVPSDTTVSEWQRGADNRKVSPRIMGAERPNLVSACHRTRLCLNGKGVRITVRGADNRKVSPRIIMTKLGLCVPTDTTVSEWQRGADNRKGISAYHVCRMTKLGLCVLIGHDCCLEWQRVRITV

SEQ ID NO: 132689 - protein, 117 aa, Glycine max
  Coding DNA Sequence Number=SeqID_41004
  Pfam annotation: Domain name=G-patch; Domain location=2-50; Score =3.5; E_value=0.07; Accession=PF01585.14; Description=G-patch domain
MMVAQVMLGHDYKPGMGLGKNNGGRTSLVRPEETAGSLERKNKGQGLRLGQRAKEAPPCHISTSFISAGLRHEGQVTAICDDYSPRRSDLVRPCPPGFKLGNWRVEECPDVYATSLM

SEQ ID NO: 132690 - protein, 158 aa, Glycine max
  Coding DNA Sequence Number=SeqID_41005
  Gene Ontology: Mol. function=[protein-PII] uridylyltransferase activity; Biological process=nitrogen compound metabolic process
  Homolog annotation: Hit_ID=P41393; Match level="QueryCoverage=100%, HitCoverage=17%, E-value=5e-68, Identity=80%"; Hit description =[Protein-PII] uridylyltransferase
  Pfam annotation: Domain name=NTP_transf_2; Domain location=74-153; Score=35.8; E_value=1.6e-07; Accession=PF01909.14; Description =Nucleotidyltransferase domain
MSNSLPDTASPLLPIPPEHPVNWPQGDLNCAAIKAHIDTFQHWLGEAFDNGIAAEQLIAARTEFIDQLLQRLWVDYGFESVCDLALVAVGGYGRGELHPLSDVDLLILSRKKLPDEQAQKVGELLTLLWDVKLEVGHSVRTLEECLLEGLSDLTVATN

SEQ ID NO: 132691 - protein, 78 aa, Glycine max
  Coding DNA Sequence Number=SeqID_41006
MNLGRDRSAMGFNQTYSPQAYPYGLPPNFTPRTAPDDLSQAPTFEGQLPPHVDYPLQEDDEGDAHLGPLLPLKGTSPP

SEQ ID NO: 132692 - protein, 105 aa, Glycine max
  Coding DNA Sequence Number=SeqID_41007
MLAIISKYQEELNLATAHEHKVADKYARVYTEKEARGRVIDLLHQEATMWMDRFALTLNGSQELPRLLAKAKAMVDTYSAPEEVHGLLRYCQHMIDLMAHIIRNR

SEQ ID NO: 132693 - protein, 85 aa, Glycine max
  Coding DNA Sequence Number=SeqID_41008
  Subcellular localization annotation: CTP_CleavageSite=55; ConfidenceScore=5.01e-01
MALARGFRRETTRGAFWKLPRGSLPQRGPGKIRRLKELVPLLSMTVTTLGALYTSSASRPSRDGHFSGSDASSSGTMSIPISRKK

SEQ ID NO: 132694 - protein, 107 aa, Glycine max
  Coding DNA Sequence Number=SeqID_41009
EEKDQSRAHSMVLKEELVACSRSKRSLSQRLCETETNMLAIIAKYQEELGLATAHEHRIADEYAQVYAEKEARGRAKAMADTYSTPEEIHGASRLLSAYDRLNGPHN

SEQ ID NO: 132695 - protein, 111 aa, Glycine max
  Coding DNA Sequence Number=SeqID_41010
  Homolog annotation: Hit_ID=Q84VH6; Match level="QueryCoverage=27%, HitCoverage=1%, E-value=2e-08, Identity=96%"; Hit description=Gag -pol polyprotein
MAPVTMGLCTVIVQIQCWLGIVMLIGLEVQMTEKALLEAELCVPIYCRSRVYCSRKQLFTTSLDEADAEGHVDTEEQIADIFTKALDANQFEKLRGKLGIVARGIIAATAI

SEQ ID NO: 132696 - protein, 217 aa, Glycine max
  Coding DNA Sequence Number=SeqID_41011
MEAMKEQMATMMEAMMSMKKIMEANAVIVAATGAVAKVNPMLPYGLKQMNRPTSNMVGKDLGSTDNPMMCKFKTSTPSRHMACLPNYTPPNVAYIPNEDTHEIPHHNLADFEPWLGYATEGQAVGGIPLENTSEGPQYHPQLHLLHSTTSKNPRAMAEMEKLDHLEERLRAIEGGEDYAFANLKELFLEPNIITPPKFKVLDFDKYKGTTCPKNHLK

SEQ ID NO: 132697 - protein, 56 aa, Glycine max
  Coding DNA Sequence Number=SeqID_41012
MEGFGCFKSNGAPRMVDVILPRKGPVTRAMSKKLQKDYARVAEESPRILMNLRVDF

SEQ ID NO: 132698 - protein, 116 aa, Glycine max
  Coding DNA Sequence Number=SeqID_41013
MDELLMDLQDSFEEQATQGSFVPHGRQDVLTAAIGPPEHPGHVRAAGAGVTIKQYFGSAPRMSRSSSSLPPEELQQLTQQIRDQLVESITERVTRQFMASFSQMQSQMQSQGLALP

SEQ ID NO: 132699 - protein, 26 aa, Glycine max
  Coding DNA Sequence Number=SeqID_41014
MEASGNRLPACVIDYTEEWVTDRDGG

SEQ ID NO: 132700 - protein, 106 aa, Glycine max
  Coding DNA Sequence Number=SeqID_41015
MSLIEVMTLARVYVKNIETIIEGTIDHILNIVPKEEKRIEGLKRLTLASYISMEKIMFNNSLLAIILPKREKFYWLPLAFKGMPSIGGLPLLGNEGFMGSFSRVLE

SEQ ID NO: 132701 - protein, 46 aa, Glycine max
  Coding DNA Sequence Number=SeqID_41016
MCSKSWLWNSENAGSRSIEESTFTDEIESNDEGGSLVSNITQCLQD

SEQ ID NO: 132702 - protein, 263 aa, Glycine max
  Coding DNA Sequence Number=SeqID_41017
  Homolog annotation: Hit_ID=Q6WAY6; Match level="QueryCoverage=34%, HitCoverage=18%, E-value=7e-11, Identity=35%"; Hit description =Putative uncharacterized protein
MRESFSHVGGYPNIPLIGTRGCINYNPALVIRQLGYPMRGAPMEESMSPFLVRDFGAQNFKAIQRIHKAWGIRNGIIGGYHEWLKVHIRGLDWLAKLKVVSEESFEAPEEDEEVQALKSELGKAKLAKEKFKLAATHIRKECARLREENATTARALEQEAKRARKEEYGRNKFRGALWGSNNELKLRREERDQSRAHSMVLKEELVACSRSKRSLSQRLCETETNMLVIIAKYQEELGLATAHEHRVADEYAQVYAEKKARGR

SEQ ID NO: 132703 - protein, 42 aa, Glycine max
  Coding DNA Sequence Number=SeqID_41018
MDKSLKIGENEWREKERRSTKFYAPNEPTSPRSSSRFSTKCA

SEQ ID NO: 132704 - protein, 164 aa, Glycine max
  Coding DNA Sequence Number=SeqID_41019
MAPKKLSTKRCRRDATRDGSSTTPEFDSHRFRSAEHQQRFEAIRGWSFHRERRVQLREDEYTDFQEEIARRRWTPLVTPMAKFDPEIVLEFYANAWPMEEGVRDMRSWVGGRWVRIMRTSKTTLTQTWMTLLLNNVLPSDHNSNLPLPKCQLVYGAHQAPCGPR

SEQ ID NO: 132705 - protein, 81 aa, Glycine max
  Coding DNA Sequence Number=SeqID_41020
MRLFRNLGREDPDIFGEGASDDTSLGEVLVTTLVTACYRALSLTDSKCDFSQSRSEHTNISGKGVGDGVSHYMLSGFECYG

SEQ ID NO: 132706 - protein, 101 aa, Glycine max
  Coding DNA Sequence Number=SeqID_41021
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=66%, HitCoverage=18%, E-value=4e-21, Identity=63%"; Hit description=ATP synthase subunit alpha
  Pfam annotation: Domain name=ATP-synt_ab_C; Domain location=7-94; Score=77.7; E_value=3.9e-20; Accession=PF00306.18; Description=ATP synthase alphabeta chain, C terminal domain
STLEDPLELAQFAELEAFAQFASDLDKATQNQLARGQRLRELLKQSQSAPLTVEEQIITIYTGTNGYLDSLEIGQTFTGEAEVLLKEAIQEQMELFLLQEQ

SEQ ID NO: 132707 - protein, 61 aa, Glycine max
  Coding DNA Sequence Number=SeqID_41022
MDLVLCLPLALDLVAYWSAMCRRQRPNLFMDELSPSGGAVLLDESPVNAGPNDLVGAMGTP

SEQ ID NO: 132708 - protein, 252 aa, Glycine max
  Coding DNA Sequence Number=SeqID_41023
  Homolog annotation: Hit_ID=Q84VI1; Match level="QueryCoverage=100%, HitCoverage=36%, E-value=9e-74, Identity=62%"; Hit description =Envelope-like protein
MASSPKETSAPGSPAVPSSPHQEQPEFNIQPIQIIPGQASVPEKLVPRRQQGVKIAENPSSATSSREVDTEMDKKIRSIVSSILKDASVPDAEKDVPTSSTPSVSVPDAEKDVPTSSAPNAEALPSPSEEESTEEEDQASEETPAPRAPETAPGDLIDLEEVESDEEPIANRLAPGIAERLQNRKGKTPLKRSGRIKTMAQKKITPITPATSRRSKVAIPSKKRKEVSSSDSDDDVELDVSTSKRAKTSGRK

SEQ ID NO: 132709 - protein, 186 aa, Glycine max
  Coding DNA Sequence Number=SeqID_41024
  Gene Ontology: Mol. function=DNA binding
  Homolog annotation: Hit_ID=Q9LZN8; Match level="QueryCoverage=75%, HitCoverage=20%, E-value=4e-09, Identity=27%"; Hit description =Putative uncharacterized protein T12C14_220
  Pfam annotation: Domain name=zf-BED; Domain location=30-74; Score =36.4; E_value=1e-07; Accession=PF02892.6; Description=BED zinc finger
MDDHDDIDILASSTIGEMLPPCSVGRKNQSIAWNHFDKLPDPNPLSQAKCRHCGSLIKYSSGTITMHIHLDRCKKKSDIMSKRQKLDSSSTTITPSSSSMIEQEACWIALVKLFVELELSFRMIENEAFHEFFSIVAPFLVVISCTTLAQDVLCLWSSEKMLQKKVINFCQVKSHTRKNLARMLES

SEQ ID NO: 132710 - protein, 84 aa, Glycine max
  Coding DNA Sequence Number=SeqID_41025
MVAITPARFPQSPFFRGYDSNVMCACHGEALGRSIEHCRALKHKVQECGCKPLVCLLKRPVLLSLDFQDRSIRDYSPCTLVGVP

SEQ ID NO: 132711 - protein, 252 aa, Glycine max
  Coding DNA Sequence Number=SeqID_41026
  Homolog annotation: Hit_ID=Q84VI1; Match level="QueryCoverage=100%, HitCoverage=36%, E-value=1e-93, Identity=73%"; Hit description =Envelope-like protein
MATSPKDTSAPGSPAVPSSPHQEQPEFNIQPIQMIPGQAPVPEKLVPKRQQGVKISENPSPATSPREVDPEMDKKIRSIVSNILKNASVPDADEDVPTSSTPNISVPDVDKDVPTSSTPNAEALPSPSEEESTEEEDQATEETPASRAPEPAPGDLIDLEEVESDEEPIANRLAPGIAERLQSRKGKSPVKRSGRIKTMAQKKSTPITPTRSRWSKVAIPSKKRKEISSSDSDDDVELDVSTSKRAKKSGKK

SEQ ID NO: 132712 - protein, 85 aa, Glycine max
  Coding DNA Sequence Number=SeqID_41027
MSWGKHGARQRRTLGHNSNSHLGYNRAAYPYGLPPNYTPPVMHDDAGHASSPILEGEPPRQPDKAHEDHQEYAQKDVDFYPPIPI

SEQ ID NO: 132713 - protein, 134 aa, Glycine max
  Coding DNA Sequence Number=SeqID_41028
  Homolog annotation: Hit_ID=UPI0000ECBAF8; Match level="QueryCoverage =49%, HitCoverage=80%, E-value=3e-21, Identity=80%"; Hit description =UPI0000ECBAF8 related cluster
MVAESSEESKSKKPIDTEFDEDVEEYKGQNSLNKQLSNTSKEAKSDNNGIYCGIPGYRARIRPIVSRITIHWPSFYNVVTGKTLALPNLIALQHIPLSPAGVIAKRPAPIALPNSCAAEWRMAPDAVFSPYASV

SEQ ID NO: 132714 - protein, 41 aa, Glycine max
  Coding DNA Sequence Number=SeqID_41029
  Homolog annotation: Hit_ID=A5BKB9; Match level="QueryCoverage=100%, HitCoverage=3%, E-value=3e-08, Identity=60%"; Hit description =Putative uncharacterized protein
MDALEIYLNEEERQLDRKVKVVRSDRSDEYYKRYDEIGQHP

SEQ ID NO: 132715 - protein, 122 aa, Glycine max
  Coding DNA Sequence Number=SeqID_41030
MTSPRSMAYSIIQSKHPRAMREIVAWFDHEQGVLIRHKCMDEMDRIGCLSNERPYGCDISKVLIRLRAKCLTCMGYFFLRRHGNKSMVRASGWLYVCIHNNTMIEQNRLEMVTSRHWLIEES

SEQ ID NO: 132716 - protein, 582 aa, Glycine max
  Coding DNA Sequence Number=SeqID_41031
  Gene Ontology: Mol. function=ATP binding; Cellular component =intrinsic to membrane; Biological process=apoptosis
  Homolog annotation: Hit_ID=Q8LJ95; Match level="QueryCoverage=94%, HitCoverage=90%, E-value=8e-61, Identity=31%"; Hit description=NBS -LRR resistance protein RGH1-like
  Pfam annotation: Domain name=LRR_1; Domain location=333-355; Score =5.4; E_value=30; Accession=PF00560.24; Description=Leucine Rich Repeat
  Pfam annotation: Domain name=LRR_1; Domain location=357-379; Score =13.8; E_value=0.67; Accession=PF00560.24; Description=Leucine Rich Repeat
  Pfam annotation: Domain name=LRR_1; Domain location=381-403; Score =13.1; E_value=1.1; Accession=PF00560.24; Description=Leucine Rich Repeat
  Pfam annotation: Domain name=LRR_1; Domain location=545-566; Score =1.1; E_value=1.9e+02; Accession=PF00560.24; Description=Leucine Rich Repeat
  Pfam module annotation: Pfam domain module=LRR_1::LRR_1::LRR_1::LRR _1; Domain location=333-355::357-379::381-403::545-566
MSIRTNPMKAVPTLLKRLSTIEGQANLDDLKPELMNIKDVFLLVKQNKEELLDTLAAVDGYLRNSNMRKLMEEKEDICRRLRTSFQKLLPADAAAVPSGDTEAVHSSSIKPFQYGRKRKEVMNRVHSFSQLQDIEKFKVHSHNLDHLHKKRGLLSLLLFPEKTVIKKRDIITWWMGLGDILGEGDGEDVFVELLHCNLIVPHHQGNCPHVNKFQVNPWVRKNLMPLLQKDKKQLFGIYSQIKTSSSHHNDTLYGSLTLDKREVKLCDEFGFKSNHWKAVFNVNASYLKFGLQWMAKMKYLEVLHLGRWPQHSASHHIEVENEEFLKELEGQKCLKYLSLRGISRISELPPSIFQLESLETLDLKACHNLETLPNDIASLRNLRRLDLSQCYLLDRMPKGIEKLTELRVLKGFVIGSSSKNPSTISDLANLKKLEQLSIHIGSGAVIQDGEFESLKELSALEHLKISWGVSDIRYSDMQIILPSNLEKLHLEGFPGENIPEWLKPDKLPFLLKELNITGGKLKSMDHGEIYDKDRYPWLKIIRLKYLKHLNVHLTNLREMFPSLWYVDIKHVPNSPSWEGSIE

SEQ ID NO: 132717 - protein, 37 aa, Glycine max
  Coding DNA Sequence Number=SeqID_41032
MENGRDNKRGKGREGSERSEDGENWTDLFGDVDAVKH

SEQ ID NO: 132718 - protein, 80 aa, Glycine max
  Coding DNA Sequence Number=SeqID_41033
MTNCIINFKETQSDAILPRKGLVARAISKRLQENWARAVEEGPKALMNLRLPFVFQEVNESIDEEDSRPTSSNGATSQPL

SEQ ID NO: 132719 - protein, 466 aa, Glycine max
  Coding DNA Sequence Number=SeqID_41034
  Gene Ontology: Biological process=intracellular signaling cascade
  Homolog annotation: Hit_ID=Q6H5G7; Match level="QueryCoverage=76%, HitCoverage=72%, E-value=4e-90, Identity=44%"; Hit description=Leaf senescence protein-like
  Pfam annotation: Domain name=DUF231; Domain location=277-457; Score =146.1; E_value=9.5e-41; Accession=PF03005.6; Description=Arabidopsis proteins of unknown function
  Subcellular localization annotation: CTP_CleavageSite=18; ConfidenceScore=5.60e-01
MRLRSNTLSKKLLPPSSSSSSVSYYAVSRIALLCFCVYLFCLSFTSPTPNQLPHSLSITNHSSLELHSISSSNQSSLATSTELPRSIFITNHSSLFASPPPPPVYVYEEPCDYTNGRWVRTKGGPQYNATNCVKMKRNQNCIANGRPDLGYLNWKWKPRECNLPRFDPNTFLQLISNKHVAFVGDSVSRNHLESLLCLLTTVTKPNRVRHPGSRRWRFPSHNAVLSFYWSPFLVQGVQRKLRGPPRYNTIHLDRVNMRWEKDLDEMDMIVLSLGHWFTVPSVFYEGGKVIGCVHRPVSSCKRDIGFYGPLRRALRTALNSIIQRKMRNRNGVDVIVRTYSPSHFEGAWDKGGTCSKTMPYGVGQRKVEGMNAEIRRIQMEELERAKAKAKKFRRFKFEVLDVTKLALLRPDGHPGAYMNPFPFANGVNPKTPVQNDCVHWCLPGPIDTWSEIFLQMLKNMARAAKK

SEQ ID NO: 132720 - protein, 456 aa, Glycine max
  Coding DNA Sequence Number=SeqID_41035
  Gene Ontology: Biological process=intracellular signaling cascade
  Homolog annotation: Hit_ID=Q6H5G7; Match level="QueryCoverage=76%, HitCoverage=70%, E-value=7e-88, Identity=44%"; Hit description=Leaf senescence protein-like
  Pfam annotation: Domain name=DUF231; Domain location=268-449; Score =129.6; E_value=9.2e-36; Accession=PF03005.6; Description=Arabidopsis proteins of unknown function
  Subcellular localization annotation: CTP_CleavageSite=14; ConfidenceScore=5.32e-01
MRSKRFTNLLHSSSSSSVFYALPPIVLLGFCVYFYYLSFTSSPENNILRSISISVSITNHSSLPAPTPPANFIDKSNDLRHKMCSSPMLERDEKRKGVYENPCDYSNGKWVRTKRGPLYNGTTCVKMKKNQNCIANGRPDSGFLYWKWKPSECHLPRFDPNTFLQFISNKHVAFVGDSISRNHLESLLCMLATVTKPNRVRHQGSRRWHFPSHNAILSFYWSPFLVQGIPRKNPGPHYNTVFLDRVNLRWARDMDQMDMIVLSFGHWFNVPSVFYEGDDKVLGCHNHPVTNCTTEIGFYGPIRRALRIALNSIIERKVSKGNGVDVIVRTYSPSHFEGDWDTGGTCAKTNPYGVGQRQLEGENAVIRRIQLEEVENAKVKAKQFRGFRLEVLDVTKLALLRPDGHPGAYMNPFPFANGVNPKKPVQNDCVHWCLPGPIDTWSGIFLEMMKNMARAA

SEQ ID NO: 132721 - protein, 422 aa, Glycine max
  Coding DNA Sequence Number=SeqID_41036
  Gene Ontology: Biological process=intracellular signaling cascade
  Homolog annotation: Hit_ID=Q6H5G7; Match level="QueryCoverage=97%, HitCoverage=82%, E-value=6e-94, Identity=43%"; Hit description=Leaf senescence protein-like
  Pfam annotation: Domain name=DUF231; Domain location=235-413; Score =133.6; E_value=5.7e-37; Accession=PF03005.6; Description=Arabidopsis proteins of unknown function
MNSKRFTNLLPSSSVSYALPPIVLLAFCIFFYYLSVTSSPENHLPHSIPITNHSSLTAPTPRSPVYEKPCDYSDGKWVRTKRGPLYNGTTCVKMKKNQNCIANGRPDLGYLFWRWKPSECHLPRFEPNIFLQLISNKHVAFVGDSVCRNHIESLLCMLATVIKPNRVRHEGSRRWLIPSHNAILSFYWSPFLVQGVQRQIKGPHYNTIHLDRVNIRWEKDLDEMDMIVLSFGHWFMAPSVYYEGEKVIGCLNHPVSNCTTEIGFYGPIRRALRTALNSIIERKVIKGNGVDVILRTYAPSHFEGDWDKGGSCAKTKPYGVWERQLEGKDAEIRRIELEEVENAKAKAKNFRGFRMEVMDVTKLALLRPDGHPGAYMNPFPFANGVPKRVQSDCVHWCLPGPIDTWSEIFLQMLENMARAAKE

SEQ ID NO: 132722 - protein, 267 aa, Glycine max
  Coding DNA Sequence Number=SeqID_41037
  Gene Ontology: Mol. function=molecular_function; Cellular component =membrane; Biological process=auxin mediated signaling pathway
  Homolog annotation: Hit_ID=A5AVY3; Match level="QueryCoverage=94%, HitCoverage=94%, E-value=1e-35, Identity=35%"; Hit description =Putative uncharacterized protein
  Pfam annotation: Domain name=DUF6; Domain location=107-237; Score =7.7; E_value=0.025; Accession=PF00892.11; Description=Integral membrane protein DUF6
MARWVNGRGNLLPFLGMVLVMLAQSGSMVVIKVAMSDGINKYVMVVYSLALSTILLLPFALFLHRSSGQIMAYVGIDLSSATLASAMLNLIPAFTFILALIFRMEEVHWRHSSSQAKASVAHKFPAVTVIVFFQLLFSTIQCAVFALIAVPDPTEWELKFDIGLIGILYQAIAATLIRYILCTWCVLKAGPLFCSMFKPVSIIFTVFMAAIFLGDDLSLGSLIGAVIIVIGFYAVLWGKSIEENKIVKGVENLESSCHNVPLLQNRT

SEQ ID NO: 132723 - protein, 117 aa, Glycine max
  Coding DNA Sequence Number=SeqID_41038
MENVQYMTWAELFKIHARSHRFYQARSMLVLEESDLKKAAQTSSSAMVARDSDESQEMSDHSSVRHTNNDGKRYSNYGNSRKNRNNTGGRDNSNAGKGGSSGGGKGGGGSNHGGEQQ

SEQ ID NO: 132724 - protein, 338 aa, Glycine max
  Coding DNA Sequence Number=SeqID_41039
  Gene Ontology: Mol. function=molecular_function; Cellular component =membrane; Biological process=auxin mediated signaling pathway
  Homolog annotation: Hit_ID=A7Q2G5; Match level="QueryCoverage=94%, HitCoverage=93%, E-value=1e-68, Identity=43%"; Hit description =Chromosome chr1 scaffold_46, whole genome shotgun sequence
  Pfam annotation: Domain name=DUF6; Domain location=17-171; Score =12.3; E_value=0.014; Accession=PF00892.11; Description=Integral membrane protein DUF6
  Pfam annotation: Domain name=DUF6; Domain location=189-309; Score =9.7; E_value=0.019; Accession=PF00892.11; Description=Integral membrane protein DUF6
  Pfam module annotation: Pfam domain module=DUF6::DUF6; Domain location=17-171::189-309
MVGVGVSVSAAMVATLFLEVGLNTLIKAANTNGMSNFVFIVYSNFLALFFLIPSTFLYHRLASFHKLSCHSLTLKKSQEKSSSPNSKLNSLENFSSLLPQLCSTAVQTLTYTGIAYSSPTLNSAMSDLVPAFTFIFAIISRMENLNLKLRSSHAKIIGTVISIAGALIITLYKGMPLTGSSMRNLVLGGSEAYLSVQLDWIIGGFLLATSSLCLSVLFIVQTWIIKDYPEELVVTTICCSPVAIFVVSMRSVVYTWAMRKKGPVYVAMFSPLGMVIAIGMGVIFLGESLYLGSMIGAATIGIGFYAVMWAQAQDEKLVNEKNENHDFVTSSSAPLLST

SEQ ID NO: 132725 - protein, 385 aa, Glycine max
  Coding DNA Sequence Number=SeqID_41040
  Gene Ontology: Mol. function=transcription regulator activity; Cellular component=nucleus; Biological process=regulation of transcription
  Homolog annotation: Hit_ID=A7Q2F5; Match level="QueryCoverage=89%, HitCoverage=95%, E-value=1e-132, Identity=69%"; Hit description =Chromosome chr1 scaffold_46, whole genome shotgun sequence
MEEHLTPLAVTHLLQHTLRSLCSHENSQWVYAVFWRILPRNYPPPKWEGQGAYDRSRGNRRNWILVWEDGFCNFAASAAPEINSGDCSTPPAYGNCEFQPYQGLQPELFFKMSHEIYNYGEGLIGKVAADHSHKWIYKEPNDQEINFLTAWHNSADSHPRTWEAQFLSGIKTIALIAVREGVVQLGAVHKVIEDLSYVVLLRKKFSYIESIPGVLLPHPSSSAYPYKVEGGGGYGALEQWQHFHGISNNHHHHHLSSSPQQAELYDHHAGHFNLPLKITPSMSSLEALLSKLPSVVPPSTQQQQSLLPSQRPLEFMGMQKVAKEELEEEVYRPELDIGESSSSMPEVGYHHQHQHQHQHHHQHHFHQVQNNNNNNVTRSGANNGF

SEQ ID NO: 132726 - protein, 506 aa, Glycine max
  Coding DNA Sequence Number=SeqID_41041
  Gene Ontology: Mol. function=calcium ion binding; Cellular component =membrane
  Homolog annotation: Hit_ID=A7Q2F1; Match level="QueryCoverage=95%, HitCoverage=95%, E-value=1e-173, Identity=64%"; Hit description =Chromosome chr1 scaffold_46, whole genome shotgun sequence
  Pfam annotation: Domain name=NHL; Domain location=142-169; Score =28.6; E_value=2.3e-05; Accession=PF01436.12; Description=NHL repeat
  Subcellular localization annotation: CTP_CleavageSite=61; ConfidenceScore=5.61e-01
MAKLHFAFSFSLLFLLSNASAAPSTTLPAKIVSGFLSNAVPAFTKWVWSLKAPTKTAIGAKSMMKFESGYTVETVFDGSKLGIEPYAVEVLANGELLILDSANSNIYRISSSLSLNTRPKLVAGSAEGYSGHVDGRLREARMNHPKGIAVDNRGNIYIADIMNMAIRKIRVTTIAGGKWSRGGGHIDGPSEEAKFSNDFDVVYIGSSCSLLVIDRGNQAIREIQLHFDDCAYQYENGLTLGIAMLVGAGFFGYMLALLQHRLGTIVASQDLEGAAMSGISPSPYQKPLKSVRPPLIPSEDESDKQEESFIRSIGKLLTNAGASVVEIMGALFPGFRKKPQSYEFQSQPLFQQPQKQVNAWPVQESFVIPDEDEPPSIDPRSPTPRKTYAFMSQDAEKMPQLWQSHAFYSGWGGDLQQQQQLKLQQQQQQQQQQQLKHHRHLYHSSVPHTYYEQSHEEINEIVFGAVQEQEGKKETVVIKPVDYGQSLYDHHYIRPRNSSMGHINKY

SEQ ID NO: 132727 - protein, 691 aa, Glycine max
  Coding DNA Sequence Number=SeqID_41042
  Gene Ontology: Mol. function=ubiquitin-protein ligase activity; Cellular component=ubiquitin ligase complex; Biological process =protein ubiquitination
  Homolog annotation: Hit_ID=A7Q2D4; Match level="QueryCoverage=99%, HitCoverage=99%, E-value=1e-178, Identity=49%"; Hit description =Chromosome chr1 scaffold_46, whole genome shotgun sequence
  Pfam annotation: Domain name=Arm; Domain location=418-458; Score =30.0; E_value=8.6e-06; Accession=PF00514.14; Description =Armadillobeta-catenin-like repeat
  Pfam annotation: Domain name=Arm; Domain location=459-500; Score=2.5; E_value=5.3; Accession=PF00514.14; Description=Armadillobeta-catenin -like repeat
  Pfam annotation: Domain name=Arm; Domain location=541-582; Score =17.6; E_value=0.047; Accession=PF00514.14; Description=Armadillobeta- catenin-like repeat
  Pfam annotation: Domain name=U-box; Domain location=286-357; Score =46.6; E_value=8.8e-11; Accession=PF04564.6; Description=U-box domain
  Pfam module annotation: Pfam domain module=Arm::Arm::Arm::U-box; Domain location=418-458::459-500::541-582::286-357
MIRNTNRSDRRVLTSPVVHPCDNIALSTLLPSLITLSNAISNFQHSSFPCNKRNARIAIRLTRLLQPFLHEIRDHHSGLADPATLSLSELHLTFQKLLFLLEDLTRKGAKLYMLMESDRVATQFRVISRSVATALDVFPFGSVEISEETKEHVLLLNEQARRARLEFEQEDKRVVVSVVSGLTRFENRVPPGEGDLKWVLEYIGVKKWSECNKEVKFLEGEIGFECLKNEEKGKMVFLSSLMGFMSYCRCVVMEDVDCEESNKKINVRESSVESEVSLSLTFLNSDDFRCPISLELMSDPVTIETGHTYDRSSILKWFSSGNLMCPKTGKRLSSTEMVPNLVLRRLIQQHCYTNGISIPFVDSSHRNRKITRTEEPGSVAAEGAMRMLASFLNGMIENGSGEEKNRGAFEIRLLSKTSIFSRSCLVEAGLAPLLLKLLSSSDSLTQENAAAALLNLSKCAKSRSVMVEKWGLELIIDVLRKGLKIEASQHVAAVLFYLSAEYGNLIGEEPEAIPSLIRLIKDGSYRSKKNGLVAIFGLLKHPENHRRVLEGGAISSLVDILKGCEKEDLITDSLAILATLAERSEGMLAILHGEALHVAVEILSCSTSRVGKEHCVALLLSLSLHGGEDVVAYLVKRTSLMGSLYSQLSEGTSRASKKASALIRVLHDFYERRSSGFKASVIPQEQFIHVR

SEQ ID NO: 132728 - protein, 170 aa, Glycine max
  Coding DNA Sequence Number=SeqID_41043
  Subcellular localization annotation: CTP_CleavageSite=27; ConfidenceScore=5.38e-01
MADFASSPATLPLNPQPSESAPDPLPQSATPPSSTPIATNPNPNPTLLPPPPALLFPAGTPPQVPGVLPPSFRPLAPQFSPVPSPNPAFQSPAVPPPGVTGAAVAVPPPQMQQMLSYQIQPGNPALRPFAPIPNGYAAAPTITPAGDGFVLEEWVVFGEIENLREFLMVG

SEQ ID NO: 132729 - protein, 98 aa, Glycine max
  Coding DNA Sequence Number=SeqID_41044
  Gene Ontology: Mol. function=nucleic acid binding
  Homolog annotation: Hit_ID=A9PCK0; Match level="QueryCoverage=64%, HitCoverage=45%, E-value=1e-23, Identity=87%"; Hit description =Putative uncharacterized protein
  Subcellular localization annotation: CTP_CleavageSite=51; ConfidenceScore=5.30e-01
MVFLFNKGGSHPNNALKAESFHCSSPKISSTPPGSMDTMTEGATVILRNAKIDMFKGSMRLAVDKWGRVELTEPASFTVKEDNNLSLIEYELVNVVAE

SEQ ID NO: 132730 - protein, 404 aa, Glycine max
  Coding DNA Sequence Number=SeqID_41045
  Gene Ontology: Mol. function=protein binding
  Homolog annotation: Hit_ID=A7QP08; Match level="QueryCoverage=89%, HitCoverage=80%, E-value=2e-94, Identity=48%"; Hit description =Chromosome chr1 scaffold_135, whole genome shotgun sequence
  Pfam annotation: Domain name=Kelch_1; Domain location=128-174; Score =29.5; E_value=1.3e-05; Accession=PF01344.16; Description=Kelch motif
  Pfam annotation: Domain name=Kelch_2; Domain location=128-174; Score =19.6; E_value=0.012; Accession=PF07646.6; Description=Kelch motif
  Pfam module annotation: Pfam domain module=Kelch_1::Kelch_2; Domain location=128-174::128-174
MATEEAPIHGDILEAIFSHVPLIHLVPASHVSNSWKRAVSSSLAHVRPIKPWLIVLTQSLRASHVTTLHAYDPRSHVWLQINNSKYCHTSPVRSSHSTLFYTLTPSEFAFSLDALHLNWHHAPSPRVWRTDPVVARVGTCVVVAGGACEFEDDPLAVEMYDLKSQSWEACPSMPALLKGSTASSWLSVAIAGEIMHVTEKHSGVTYSFDTVSKTWKGPFNLRPHESVFHCVTGTLGERLMVAGVVWEVGNVKGVKLWEVRVGSGMEEVGEMPKEMVRKLFSGSELDSVEVTWIGDFVYVRNTFEPEELVLCEVLNHLNGVGCEWRSVRNAAVRCGARMLFCGGDVCLEDLQRAVMSENPTFSIEQGRYAHAQEQIASETGDIGGRPKGKLQLSLASSWQMSLAT

SEQ ID NO: 132731 - protein, 69 aa, Glycine max
  Coding DNA Sequence Number=SeqID_41046
MAGCASPDYAWYAFLFFFILLFFFILLHYIAVLLVLFLDCAVIVLVTWFLPLRATPSYYVVFLIGLVRM

SEQ ID NO: 132732 - protein, 44 aa, Glycine max
  Coding DNA Sequence Number=SeqID_41047
MALSCTEFIVIESFVTREGKWWDKVHVWNDLEVCISYPSKSSFC

SEQ ID NO: 132733 - protein, 62 aa, Glycine max
  Coding DNA Sequence Number=SeqID_41048
MDPQGEHIIEELLAILINYMEKIKLSSEDTNLPGITYEAILEQFIGVEAAACTKQHRHWHVY

SEQ ID NO: 132734 - protein, 178 aa, Glycine max
  Coding DNA Sequence Number=SeqID_41049
  Gene Ontology: Mol. function=nucleotide binding; Biological process =defense response
  Homolog annotation: Hit_ID=A7Q201; Match level="QueryCoverage=96%, HitCoverage=31%, E-value=5e-17, Identity=36%"; Hit description =Chromosome chr13 scaffold_45, whole genome shotgun sequence
  Pfam annotation: Domain name=LRR_1; Domain location=113-135; Score =8.1; E_value=9.6; Accession=PF00560.24; Description=Leucine Rich Repeat
  Pfam annotation: Domain name=LRR_1; Domain location=33-54; Score=5.7; E_value=27; Accession=PF00560.24; Description=Leucine Rich Repeat
  Pfam annotation: Domain name=LRR_1; Domain location=89-111; Score =7.5; E_value=12; Accession=PF00560.24; Description=Leucine Rich Repeat
  Pfam module annotation: Pfam domain module=LRR_1::LRR_1::LRR_1; Domain location=113-135::33-54::89-111
MLQPDTQQLQSLRVEGYKGVNFPEWMSFPSLKYLTYLSLEDCKSCFQLPTLGKLPSLKELRIDNMINDLWIVSCKEVEGLHEALQHITNLKKLRLESLPNLEFLPDCIGNLPLLRQLHIWNCDKLTCLPPSLSLLSSLKELMIWGCHPELEKRCEKEMGEDWPKIAHVPCVEVISWRQ

SEQ ID NO: 132735 - protein, 61 aa, Glycine max
  Coding DNA Sequence Number=SeqID_41050
MRHGPGFCLVGSKKLGYNQKMVNCIHVRRHKLTLRLSMAYGVGKGVEVKMEVIGSTEKDMW

SEQ ID NO: 132736 - protein, 182 aa, Glycine max
  Coding DNA Sequence Number=SeqID_41051
MAPTRHPLDPDKSNRALGFPALITGLCQSFGVPVTPSKVIRPPITRAFIEKYCTQRQVQGDAPQAAGAPPPHQAGPARLFDTEQYLRHLVRQQAANHRAHVQTHDCLYQMSLSLQSQGFTSFPCHTPDQFRAEVAWPGDWLEAQAGEAPAGAPAEAPDEADEARKDEEMIDLLDFLGGSGAT

SEQ ID NO: 132737 - protein, 98 aa, Glycine max
  Coding DNA Sequence Number=SeqID_41052
MGMSNSSKHGKKLTKLPIISPKTPYPRKSKEKEVHPNLKFRSPTRRHALHDPENALLSRFGAEMMAKGWSFVGVSMENGGERKSNVRKRERELLKMWG

SEQ ID NO: 132738 - protein, 79 aa, Glycine max
  Coding DNA Sequence Number=SeqID_41053
MGFPLPAVIYPAKNLSAFVIHSPLRRFCVLYFGGKDEDSFHGPRFKVAQGCVSTWSSHRASPILISGAKQIRVKVSVSG

SEQ ID NO: 132739 - protein, 195 aa, Glycine max
  Coding DNA Sequence Number=SeqID_41054
  Gene Ontology: Mol. function=nucleic acid binding; Biological process= RNA-dependent DNA replication
  Homolog annotation: Hit_ID=Q2AA09; Match level="QueryCoverage=95%, HitCoverage=60%, E-value=3e-09, Identity=29%"; Hit description =Retrotransposon gag protein
MERSMIDAASGGALGDMTPAEARNLIEKMALNSQQFSAKSDAIVIREVHDVATNSSSSAETKKLEGKLDVLVNLVTQLAMNQKYAPVARLCGLCSSTNHHKDLCPSVQQSEAIEQPEAYAANIYNRPPQPQQQNQPQQNNYDLSSNRYNPGWRNHPNLRWSNPSQQQQQQQQLPYFQNVVGPSRPYVPPPIQQQQ

SEQ ID NO: 132740 - protein, 120 aa, Glycine max
  Coding DNA Sequence Number=SeqID_41055
MELMRLHQHEENDIKRKGIALRATSSFIQKESDKEDLTETEEDDNDFKLFVKRFNKLLRNKRNKRKSNINTKKKEVDSSLVPSCYESNQPGHMRSDYLVFERRIEKSDKRNLKEKKEKKT

SEQ ID NO: 132741 - protein, 83 aa, Glycine max
  Coding DNA Sequence Number=SeqID_41056
MAEEPRRVTLEDYSSSTVPQFFTSITQPEVQAQTITYPPSLIQLIQNNLFHGLPNEDPYAHLATYIEICNTVRLAGVLWGCNQ

SEQ ID NO: 132742 - protein, 125 aa, Glycine max
  Coding DNA Sequence Number=SeqID_41057
QTVSELHERPHSVRRKYTRLYQPLRTGNEGQRLAGTGRRLVHLVSLPTADRPDKDVIGDGGQEAVEQIEERKLCVWCSMQHKGNYGGKQMLVDNHRHDRKEDRQQGGKRQGFGKGFADGMLIRYA

SEQ ID NO: 132743 - protein, 112 aa, Glycine max
  Coding DNA Sequence Number=SeqID_41058
MDLFWFNGWFCLDIYCVTDLDIDCLALVLFDVAKGGENLGKNMRAIILYIACLDLRYCHHQKGGDCRQRIKLKVLMMPKDYMNHMLLKDLLKTKQLEIFKMDNQDSLRKDIK

SEQ ID NO: 132744 - protein, 107 aa, Glycine max
  Coding DNA Sequence Number=SeqID_41059
MTRGNPSDLQPFDPEIDRTFHRLVRHHFIPFDHSEHSITGESVHSVIGDFEHPDLEHYNFEHSDSEHSDFAHSQNMAQPPPRERTLREMAAPDFTYESLCIQYPDED

SEQ ID NO: 132745 - protein, 164 aa, Glycine max
  Coding DNA Sequence Number=SeqID_41060
MPPTRHPLDPDKSNRALGFPVLITGLCQSFEVPITPSKVIRPPITRAFIEKYCMPRQAQGDAPQATDAPLPPHQADPTGSLGMERYLQHLVRQQAANHRGQGQGFAPFACPTPNQFRAEVAWPGDWPEDQTEEAPTGAPDDAEDARMDEEMTDLLGFMGGSTAT

SEQ ID NO: 132746 - protein, 78 aa, Glycine max
  Coding DNA Sequence Number=SeqID_41061
MGDQEETQEQMKADMSALKEKMASMMEAMSGMRQLMEKNMATAAAVSSATEADPTLLATDMNPHGTRADLGSSRIKPC

SEQ ID NO: 132747 - protein, 101 aa, Glycine max
  Coding DNA Sequence Number=SeqID_41062
  Subcellular localization annotation: CTP_CleavageSite=39; ConfidenceScore=5.23e-01
MILHEIRRPNFLKTVPSGVANCRNLPFGGRATRGLVGASSMEGKCAELPPTFIRGKRRKNRKRCGLRTLSVKGSGVVFTHGEGCFPCSYVFLNCDEEIRPT

SEQ ID NO: 132748 - protein, 66 aa, Glycine max
  Coding DNA Sequence Number=SeqID_41063
MGDEKSNDTDQGNEQVLQEINHNDLIRPEADDSDDIIEVTIPMENILPHDKDDNYIDDDESDADFF

SEQ ID NO: 132749 - protein, 86 aa, Glycine max
  Coding DNA Sequence Number=SeqID_41064
  Subcellular localization annotation: CTP_CleavageSite=67; ConfidenceScore=5.48e-01
MFKTRLWYHFLIFGQKTLVATARIPFVEHNRVALPPKGRFCNASVNVGNSSSRSPASSTVLHPFFVRSSFFNGFLFFPFDVLKPFI

SEQ ID NO: 132750 - protein, 149 aa, Glycine max
  Coding DNA Sequence Number=SeqID_41065
  Gene Ontology: Mol. function=nucleoside-triphosphatase activity; Cellular component=integral to membrane; Biological process=transport
  Homolog annotation: Hit_ID=A7PT55; Match level="QueryCoverage=40%, HitCoverage=5%, E-value=9e-14, Identity=65%"; Hit description =Chromosome chr8 scaffold_29, whole genome shotgun sequence
MADNMSGTTTTLLPARHSYFFLLSGGRQHVWYNHYPHASSTLLLLAPVALSTLLIFIYNCSYQVLVTRERRKAKSRESATRQVREIVQARERWKIAKDVAKKGRRGLQGDVRTTLVIEVAFKDLTLTFERFVSRRYEKENHRELTTSFF

SEQ ID NO: 132751 - protein, 134 aa, Glycine max
  Coding DNA Sequence Number=SeqID_41066
  Homolog annotation: Hit_ID=A5AV98; Match level="QueryCoverage=77%, HitCoverage=14%, E-value=1e-17, Identity=46%"; Hit description =Putative uncharacterized protein
MKLGNTQVHLLNFFINVVFVRNTQCQKSQKGYMFYYPNHSMRIVKTENVRFIENGEISGSKVSQDVEIKEVRVQVPLACAFSNKVIAPLVIVPNNNEEEQHNNELMIHNEPIVEEPQEVALKRSQRQRETTISK

SEQ ID NO: 132752 - protein, 82 aa, Glycine max
  Coding DNA Sequence Number=SeqID_41067
PLGPSKIFLQKAVASGGSNLARLGELGGNHLPYFAINRGGSEEEKAEALPKRFRNVFREEFRKGFNRSSTSSFVLHRSSIFN

SEQ ID NO: 132753 - protein, 100 aa, Glycine max
  Coding DNA Sequence Number=SeqID_41068
MDYLAEGSKFVKEKLCIPRGLRTKSGPIQRKDRTLRYSKEPSLAHRGKDGPFSGGALILPGGLGTKDLRSTSIKGEGMMQSSLAKGPLITKAMSKRLQED

SEQ ID NO: 132754 - protein, 65 aa, Glycine max
  Coding DNA Sequence Number=SeqID_41069
LSLSLQSQGFTSFPCPTSDQYRAEVAWPGDWREAQAGEAPGEADEAREDEEMTDLLNFLGGSGAT

SEQ ID NO: 132755 - protein, 159 aa, Glycine max
  Coding DNA Sequence Number=SeqID_41070
  Gene Ontology: Mol. function=endonuclease activity
  Homolog annotation: Hit_ID=Q9AY32; Match level="QueryCoverage=24%, HitCoverage=59%, E-value=2e-09, Identity=82%"; Hit description=RRNA intron-encoded homing endonuclease
MVVTVKKLVVGPWVGSIGPPPVCTGRLVPSAGDALLSLTGRVVPPHGITPQDSDPIVLAFGIGVMINRDSRGHSYFIVRGEISWIYERRTTGEKHLPRMFSLIKNESWGLEERSDTVLVSTINDADQGSADVAFRTPLAPYEKIKVFGFRGEYGRKAET

SEQ ID NO: 132756 - protein, 83 aa, Glycine max
  Coding DNA Sequence Number=SeqID_41071
MCNCRNVPFCDRAKARLTGALSKGGKIRGFATNVYLWKTSEKPKEPVKMKIQSSGVVFTYEEGRQKRGCCSYVPSIKEEIRPT

SEQ ID NO: 132757 - protein, 281 aa, Glycine max
  Coding DNA Sequence Number=SeqID_41072
  Homolog annotation: Hit_ID=Q2HW90; Match level="QueryCoverage=91%, HitCoverage=71%, E-value=7e-22, Identity=26%"; Hit description =Putative uncharacterized protein
MGTNQTGKRFYQVKVKSLDTTSVKELGRLMEPLQMQAFRKTYGKILELTIAEVSIEAIASLTQYYDQPLRCFTFGDFQLVPTIEEFEEILGCPLGKRFDRIKQTRNGIAGLPRRYLEDKARAIDAFLAYHHSKESPVVAVLADLFGTFDRRIDWDQLLAGIGGRTISWFPRWKEGKEGVLFSCGRYPNIPLVGTRGCINYNPALAIRQLGYPMRGAPTEESMSPFLVRDFGAQNSKTIQRIHKAWETPLKKDQELRGIRNGIIGGYHEWLKVHIRGLDWLA

SEQ ID NO: 132758 - protein, 110 aa, Glycine max
  Coding DNA Sequence Number=SeqID_41073
MSGFTRNSPQISASPHQLDLAPYASEPYNAQWNAPGLLRDKHTLRLSRILGEMEVVFVIGSAVDRLCGLSNDIVGLVGNLAVQEWQSQHGFSLIVTSLFAPVSHSSKQDD

SEQ ID NO: 132759 - protein, 263 aa, Glycine max
  Coding DNA Sequence Number=SeqID_41074
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=33%, HitCoverage=81%, E-value=4e-43, Identity=97%"; Hit description =Chromosome undetermined scaffold_79, whole genome shotgun sequence
  Pfam annotation: Domain name=Complex1_49kDa; Domain location=64-263; Score=-9.5; E_value=4.8e-12; Accession=PF00346.10; Description =Respiratory-chain NADH dehydrogenase,
IQSLLLQTGLRALFRLVGWEVPLMIILCVLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQGHALSENAYAAGKMTTGSSVYSTSIHHFELYTEGFSVPAPSTYTAVEAPKGEFGVFLVSNGSNRPYRRKIRAPGSAHSQGLDSMSKHHMPADVVTIIGTQDIVSGE

SEQ ID NO: 132760 - protein, 74 aa, Glycine max
  Coding DNA Sequence Number=SeqID_41075
MAGKGVFSPYRVEEKINEFQEPLDLRSNPFQGGGNDAILPPRALDRRLQEDWTKDVREGPRVLMSLRVDFGPMD

SEQ ID NO: 132761 - protein, 291 aa, Glycine max
  Coding DNA Sequence Number=SeqID_41076
IPFDADAISQFLGYHLVLEEGQECEYGQRRNRSDGFDEEAIAHLLCIPGQDFARTATGRRVRIMRTNMTTLTQIWMTLLLSNIQPSDHNSDLPLSKCQLVYAILTRMSIHVAQLIADAIYLFAGMAPTRHPLDPDKSNRALGFPALITGLCQSFRVPVAPSKVIRPAITRAFIEKYCTQRQAQGDAPQAADAPPPHQAGPAGSFDTEQYLRHLVRQQAANHRAHSQGFTSFPCPTPDQFRAEVAWPGDWPEARAGEAPTEAPAEAPDEADEAREDEEMTDLLDFLGGSGAT

SEQ ID NO: 132762 - protein, 92 aa, Glycine max
  Coding DNA Sequence Number=SeqID_41077
  Subcellular localization annotation: CTP_CleavageSite=54; ConfidenceScore=5.56e-01
WLLFLSAVPPCQLLTGLRSPLRVTTTPAALNAPLQGASHSPFRLRNCWEGRSVRASSLLRQLAKGGCAARRLSWVTPVFSQSRRCKTTASEL

SEQ ID NO: 132763 - protein, 208 aa, Glycine max
  Coding DNA Sequence Number=SeqID_41078
  Homolog annotation: Hit_ID=A5BEV8; Match level="QueryCoverage=94%, HitCoverage=23%, E-value=1e-14, Identity=31%"; Hit description =Putative uncharacterized protein
YALNQIVVEFDNVSYVGISNCRCGCVMRTTHGLPCACELARYVVGSIPLGVIHMFWQKLSFSYQGLFEPKVSITEEMETISKRFEELDVCGKATVKSKFWKIAYPDLNSMCAPPEKQAKLRRTMPMLDQFHPCIHDSIENIVDVKTDCNCENHAIAALLGMGEDSLSLVHNHLLKELAKWSDEYINLLCGIDRFEELKQSLLVDGLSM

SEQ ID NO: 132764 - protein, 218 aa, Glycine max
  Coding DNA Sequence Number=SeqID_41079
MHSEAEALEHMKKRHTGHQSVSLENKTGDSSVLKIGDSAKVVTKQDMKGGEHKYGFNNNKHEKPKKVRVVNDETGYKHELFEVLRMPSRCVFFKVFMSFLHHSTSFMSFLPREFEDHGFSTCLPSSSSSCNFGPHRLSRLPLSGHAKSHVYDHCLLDHLVLRDQWSMLILLPTRPMVPTGRKLRTYLGIMARDKVDVTYENLEEVPIAQKDLIWEDIQ

SEQ ID NO: 132765 - protein, 35 aa, Glycine max
  Coding DNA Sequence Number=SeqID_41080
MDTSEPYTGAMKGTMHEPQANLGAGGVTNPGISVD

SEQ ID NO: 132766 - protein, 95 aa, Glycine max
  Coding DNA Sequence Number=SeqID_41081
TYQGNPCGVYPDLSSFTGSGVYPDLSSFTGSGVYPDLSSFIGSGVYPDLSSFIGSGVYHDLSSFTGSGVIQISVACIKRSAPTQVHIIWYQSFGS

SEQ ID NO: 132767 - protein, 296 aa, Glycine max
  Coding DNA Sequence Number=SeqID_41082
MEESMSPFLVRDFGAQNFKAIQRIHKAWETPLRKDQELRGIRNGIIGGYHEWLKVHIRGLDWLAKLKVVSEESFEAPEEDEEVQALKSGLGKAKLAKEKFKLAATHIRKECAGLQEENATTARALEQEAKRARKEEYGRNKFRGALWGSNNELKLRREERDQSRAHSMVLKEELVTCSRSKRSLSQRLCETETNMLAIIAKYQEELGLATAHEHRVAEEYAQVYVEKEARGKGDRLFTPRGNHVDGSVCPYLERESRTSPIVSQGQGDGGHLLRPRRNSWASRLLSAYDRPNGPHN

SEQ ID NO: 132768 - protein, 69 aa, Glycine max
  Coding DNA Sequence Number=SeqID_41083
MTTSKGKDPLKGLGGPMTRARARKAKEALQQVLSILFEYKPKFQGEKSKVVSGSLLKSTVMLLYKRGIL

SEQ ID NO: 132769 - protein, 66 aa, Glycine max
  Coding DNA Sequence Number=SeqID_41084
VEGRSPEYEEPRDLRSNPFQASHLKEVSLAIRELLKEVFSKKLLKEVFSKKLLKEVFSRKLLKKAT

SEQ ID NO: 132770 - protein, 67 aa, Glycine max
  Coding DNA Sequence Number=SeqID_41085
MEATDAQFDLFKMLDMAKQVAELSGAIPVDLFTNYLDQYVNLLKTMGKLVEIGFSDVSSKAEILRNQ

SEQ ID NO: 132771 - protein, 50 aa, Glycine max
  Coding DNA Sequence Number=SeqID_41086
MTSFNKPNRLNCFNIAIKTKHKRVMATLTLSGKIPRIATTNSCCIKTWKS

SEQ ID NO: 132772 - protein, 166 aa, Glycine max
  Coding DNA Sequence Number=SeqID_41087
  Gene Ontology: Mol. function=unspecific monooxygenase activity
  Homolog annotation: Hit_ID=Q5CEG7; Match level="QueryCoverage=63%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPAIKLIDTVDLEGGP

SEQ ID NO: 132773 - protein, 71 aa, Glycine max
  Coding DNA Sequence Number=SeqID_41088
YILWGTSRGYIYLGLTENKRGYICCGSVLVEGTSTRFKENKGGALHPDPMTTQFMADFLAEFAGNDHTTLD

SEQ ID NO: 132774 - protein, 92 aa, Glycine max
  Coding DNA Sequence Number=SeqID_41089
MRRDLHHLLHLLSSGDGESDDIRGYRMVFPTFHQPGENEPVDMQRLTSPSAPFVIQGQQVRWQAEIPYGHPHLSSTEANKFDDIRMMLVVRF

SEQ ID NO: 132775 - protein, 252 aa, Glycine max
  Coding DNA Sequence Number=SeqID_41090
GAPTEESMSPFLVRDLGAQSSKTIQRIHKAWETPLRKDQELRGIRNGIIGGYHEWLKVDIRGLDWLAKLKVVSEESFEAPEEDEEVQTLKSELGKAKLAKEKFKLAATHVRKECAGLREENAITARALEQETKRARKEEYGRNKIRGALWGSNSELKLRREERDQSRAHGMVLKEELIACLRSKRSLSQRLCETETNMLAIIAKYQEEQPCGWIGLLLPLNGSQELPRLLAKAKAMADTYSAPEEIHGLLGY

SEQ ID NO: 132776 - protein, 204 aa, Glycine max
  Coding DNA Sequence Number=SeqID_41091
GYGSRLIEFGQLETILKAEKLLKLSMRSPKKEKAEEELIDFLNRCKLENKIVMLCPRCSAICDKEATEGLKKYQVVNKGAKQDQRFDKGTTFALLVQFRSKNGCTRDSIRFNKGIMEVGGSSGTKQIGHRRFQRQKKLAQQNPQMGQYKEVSRRPVKERLLPPVDEDKMEDEDLLDSEPDFDVICVVSILPSEYDVQSEVTEIE

SEQ ID NO: 132777 - protein, 50 aa, Glycine max
  Coding DNA Sequence Number=SeqID_41092
MTKARQKGVQKEKEGDACHPACPGELGCFLQKQPPSGGTSWKAQVGLVAI

SEQ ID NO: 132778 - protein, 212 aa, Glycine max
  Coding DNA Sequence Number=SeqID_41093
MEGERLIPLSPTGRTGLNLLGTWQPLGGLSLRPYKKERMIDQGRLEVGSEGREEQHICMQSTDGSSVAKPKPLVIYFTKGAASQKTRHPLAAKPVPFPYQNSHSVPWRYTPPTKKKEEATNASSLSAKVTNITGLSGVTRSGHVFAPPDLPVQPANVKEKAKVVEEQDDEAPLASNKDIPAKGLSEKKDGKKEVSLEEASEFLRIIQQSEFK

SEQ ID NO: 132779 - protein, 51 aa, Glycine max; identical to SEQ ID NO: 118079
  Coding DNA Sequence Number=SeqID_41094

SEQ ID NO: 132780 - protein, 142 aa, Glycine max
  Coding DNA Sequence Number=SeqID_41095
  Gene Ontology: Mol. function=RNA-directed DNA polymerase activity; Biological process=RNA-dependent DNA replication
  Homolog annotation: Hit_ID=Q8L7J3; Match level="QueryCoverage=21%, HitCoverage=1%, E-value=2e-09, Identity=86%"; Hit description=Gag -pol polyprotein
MSPCAVPVILVPKKDGTWRMCSDCRALNNMMRIMKLAKYRLKAQVEKDEGPSGEGQSPRVEKDEGPSNPCGVYPDLSSFTGSGVYPDLSSFTGSGIYPDLSSFIGSGVSDENHETGQIQAKGPSGEGRRPKWRRTKPPSGEG

SEQ ID NO: 132781 - protein, 120 aa, Glycine max
  Coding DNA Sequence Number=SeqID_41096
MLGFIRNSPQISASPHQLDLAPYDSEPYNAPWNASGLLCDQHTLRSSRILGEMEVDEPWLGLWLPLNYQVDMGSSLAYDNEIWGEPYRLSRCKIHFLLVFFWFVLKVVFVIGSAVDRLCG

SEQ ID NO: 132782 - protein, 117 aa, Glycine max
  Coding DNA Sequence Number=SeqID_41097
MVAITPTKVHQPPFLLEYDSNTICACHGEAPGHSIEHCRALKDKVQGLIDAGWLKFEENIDIFVPRPLTNASLLIQLSPECGCKPLVCLLKRPVLLSLDFQDRSIRDYSSCALVGVP

SEQ ID NO: 132783 - protein, 132 aa, Glycine max
  Coding DNA Sequence Number=SeqID_41098
MSSSQSISINTQALCNIYTKTQSYMQCRTMLMKTHLGRLGVHDKTNHALASQVTLTRLKGALKPGDPQGLHPEESFISSPLKGLSINSLPLKELSINSSPLKGLNIYSSPLKGLSINSLSLKGLIVLRLYNS

SEQ ID NO: 132784 - protein, 87 aa, Glycine max
  Coding DNA Sequence Number=SeqID_41099
MARRDKNWSFYTLCHPEAAGPMTRRRQNLVIPHPFAIQTQSCPMARRDKNWSFCTLCHPEAAGPMTCGDLQIMVIPHPFASDTVVSY

SEQ ID NO: 132785 - protein, 192 aa, Glycine max
  Coding DNA Sequence Number=SeqID_41100
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=86%, HitCoverage=46%, E-value=3e-11, Identity=30%"; Hit description=CTV.20
  Pfam annotation: Domain name=zf-CCHC; Domain location=12-29; Score =30.0; E_value=8.9e-06; Accession=PF00098.14; Description=Zinc knuckle
MENPKQKTKSKITCYNCGKQGHISKYCRLKRKLRNLNLEPAIEEQINNLLIETSEEETETSSSVLSDENLNLIQQDDQLSSTDDDDGQINTLTREQDLLFEAINSIPDPQEKKVFLEKLKKTLEVKPRQKDFITNNKFDVSNILKRLENSSTKPTTIQDLQTEINNLKREVKELRQQQEIHQIILSQLEGRQ

SEQ ID NO: 132786 - protein, 134 aa, Glycine max
  Coding DNA Sequence Number=SeqID_41101
MKKARKEEWSRNKFRGALLGSSNELKLRKVEKDKSRMENVMLKDELRNCQESKGSLKEQLSKMEKNMVIIIDQYKEKVNLATGWGQVLRDEQTKASSLQVEREAREEVIELLHWSHSKWKSRASKAASQSQDGG

SEQ ID NO: 132787 - protein, 147 aa, Glycine max
  Coding DNA Sequence Number=SeqID_41102
MAPRKLSAKRSRKDAAAEGTSAAPEFDNHRFRSTEYQQHFEAIKGWDDEYTDFQEEIAHRRWMSLVTPVAKFDPDVALEFYAQCFAHGGGRAGHAVMGGHCLAVMHTGSGFCPDRCRETGADHAHQHDYLDPDVDDVAAQQHPAQRL

SEQ ID NO: 132788 - protein, 16 aa, Glycine max
  Coding DNA Sequence Number=SeqID_41103
TLLDIPGGGDRVVKEF

SEQ ID NO: 132789 - protein, 24 aa, Glycine max
  Coding DNA Sequence Number=SeqID_41104
NFAKVFNRTFDVLHSFFNRSSIFN

SEQ ID NO: 132790 - protein, 232 aa, Glycine max
  Coding DNA Sequence Number=SeqID_41105
MASNSQQFSARNDAIIIRGVHEVATNPSASSETKKLEGKLDALVNLVTQLALNQKSVPVARVCGLCSSADHHTDLCPSMQQPGAIEQSEAYAANIYNRPPQPQQQNQPQQSNYDLSSNKYNPGWRNHPNLRWSSPQQQQQQPAPSFQNAVGPSRPYIPPPIQQQQQPQKQPTVEAPPQPSLEELVRQMTMQNMQFQQETKASIQSLTNQMGQLATQLNQQQSQNSDKLPSQA

SEQ ID NO: 132791 - protein, 101 aa, Glycine max
  Coding DNA Sequence Number=SeqID_41106
MDSFTGAGEDGDMADYVWAEVLGHPVIRQFVKIPGHAGKQKKNIDAQSALLSLSNLLGKIVSVKKIQAEALPNRFREEFREGFDRSSTFFIRSSSFFDLQR

SEQ ID NO: 132792 - protein, 27 aa, Glycine max
  Coding DNA Sequence Number=SeqID_41107
MKANMTAMKEQVTTMMEAMMSMRKMVE

SEQ ID NO: 132793 - protein, 193 aa, Glycine max
  Coding DNA Sequence Number=SeqID_41108
MDNEEGVQEQMKADLSALKDQMASIKEAMLKLQKTIEDNATAVASNTAREAEPVLQPAINLGQDRNTTGFNRRYSPQAYPYGLPPDFTPRTAPGDLSQAPTFEGQLPPHADYPLQEDDEGDAHLGPLPPLKEPAPHELPRQNIVRHVPSPSAPVKELVPFAKDKGKIDLLEERLRAVEGLGNYPFSDLVDLCL

SEQ ID NO: 132794 - protein, 73 aa, Glycine max
  Coding DNA Sequence Number=SeqID_41109
MAPQRLTHKKSPVESPTVATCPFMGERGEAHGCAFQRRKDTSSRHQHLFVENSEKPKETGQNKNSKFGSCIYV

SEQ ID NO: 132795 - protein, 118 aa, Glycine max
  Coding DNA Sequence Number=SeqID_41110
MRCLPPSSPRRARFLSPEATAFWRNILEGPMLRHLTDYVVIPFLPSGTLRNFTDCALTLLFNFRHVTELHGLCYNAFLLASGMSQNFTKCLTMGAKYLEVVKQGSHPNNGWSPNEIRV

SEQ ID NO: 132796 - protein, 282 aa, Glycine max
  Coding DNA Sequence Number=SeqID_41111
TLTFRGLHALTFKGLHILAIKGLHVLTFKGLHALTFRGLHVLTFRGLHILAFGGLHAPPLEGYASWATPNIGGRPTVRAQPEREAITQLLCISGQDFTHATAKRRVWIMRTNMTTLTLIWMTLLLSNISSSGHNTDLPLWRNRTHKDTQWTRRSPTGPWGFQLWLQASVSPTGCPFPPARSRHHDIGIAPARHPVDPKKSNRVLGFPALITGLCQFYRVHVAPSKAGAGRDTTVAWGWPAAGNRRTVATSKAPQLIHKKVRDRQVIKRLAQDVKEALLGGNL

SEQ ID NO: 132797 - protein, 129 aa, Glycine max
  Coding DNA Sequence Number=SeqID_41112
MAHGRQALTFDKIGAIFSNDLPRESIPTNQLPLYESDHHALRDIGVGSRFDPYGEIIYRHENEAMTVRSLGFDGPYDVYPPHGKRPRGRHDIQRMWWSIYIVREHLEFMEFPYMGSEIAFHGEPVITCS

SEQ ID NO: 132798 - protein, 313 aa, Glycine max
  Coding DNA Sequence Number=SeqID_41113
  Homolog annotation: Hit_ID=A9HJM2; Match level="QueryCoverage=59%, HitCoverage=14%, E-value=3e-09, Identity=34%"; Hit description =Putative uncharacterized protein
MGGASRGHPGAGGDAVVLTRGDIIINALVSGGQGGTRDLNLAPRTFSGDGGVGISLGSGTVVNNNVVLGGFPGTVQYPNKGSVGKRGTALRAGSDTIVTNKGSFNSNGATAVLFEGDNNTFIMWSGSDIIGDLYFKGKDNQLAFGSDDGAPITQYIWGDGDLDFGIAGTYTVRVTPTAADRLDVAKTARLTGAVLRVNAMASDLYAETQRYTILHAGEKFNGTRFAGVTSNLAYLTPTLSYSDDDQDAFLTLVRKAAPAPAPVPVPPVIEPVPPATNPAPPVTDPVPPTTEPTPPVTDPAPPTTEPVPPASDP

SEQ ID NO: 132799 - protein, 77 aa, Glycine max
  Coding DNA Sequence Number=SeqID_41114
MISQWNNRAEFRVEGEVPETLQYMVSPQGRNTWTVDDLVPYVEKITILSEKQERITEHVAHCPASEHRFPSQQFHML

SEQ ID NO: 132800 - protein, 95 aa, Glycine max
  Coding DNA Sequence Number=SeqID_41115
  Subcellular localization annotation: CTP_CleavageSite=45; ConfidenceScore=5.28e-01
LSLSLTLPFSSSSFSIEAPSKASTFGHHFCPKSRKEGIFGVVKCVAMSGTSKIQDLIWARLDEGKCDFRNLHLSYPNFVRGPLLDDMRPFFGPCE

SEQ ID NO: 132801 - protein, 120 aa, Glycine max
  Coding DNA Sequence Number=SeqID_41116
MKREKHASYSSHDSCKSLSEELSDYYRGCHSSHTKHHSQRKEKDKRPQEVNISLPYFHGKDNVEAYLDWEMKVEQLFACHHISEERKGIRKEDWWPSLEEIDESKSLWGKDIPHYEGAMD

SEQ ID NO: 132802 - protein, 157 aa, Glycine max
  Coding DNA Sequence Number=SeqID_41117
  Gene Ontology: Mol. function=oxidoreductase activity; Cellular component=membrane; Biological process=metabolic process
  Homolog annotation: Hit_ID=A6T9K2; Match level="QueryCoverage=100%, HitCoverage=51%, E-value=3e-64, Identity=77%"; Hit description =Putative oxidoreductase
  Pfam annotation: Domain name=KR; Domain location=24-156; Score=-81.6; E_value=0.013; Accession=PF08659.1; Description=KR domain
  Pfam annotation: Domain name=adh_short; Domain location=21-157; Score= 40.6; E_value=5.6e-09; Accession=PF00106.16; Description=short chain dehydrogenase
  Pfam module annotation: Pfam domain module=KR::adh_short; Domain location=24-156::21-157
MEPRPDHGETSYRGTGRLTGRKALITGGDSGIGRAVAIAYAREGADVAINYLPEEEQDAAEVVQLIEAEGRKAVAIPGDIRSESFCQQLVKEAAEKLDGLDIVVNNAGRQQFNESIRTLSTEDFDATFKTNVYAMFWITKAALEYLPAGSSIINTSS

SEQ ID NO: 132803 - protein, 217 aa, Glycine max
  Coding DNA Sequence Number=SeqID_41118
  Subcellular localization annotation: CTP_CleavageSite=52; ConfidenceScore=5.66e-01
MPPASNTSQVSLASHSGSRLCTIHCRSCGWSKLYSRIPTPLSVPSSARYISRANSRSTAESSTNILTLLRLASVWFPLPPSPADPAAVPPGGAADNPDQRQNSVRKSPPPTRKWRRCCRGTLAPGCRRYAACRIPSTAAGQPPSPPSPPAAQQSQPVTSAPADAARAATDQDDRASAAHCPPGCSAALAAPVPPSGERQKTPAAPAAGCRAEIHAGF

SEQ ID NO: 132804 - protein, 805 aa, Glycine max
  Coding DNA Sequence Number=SeqID_41119
  Gene Ontology: Mol. function=transcription factor activity; Biological process=regulation of transcription, DNA-dependent
  Homolog annotation: Hit_ID=A8AKD4; Match level="QueryCoverage=36%, HitCoverage=99%, E-value=1e-104, Identity=63%"; Hit description =Putative uncharacterized protein
  Pfam annotation: Domain name=HTH_6; Domain location=523-628; Score =3.1; E_value=0.00052; Accession=PF01418.8; Description=Helix-turn -helix domain, rpiR family
  Pfam annotation: Domain name=SIS; Domain location=646-771; Score =31.2; E_value=3.9e-06; Accession=PF01380.13; Description=SIS domain
  Pfam module annotation: Pfam domain module=HTH_6::SIS; Domain location=523-628::646-771
PGSTYPIELKFSAARTRFIDGARGAVNVERHIAFVDAVQRYAGKQPGRNLPLAAHFPCGALFRLADVAVIVDVSRRRKGFAHAAHRNPVVGERNAVFGVYRATVQAVKQVSVGAVFTAAVGERCQHIVLRIVQVEAGVRFDPDTGVHATVGVGAARHHAGSGVDRRNPHFVVVVLTLVPAKSQARAPRLIELPGVMRVQGFIVAPRMVSFIVQAIFIANRYWLTVNKRRAAIVGNIVLIIFVADKEAGLLAIPLNQAESKTVAERAGDVQRAGAAALAGCATADFGVPGVLRLFAHNIDHATGILDTVQQRSRALQYLDTFGGGVEIQPLAAAHAITIDGTIRVAAKAAAYKAIFGTCQRIAFAYAADKAQRVGEAGGLIILQLLLRHHAHRLGFIEARHRRFTGDRTAGGAIAVVTVLLLRRHGEGAVLFSGKAVSTAECRYAVNSGKDSRMAQTFAARHCYAISQQKKAAEIQARREWTAVAAQIFTTSRPADAVHNDAILLTGNIMAANNIKNRVDVFGERYRARVTTLSASLQTVARYIHEHREAILDATALDIAQATQTSDATVVRTVQALGFAGLRDLKTTLAAWFGPAQNSEEKMSATISELSCDINSGIDFVLGGHQRACEVLAEPVNRQAVAAAVTLLLEARQVALFGINASGILAEYSARLFRRIGLPAVTLNRAGIALAEQLITLQRGDVLIMMAQKSAHREGMTTLKEAQRLGMPVILLTHALDSAFAQQADVVINVPRGGENGRMPLHGTVLVCLEMLILAVASASSARTVKTMKRIQDLNRSLKPTSKKAG

SEQ ID NO: 132805 - protein, 305 aa, Glycine max
  Coding DNA Sequence Number=SeqID_41120
  Gene Ontology: Mol. function=transcription factor activity; Biological process=regulation of transcription, DNA-dependent
  Homolog annotation: Hit_ID=Q46MP9; Match level="QueryCoverage=97%, HitCoverage=99%, E-value=1e-106, Identity=65%"; Hit description =Regulatory protein, LysR:LysR, substrate-binding
  Pfam annotation: Domain name=HTH_1; Domain location=14-73; Score =64.5; E_value=3.7e-16; Accession=PF00126.18; Description=Bacterial regulatory helix-turn-helix protein, lysR family
  Pfam annotation: Domain name=LysR_substrate; Domain location=97-301; Score=74.5; E_value=3.4e-19; Accession=PF03466.11; Description=LysR substrate binding domain
  Pfam module annotation: Pfam domain module=HTH_1::LysR_substrate; Domain location=14-73::97-301
MKKKTLAQVTDFDLRLLRVFKTVSECGSFSAAESLLGITRSAISLHMSDLEKRLGMRLCQRGRAGFALTEEGREILRHSETMMAAVEDFRQQVNQMHQQLRGEFNIGIINNLVTQPRMRLTHALAALRESGAGIRINISMLTAADIERGLLEGRLHVGALPMAAPVSGLAYAQLYDEHAQLYCSHAHPLFNQAERPEHHALAACDAIAPLFRMPAEAIALHQQLNCSATASDREGIAFLILTGRYIGFLPDHYAAQWVEKKQMRALAPQQFHYHSQIALVTRQGPRHNAILQRFLQALALDEPGA

SEQ ID NO: 132806 - protein, 29 aa, Glycine max
  Coding DNA Sequence Number=SeqID_41121
ATLIDAILSPQGHWIEDSKKVGPKMKEKA

SEQ ID NO: 132807 - protein, 206 aa, Glycine max
  Coding DNA Sequence Number=SeqID_41122
MGDQEETQEQMKADMSALKEQMASMMEAMLSMKQLIEKNAATATAVSSAAEADPTLLATTHHPPSNIVGRGRNTLGHDGSPHLGYNRAAYPYGLPPNYSPPVLQEDAGHIASPVHEREPPQQPDEVHKDPQDYARRDVEFYPPIPEGPAPGTLPQPNIAASPIVLSMEGPPPATEERRKLDLLEERLRAVEGFGDYPFADMTDLCL

SEQ ID NO: 132808 - protein, 225 aa, Glycine max
  Coding DNA Sequence Number=SeqID_41123
MGEVEEVQEQMKANMEAMKEKMATMMEAMMSMKKIMEANAVTIAATSTVAERNPMPPCGLNQMNHPTSVMVGKDLGSTGSPHDVQIQNEHAFPTYSLPLNYTPAKVATHEIPHHNLADFEPWLGYTTEGQAVGGIPYKTLWRALSITHNCTSCIPQRLKTLMTMAGMGKLDHLEERLRAIEGGEDYAFANLEELFLIPKHGHSQVQGAGLWQVQGDYSLQGPSKD

SEQ ID NO: 132809 - protein, 250 aa, Glycine max
  Coding DNA Sequence Number=SeqID_41124
  Gene Ontology: Mol. function=aspartic-type endopeptidase activity; Biological process=proteolysis
  Homolog annotation: Hit_ID=Q7XG75; Match level="QueryCoverage=67%, HitCoverage=30%, E-value=2e-12, Identity=34%"; Hit description=Zinc knuckle family protein
GNPSDLQPFDPEIDRAFHRLVRHHFIPFDHPEHSITAESVHSVIGDFEHPDFEHYNFEHSDSEHSDFEHSENMAQPPPRERTLREMAAPDFTYESLCIQYPDEDVPYVLKTGLIHLLPKFHGLAGEDPHKHLKEFHIVSSTMKPPDVQEDHIFLKAFPHSLEGVAKDWLYYLAPSNMERSMIDAASGGALGDMTPAEARNLIEKMASNSQQFSAKNDAIVIRGVHEVATNSAASSETKKLEGKLDALVNL

SEQ ID NO: 132810 - protein, 90 aa, Glycine max
  Coding DNA Sequence Number=SeqID_41125
MREAHEIPHHNLVDFEPCLGYATEGQSVYGVPLPNTLEEPQFHSQPQPLHFMVGRVPLAMAEKGKLDHIEERLRAIEGGGDHAFANMAEL

SEQ ID NO: 132811 - protein, 83 aa, Glycine max
  Coding DNA Sequence Number=SeqID_41126
MPSAVHVSSTFESAAPRMSLPSAVRQFSILYFYSEPHECRCLTLYMHPPPKEIGAMLHDCLSVDPLVQSSILHFFRSPMNVIA

SEQ ID NO: 132812 - protein, 309 aa, Glycine max
  Coding DNA Sequence Number=SeqID_41127
  Homolog annotation: Hit_ID=Q6WAY6; Match level="QueryCoverage=93%, HitCoverage=61%, E-value=2e-27, Identity=28%"; Hit description =Putative uncharacterized protein
LGQLMGQLQRQAFRKAYGKIWDLAMVEVSTEAIASLAQYYDQPLWCFTFGDFQLSPMVEEFEEILGCPLGGRKPYLFTGFYPSLARISNIVQISAQELDHRKQVKNGVVGIPRKYLEVKARILAVKGEWAPFIDILALLIFGGVLFPNVDGLVDLAAIDAFLAYHDHKESPIVAMLADLYDTFDRRCEKSSMRIFCCTPALYVWGCINYNPVLAIRQLGYPMRGAPLEEELAPIISRGFSETNMETLRKVREAWEVVQKKDKELRGSNNRPIGGYHEWLKTHVQGLEMLPSLKTAKREEVEAPKEDEEV

SEQ ID NO: 132813 - protein, 90 aa, Glycine max
  Coding DNA Sequence Number=SeqID_41128
  Pfam annotation: Domain name=zf-CCHC; Domain location=54-71; Score =9.5; E_value=0.057; Accession=PF00098.14; Description=Zinc knuckle
MRLKNQGNHSVNYINHQGNQGAKIFFMKKHDKGKRSLKINDESLQIQKKVSKGNNCQFYGKSGHLDKNCLKHKSWFEKKGIPYNPNHKPK

SEQ ID NO: 132814 - protein, 24 aa, Glycine max
  Coding DNA Sequence Number=SeqID_41129
MEQQQRTWECCEAKSDEGISLTIL

SEQ ID NO: 132815 - protein, 290 aa, Glycine max
  Coding DNA Sequence Number=SeqID_41130
  Homolog annotation: Hit_ID=UPI00005F76C6; Match level="QueryCoverage =48%, HitCoverage=93%, E-value=3e-38, Identity=53%"; Hit description =COG5654: Uncharacterized conserved protein
  Pfam annotation: Domain name=CHP2293; Domain location=33-146; Score =156.0; E_value=1e-43; Accession=PF09722.1; Description=Protein of unknown function (CHP2293)
  Pfam annotation: Domain name=RES; Domain location=151-276; Score =109.0; E_value=1.4e-29; Accession=PF08808.2; Description=RES domain
  Pfam module annotation: Pfam domain module=CHP2293::RES; Domain location=33-146::151-276
MRAYIPQPGANDNTLWRVAGLPPRGIELTRMLEAGLPVAVIDDIRHWSAMTRAEIMKVTGINERNIARRKSTGKSLSPDESERVARFVRVMDAAVQLFAGNKEEATQWLSRPVKGLGNVAPITLLTTESGALDVLDLIGRLEHGSQYAAEAWSGYGAKQYGGRWNHKGYPTVYVATSVSLAALEVLVHIGRESVLDEYTLLSIDIPDAEVAYLAEAFLPPDWRHDPAPLSTMDLGTGWLQSAEGAALMLPSTIIPMENNAILNPLHPAFSDYLPGVKALPFMFDRRLIRT

SEQ ID NO: 132816 - protein, 170 aa, Glycine max
  Coding DNA Sequence Number=SeqID_41131
  Gene Ontology: Mol. function=protein binding; Cellular component =integral to membrane; Biological process=defense response to fungus
  Homolog annotation: Hit_ID=A7PBE0; Match level="QueryCoverage=92%, HitCoverage=63%, E-value=4e-32, Identity=38%"; Hit description =Chromosome chr16 scaffold_10, whole genome shotgun sequence
  Pfam annotation: Domain name=LRR_1; Domain location=30-53; Score =12.8; E_value=1.3; Accession=PF00560.24; Description=Leucine Rich Repeat
  Pfam annotation: Domain name=LRR_1; Domain location=55-77; Score =11.3; E_value=2.5; Accession=PF00560.24; Description=Leucine Rich Repeat
  Pfam annotation: Domain name=LRR_1; Domain location=6-28; Score=10.4; E_value=3.6; Accession=PF00560.24; Description=Leucine Rich Repeat
  Pfam annotation: Domain name=LRR_1; Domain location=79-101; Score =13.7; E_value=0.71; Accession=PF00560.24; Description=Leucine Rich Repeat
  Pfam module annotation: Pfam domain module=LRR_1::LRR_1::LRR_1::LRR _1; Domain location=30-53::55-77::6-28::79-101
MGSLADLQSLQIRNNTLSGIFPTSLKKNNQLISLDLGENNLSGSIPTWVGEKLLNVKILLLRSNSFTGHIPNEICQMSLLQVLDLAQNNLSGNIPSCFSNLSAMTLKNQSTDPHIYSQAQLVMLYTSWYSIVSVLLWLKGRGDEYRNILGLVTSIDLSRKNSNRNSIANL

SEQ ID NO: 132817 - protein, 145 aa, Glycine max
  Coding DNA Sequence Number=SeqID_41132
IDSCLLKSISYTENALRNSFLNPVPIANSFELLIIRFSVVHGSSFDQKSGPVPVPTDEVSLVGQTLHTFLSWLTHLVKSLSQQVVVSPAKPPPKLDDPLYLMTLTIPELFSRPYQVRWDATVFGVFNPDFPLYIKHEDLSEIAHG

SEQ ID NO: 132818 - protein, 123 aa, Glycine max
  Coding DNA Sequence Number=SeqID_41133
MPNSPCGNISWFVSFRHSSTECPSPPARSCHHDIGIVPARHLVDPKKSNRVLELPALITGLCQIYGVPVAPSKAIMPPTNRAFIKKYCAPRQVQGETPQQPGDGRQRATDTPPPPLEFTSAHP

SEQ ID NO: 132819 - protein, 86 aa, Glycine max
  Coding DNA Sequence Number=SeqID_41134
MGKVGSSRGKGSDPLKEDATTEHLQKGGRIFQRTTPKRWRDLAAQVVPPMMERETMIVMVDTLSILYYEKMVGSAPSKLCGFGLRQ

SEQ ID NO: 132820 - protein, 240 aa, Glycine max
  Coding DNA Sequence Number=SeqID_41135
  Gene Ontology: Mol. function=motor activity; Cellular component=cell projection
  Homolog annotation: Hit_ID=UPI00016621D1; Match level="QueryCoverage =96%, HitCoverage=40%, E-value=9e-22, Identity=33%"; Hit description =UPI00016621D1 related cluster
KGGPLGTSTLTFRGLHALTFRGLYVLTFRGLHALTFRGLHILAIRGLHVLAFRGLHALIFRGLYALTFSGIHTLTFRGLHVLAIRVLHVLTFRGLHALTFRGLYALAFRGLHALTFRGLHVLAIRGLHVLAFRGLHALTFRGLHILAIRGLHVLSFRGLHTLTFRGLHILTIRGLHILSFKGLHALTFRGLHVLVFRGFLALTFRGLLVLPFRGLHILAFRGLHALTFRGLHILTFRGLH

SEQ ID NO: 132821 - protein, 91 aa, Glycine max
  Coding DNA Sequence Number=SeqID_41136
MAKEQPRRVTLEDYSKGRNVPFAGERGRGSRARFPKEERCAESPPTFIYGKRRKNRRKPVKMKILSSGVVFTLEEGISTSYVCLEGQQPIF

SEQ ID NO: 132822 - protein, 63 aa, Glycine max
  Coding DNA Sequence Number=SeqID_41137
  Homolog annotation: Hit_ID=Q2HW89; Match level="QueryCoverage=61%, HitCoverage=3%, E-value=1e-07, Identity=69%"; Hit description =Integrase, catalytic region; Ribonuclease H
MEAVLSFEVEVPSQRILAESVLEESEWAQTRYDQLNLIEVCDNLSPFAKFIGCPKHLIKTEPN

SEQ ID NO: 132823 - protein, 234 aa, Glycine max
  Coding DNA Sequence Number=SeqID_41138
MTPKKLSTKRSRRDTTAEGSSAAPEFDSHHFRSAEHQQRFEAIKGWSFHRERRVQLRVDKYTDFQEEIARRHRTSLVTSMAKFDPEVVREFYASAWPTEEGVRDMRSWVRGQWIPFDADALSQFLGDPLVLEEGQQCEFSQRGNRADGFDEEAIAQLLCTPGQDFARTAAGRRVWIMRTSMTTLTQTWMTLLLSNVLPSDHNSDLPLPKCQLVYAILTRMSVHVAQVCHPPDTL

SEQ ID NO: 132824 - protein, 109 aa, Glycine max
  Coding DNA Sequence Number=SeqID_41139
MMITKDDDKGDDKKLKDQSRTIQEFKIRIKKNSRLKNQDSSLRSLSQHIGRYILCGTSRGYIYLGLTENKGWYISCGSVLVEGTSTRFKENKGGYIPCGSLLVKGFLQG

SEQ ID NO: 132825 - protein, 104 aa, Glycine max
  Coding DNA Sequence Number=SeqID_41140
MAYERGGDFLEDARKILNREAFPPGGSLVRSPVPAFRFTGVIPLLWPRLSHSTPDTQFRVGSSLQAGLYARTPRFSPTAAPLSGNYRLESNPERHAKAPLAAAT

SEQ ID NO: 132826 - protein, 49 aa, Glycine max
  Coding DNA Sequence Number=SeqID_41141
MGWNVSNLWPVFASWVRATLLELLEVGAVYERPFLERGELTEPLVVQFF

SEQ ID NO: 132827 - protein, 218 aa, Glycine max
  Coding DNA Sequence Number=SeqID_41142
  Homolog annotation: Hit_ID=Q9AVH2; Match level="QueryCoverage=66%, HitCoverage=51%, E-value=8e-48, Identity=66%"; Hit description =Putative senescence-associated protein
LIRLTRVANGTSLWGAEAPYCWSANGLRAHASLLAQILTSRRSVIIQRTVASRHWLSTKRDDQLCESTVPLVLAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 132828 - protein, 160 aa, Glycine max
  Coding DNA Sequence Number=SeqID_41143
MKGAPAEESLSPFLMRDFGAQSSKIIQRVHKTWESSLRRDKELRGIRNGIIGGYREWLKDHTRGLDWLSKLKVINEENFKAPEENEEVQALKTELGKARLAKEKFKLVATDIRKECVGLREGNAASARALERETKRARKEEHGRDKFRGALWGSNNELKL

SEQ ID NO: 132829 - protein, 58 aa, Glycine max
  Coding DNA Sequence Number=SeqID_41144
MRAHEGAARGNAWGAEPMEKTALPRPSHFPVKYLPGIFQEISAPFVSHFRSPQSNDRA

SEQ ID NO: 132830 - protein, 63 aa, Glycine max
  Coding DNA Sequence Number=SeqID_41145
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q06RC3; Match level="QueryCoverage=92%, HitCoverage=42%, E-value=3e-18, Identity=86%"; Hit description=ATP synthase epsilon chain
  Pfam annotation: Domain name=ATP-synt_DE; Domain location=13-62; Score=55.1; E_value=2.4e-13; Accession=PF00401.11; Description=ATP synthase, DeltaEpsilon chain, long alpha-helix domain
MALMGVNDAEKGSDIDPLVGEAQQTLEIAEANLNKAEGKRQTIEANLALRRARTRVEAINVIS

SEQ ID NO: 132831 - protein, 200 aa, Glycine max
  Coding DNA Sequence Number=SeqID_41146
  Pfam annotation: Domain name=G-patch; Domain location=1-42; Score =21.1; E_value=0.00054; Accession=PF01585.14; Description=G-patch domain
MVARVMLRNGFEPGMGLGKDCLGNADVVDIKGNPYKYGLGYEPGMSGRRNVPSRFRADRVWPGRISQCFTSAGMVSEEEVAAIEEEFPQDPPSFVQRCHPDSQVGSWRVISQSEVYAADSIYEGRFFEDPNNEGLTIDFDRDISQTINEEEEEDVLSPELERFLSCGAVPGVGGQHCPSPEKGRQGSDMCRLPGLEPSQS

SEQ ID NO: 132832 - protein, 161 aa, Glycine max
  Coding DNA Sequence Number=SeqID_41147
ISHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHSQGFASFSCPTPDQFRAEVAWPRDWPEAQAEEAPPEAPGDGEEAHEDEEMADLLDFLGGSGDT

SEQ ID NO: 132833 - protein, 44 aa, Glycine max
  Coding DNA Sequence Number=SeqID_41148
EETGDSWHLWLLRAIQLLAYESRKLNGAERPYAVHEKNCREDQP

SEQ ID NO: 132834 - protein, 180 aa, Glycine max
  Coding DNA Sequence Number=SeqID_41149
  Pfam annotation: Domain name=G-patch; Domain location=51-90; Score =25.6; E_value=0.00015; Accession=PF01585.14; Description=G-patch domain
MDPFGGSRSLYTPPEIEVRSGGAFVYRIGRGRHLDSFSGQPWLSDAAVMMARVMLGNGYEPGMGLGKDNGGITSLISAKGNRGKFGLGYKPTQVDIKKGITGRKSGGQGSRLGQEVKGGPPCHISRSFISTGLGHEGQVVAICEDDSPSGSELVRPCPPGFRLGNWRVEERPDIYATSIM

SEQ ID NO: 132835 - protein, 202 aa, Glycine max
  Coding DNA Sequence Number=SeqID_41150
  Gene Ontology: Mol. function=repressor LexA activity; Cellular component=intracellular; Biological process=negative regulation of transcription, DNA-dependent
  Homolog annotation: Hit_ID=A7ZUR5; Match level="QueryCoverage=100%, HitCoverage=100%, E-value=1e-101, Identity=91%"; Hit description =LexA repressor
  Pfam annotation: Domain name=GntR; Domain location=7-66; Score=1.0; E_ value=0.051; Accession=PF00392.12; Description=Bacterial regulatory proteins, gntR fam
  Pfam annotation: Domain name=LexA_DNA_bind; Domain location=1-65; Score=144.5; E_value=2.9e-40; Accession=PF01726.7; Description=LexA DNA binding domain
  Pfam annotation: Domain name=Peptidase_S24; Domain location=114-182; Score=80.5; E_value=5.6e-21; Accession=PF00717.14; Description =Peptidase family S24
  Pfam module annotation: Pfam domain module=GntR::LexA_DNA _bind::Peptidase_S24; Domain location=7-66::1-65::114-182
MKALTTRQQEVFDLIRDHIGQTGMPPTRAEIAQRLGFRSPNAAEEHLKALARKGVIEIVSGASRGIRLLVEEETGIPLIGRVAAGEPLLAQQHIEGHYQVDPGMFKPSADFLLRVSGMSMKDIGILDGDLLAVHKTQDVRNGQVVVARIDDEVTVKRLKKQGNSVQLLPENSEFSPIVVDLREQNFSIEGLAVGVIRNGEWL

SEQ ID NO: 132836 - protein, 21 aa, Glycine max
  Coding DNA Sequence Number=SeqID_41151
MELASSSFKRGESSDSFYLEG

SEQ ID NO: 132837 - protein, 115 aa, Glycine max
  Coding DNA Sequence Number=SeqID_41152
GGYEHPVGLIEARNQSWKPQGPVGLFRVHWASCGMLLSSNVIYICVRVVMLVRMIRTRLFAAARVKSCPGMHSSCVIASLSGCTRTVGPPPISVGGPGTVKRKTTGPLTGSASLG

SEQ ID NO: 132838 - protein, 302 aa, Glycine max
  Coding DNA Sequence Number=SeqID_41153
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPKCAPEHRMVQELVRAQRLNSKRHEHFVQKVIVLIQEMKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132839 - protein, 87 aa, Glycine max
  Coding DNA Sequence Number=SeqID_41154
MSGFTRDSPQISASPHQLDLAPYASGPYNAQWNAPGLLHDKHTLRSSRILGEMEVDEPWLGLSRCKIHFLVGVFRLCLRWCSSLEVR

SEQ ID NO: 132840 - protein, 417 aa, Glycine max
  Coding DNA Sequence Number=SeqID_41155
  Gene Ontology: Mol. function=DNA-dependent ATPase activity; Biological process=DNA metabolic process
  Homolog annotation: Hit_ID=Q7CRY3; Match level="QueryCoverage=44%, HitCoverage=73%, E-value=7e-68, Identity=72%"; Hit description =Putative uncharacterized protein
GNRWQADNSVLTAQQIAARPESSLPVQTGEEHQPRADQLLVVEELRERLERIGGGPERLHETLPFGVDAIDHHLPGGGLKLGCLHELSGGGNGAADGAAAALFAAGVAARIAGKVLWCVTRQDLFMPGLTQAGLSQNRLIIVECRDEKGVLDCFEEGLRCNGFGAVMGEVAKLPMNASRRLQLAAETSGVTGIAIRRFRRPADAALFGEPTAAVTRWRPAGFLSFCDVAAAKAPNLKWKPVMQKVVSLYLPTWPTDRFRRLSGQNAPPVEKPLVMIGRQGSRRLALALDKAAKAAGIRPGTPVSKAQALVPGLLVEDLDAVGDARALEQLAFHFLRIYAPIVAADAPDGLVLDTAGADHLHGNEMLMLSGMVNRLHAAGFAARAAIADSWDQHHTAGWATGGDQQLAACRAEAGGSH

SEQ ID NO: 132841 - protein, 221 aa, Glycine max
  Coding DNA Sequence Number=SeqID_41156
VVSEENFEAPEEDKEVQALKSELGKAKLAKEKFKLAATHVRKECAGLREENAITARALEQETKRARKEEYGRNKFRGALWGSNSELKLRKEERDQSRAHSMVQKKLVSALCETETNMLAIIAKYQEELGLAAAHEHRIVDEYAQVYAEKEARGRVIDSLHQEATMWMDRFALTLNGSQELPRLLAKAKAMADTYSAPEEIHGLLGYCQHMIDLMAHIIRNR

SEQ ID NO: 132842 - protein, 100 aa, Glycine max
  Coding DNA Sequence Number=SeqID_41157
MRCVISSEVLKGIISDVKEERDLCGESKRKVDGVSRSKCELVEVQNGEKEKEKGGEGVQHGKRRRSKVNLRLSNPPKAAMAHYSVWGSTRWLDSAKGRQL

SEQ ID NO: 132843 - protein, 88 aa, Glycine max
  Coding DNA Sequence Number=SeqID_41158
MAEVSTEAIASIAQYSDQPLSQNLDTGVRPRKASRKWGGWGTKKIFGSKGKILGKSRRMGPIHGHPGTFDIRGGPLSKCGWVGGPGSD

SEQ ID NO: 132844 - protein, 144 aa, Glycine max
  Coding DNA Sequence Number=SeqID_41159
MGEAEEVQEKMKADMEAMKEQMATMMEAMISMKKIMEANAVIVAATSAVAKVNPMLPSGLKQMNHPTSNMETHEIPHHDLANFEPCLGYAAEGQAVGGIPLQNPLEGPQYHPQLHLLHSTAVKNPHDYGRNGKVGSYRGKAQGH

SEQ ID NO: 132845 - protein, 252 aa, Glycine max
  Coding DNA Sequence Number=SeqID_41160
  Homolog annotation: Hit_ID=A5C169; Match level="QueryCoverage=67%, HitCoverage=14%, E-value=2e-07, Identity=26%"; Hit description =Putative uncharacterized protein
MVIDQSLFHDLTKLPSDGVPFEGTLNDDWKFDFSAHDARQLVCTNNADMTGRLLVGSLAFESCILHYLIVRILLPRSSNLAQVSEEDLIIMWAFHTGRQLDWAHLVRYRMHKALRLNAPLPYPQLVTLFFRHFQIPLDSEPYVPIKRSFLIGAAVIASFGYRKERDGSWVKKGVPPADDEGHIPVEDNSTLLQRLMDKFDGLQNFVGDKFDAMELQVDMRFDAMESRITRVEEDVSFIRTCFDPPPPPPSSS

SEQ ID NO: 132846 - protein, 84 aa, Glycine max
  Coding DNA Sequence Number=SeqID_41161
  Homolog annotation: Hit_ID=UPI0000ECBAF8; Match level="QueryCoverage =51%, HitCoverage=50%, E-value=1e-17, Identity=100%"; Hit description= UPI0000ECBAF8 related cluster
MARSVFASCPYSRDLYGRKLTSGRHRGGAPIRPIVSRITIHWPSFYNVVTGKTLALPNLIALQHIPLSPAGVIAKRPAPIALPN

SEQ ID NO: 132847 - protein, 36 aa, Glycine max
  Coding DNA Sequence Number=SeqID_41162
MARSVFASCPYSRDLYGRKLTRSLEVSSPSKNISYQ

SEQ ID NO: 132848 - protein, 146 aa, Glycine max
  Coding DNA Sequence Number=SeqID_41163
MGEGEELQEQMKADMEAMKRANGHNDGGHDEHEKGNGSHAVIVAATNTVAKVNPMPPSGLNQMNHPTSDMVGKDLGSTGGPHYAQIQIKHAFTPYGLPPNYTQPNVAYTPNKDVNNSVPILIKSRQPHHVHVSQPTGRHMKFPTTI

SEQ ID NO: 132849 - protein, 79 aa, Glycine max
  Coding DNA Sequence Number=SeqID_41164
MMKDCVKSKIRDINSFLQTKDECAVEVAKPRKGIKKIVQKMVKAQWVSALNQCVLQQWATPFSLVYGMEQYPVEVEMSQ

SEQ ID NO: 132850 - protein, 60 aa, Glycine max
  Coding DNA Sequence Number=SeqID_41165
TSSKSFKVIQWLTNWNEEDFAEVGNWGWCAYAWLVEMGKLICAIARSPPSTKYDGCPIIQ

SEQ ID NO: 132851 - protein, 141 aa, Glycine max
  Coding DNA Sequence Number=SeqID_41166
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=2e-24, Identity=67%"; Hit description=LacZ protein
MKHFTDTLISANIVHLSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132852 - protein, 344 aa, Glycine max
  Coding DNA Sequence Number=SeqID_41167
  Gene Ontology: Mol. function=endonuclease activity; Biological process=DNA restriction-modification system
  Homolog annotation: Hit_ID=A3XZ15; Match level="QueryCoverage=64%, HitCoverage=20%, E-value=1e-104, Identity=86%"; Hit description=Type III restriction-modification system restriction subunit
  Pfam annotation: Domain name=DEAD; Domain location=175-333; Score= -37.6; E_value=0.027; Accession=PF00270.20; Description=DEADDEAH box helicase
  Pfam annotation: Domain name=ResIII; Domain location=175-344; Score= -9.6; E_value=0.00031; Accession=PF04851.6; Description=Type III restriction enzyme, res subunit
  Pfam module annotation: Pfam domain module=DEAD::ResIII; Domain location=175-333::175-344
TICQAVAEINIEDDKNINYIMVQLPETNIRPWEADFDSLEKVLQQSTTSIKDGRSIGAGALIVCLDDEITTETVEGIVKLKAELDPETTQVVFKDESFADDRVKTNAIQILKQANINDVKRQEIFQSNFSVSSNALASEQLGLFSRNNDIGVANALTLLPEELYENTRNVQLINGLPQTETSKQALPSLDFTIEMETGTGKTYVYLRSVFELNQKYGLTKFIIVVPSVAIKEGVYKSLQITEEHFRKEFKNVQYDYFVYDSSKREQVRNFATNDYIQIMVINIDAFSKSFTDPEKETTANLIHRTDDRLNGMKPIEFIQATNPVVLIDEPQSVTSTANRKNAIA

SEQ ID NO: 132853 - protein, 84 aa, Glycine max
  Coding DNA Sequence Number=SeqID_41168
MTELVSPEDDVNLRVSTGLSPAIDEGLFVLQIAKKNYTDNHSGIFACQRDSKVSMTELVKVADKSEALAPTYPPMRNSDLRSSG

SEQ ID NO: 132854 - protein, 232 aa, Glycine max
  Coding DNA Sequence Number=SeqID_41169
MAPRKLSAKRSRKDAAAEGTSAAPEFDNHRFRSTEYQQHFRGHQGMEGVRDMRSWVRGQWIPFNAMPQPVPGRPASVRGGPGVLDFAQTVAGRRVRIMRINMTTLTQTWMTLLHSNILPIDHNSDLPLPKCMPPTRHPLDPDKSNRALGFPALITGLCQSFGVPVTPSKVIQPPITWAFIEKYCTPRQAQGDAPQATDAAPPPHQADPAGSFSMEQYLQHLVRQQAANHRGQ

SEQ ID NO: 132855 - protein, 121 aa, Glycine max
  Coding DNA Sequence Number=SeqID_41170
  Subcellular localization annotation: CTP_CleavageSite=47; ConfidenceScore=5.38e-01
MVKVGTSYVPINVSFSPKVLSPRFPSQSPAVLPVQLLTGIGYRVTIPTTYEPEAYKCSLGLNRPTVGKGSRRFAYCGAKGGCVILALLVGVTDEAEYVRISASSLTDYVGEFGAAERNGAA

SEQ ID NO: 132856 - protein, 90 aa, Glycine max
  Coding DNA Sequence Number=SeqID_41171
GISSLSSFSIPLPFIFQEAKESIDEEDPRPTNSNGAYTTRERIEVGLKKGKFDYVASMNSGNKRLRENGVKKKKGETYVVAVVPTWPNFP

SEQ ID NO: 132857 - protein, 150 aa, Glycine max
  Coding DNA Sequence Number=SeqID_41172
MHALQLYIRDKVQTKYSVVYRSFSCLLPSIRVIGLSLIGLSWVILSTNSGRIGNVYGRYLYLDPFTICLFRQLDFSYPILQPSWMLPTTPASLFLNSLSLLFGESLAFLICWCILRCSSFNPRAMNGWIASFEGGPQIEYPNCLIPNIGL

SEQ ID NO: 132858 - protein, 269 aa, Glycine max
  Coding DNA Sequence Number=SeqID_41173
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIVGLKYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132859 - protein, 148 aa, Glycine max
  Coding DNA Sequence Number=SeqID_41174
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=1e-25, Identity=57%"; Hit description =Putative uncharacterized protein
  Subcellular localization annotation: CTP_CleavageSite=42; ConfidenceScore=5.45e-01
MTMITPSSKLTLTKGNKSCKRTQRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132860 - protein, 294 aa, Glycine max
  Coding DNA Sequence Number=SeqID_41175
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSVPPQQIGWVTDAMSCSECIPQLPNEVLRLIAQYHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132861 - protein, 203 aa, Glycine max
  Coding DNA Sequence Number=SeqID_41176
MTLLLSNILPSDHNSDLPLPKCQLVYAILTRMSIHVAQLIADAIYIFAVPVAPTKVIRPPITRAFIEKYCTQRQAQGDAPQAAGAPPPPHQAGQAGAFDMEQYLRHLVRQQAANHRAHVQTHDCLYQMSLSMQSQDFASFSCSLQTSSGQRLHGPEIGPRPKRERRPQKLPAMEKRPTRTRRWPICLTSWEGVEIRDWEIPRF

SEQ ID NO: 132862 - protein, 215 aa, Glycine max
  Coding DNA Sequence Number=SeqID_41177
  Homolog annotation: Hit_ID=Q1J7G7; Match level="QueryCoverage=17%, HitCoverage=65%, E-value=7e-10, Identity=71%"; Hit description =Transposase
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMTVKGGARYQLLFPLVRVNFELGVIMVIAVSFGKPVVPAALMNRPTRGERRFAYWALAECILAYYVGTDEGVSEVLHVAGEKRLH

SEQ ID NO: 132863 - protein, 156 aa, Glycine max
  Coding DNA Sequence Number=SeqID_41178
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=50; ConfidenceScore=5.62e-01
MTMITPSSKLTLTKGNKSCYQTLSLKLNLSRSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132864 - protein, 175 aa, Glycine max
  Coding DNA Sequence Number=SeqID_41179
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=75%, E-value=4e-24, Identity=65%"; Hit description=LacZ protein
SCPTPDQFRAEVAWPGDWPEAQAGEAPPEAPGDGEEAHEDEEMADLLDFLGGSGDTPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132865 - protein, 32 aa, Glycine max
  Coding DNA Sequence Number=SeqID_41180
MEAKNESLFVDDGDLSRPTAGCHGVGNNNPSY

SEQ ID NO: 132866 - protein, 126 aa, Glycine max
  Coding DNA Sequence Number=SeqID_41181
  Gene Ontology: Biological process=transposition, DNA-mediated
  Homolog annotation: Hit_ID=Q1J7G7; Match level="QueryCoverage=23%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMLRASIINFERLDILQDSVRHP

SEQ ID NO: 132867 - protein, 262 aa, Glycine max
  Coding DNA Sequence Number=SeqID_41182
MAPRKLASKRSRKDKVAEGTSSAPEYDSHRFRSAEHQQRFEAIKDDEYTNFQEEIVRRRWASLVTPMAKFDPDIVLEFYANAWPTEEGVRDMRSWVRGQWIPFDADALSQFLGYPLVLEEGQECEYGQRRNRSDGFDEKAIAQLLCIPGQDFARIAAGRRVQIMRTNMTTLTQIWMTLLLSNIQPSDHNSDLPLPKCQLVYAILTRMSIHVAQLIADAIYLFAGMAPTRHPLDPDNSNRALGFPALITGLCQSFGVPVAPSK

SEQ ID NO: 132868 - protein, 248 aa, Glycine max
  Coding DNA Sequence Number=SeqID_41183
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVVNKEEKVEKIAGSIPHANIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132869 - protein, 80 aa, Glycine max
  Coding DNA Sequence Number=SeqID_41184
MQGYALCSSKAALSGTNNSKISLSIGSLVSEARLAQRMPQRITLGLGKLGLAYDYQQKNCLSYLGLAIQALLATGSSARG

SEQ ID NO: 132870 - protein, 69 aa, Glycine max
  Coding DNA Sequence Number=SeqID_41185
MDYVLKPYTGGVTTVKFTTSSKIKERGMIRSFHPIGSSYIGHDRKINGTLILHGAMSIVHEPQVNIGGK

SEQ ID NO: 132871 - protein, 83 aa, Glycine max
  Coding DNA Sequence Number=SeqID_41186
MTFLGETSSQTIVNSRLAFIFPNGTVIHNECGVYFQSASPLKDQLKNNSSELKINQSTTQVNQEQFKKFKIRIKKNSRIKKKV

SEQ ID NO: 132872 - protein, 60 aa, Glycine max
  Coding DNA Sequence Number=SeqID_41187
MVVSLFLTHLLLEVVSPIIFLPSPFCCLKPQEAKDFIDEEDTRPSSSTWSYIRDDVDVDN

SEQ ID NO: 132873 - protein, 95 aa, Glycine max
  Coding DNA Sequence Number=SeqID_41188
NTETFSSLTSYPELRRSEFLIGGYVGAKALLLSTAPLSVTMTQELVARGDTLRLSAPFCHPEAAGPMTSRDKIWSFCTLVSSRGGGPDDTWRYLK

SEQ ID NO: 132874 - protein, 140 aa, Glycine max
  Coding DNA Sequence Number=SeqID_41189
IAPTRHPLDQNKSNRALGFPALITGLCQSYGVPVTHSKVIRLPITRAFIEKYCTPRQAQGDTHQAAGAPPPPRLSQQGQGAVPFVCLTPEQFGAEVAWPGDWLDAQAGEKPVGSPGEADESHMDEDMTDLLGFLGGSGAT

SEQ ID NO: 132875 - protein, 109 aa, Glycine max
  Coding DNA Sequence Number=SeqID_41190
MQSLQNSVQQRPVMSVEEFIQLVAWPGVQPSPSGGGEASIAWEPQPEVEDGIIIPKPTPPEPFTFEADTVIAQEDVASPEPFPQAEPSPSPSCLTSLPLRTYHLHRCWI

SEQ ID NO: 132876 - protein, 67 aa, Glycine max
  Coding DNA Sequence Number=SeqID_41191
MWFCLEIKMTALSAPAALSLAFIPTDEPLSLTCQAMRHFASAKHALCAKPECHSDEVELSVPCCAKL

SEQ ID NO: 132877 - protein, 107 aa, Glycine max
  Coding DNA Sequence Number=SeqID_41192
MKLPRYKRCPAFVNRWIFSKFGLQLHKTIYHDLTVGIFEKLRKNAISSSFFLPNPFLKFQVLSPSPTSTISHRKPSLFFIENPHREEPFNRSRIYNLACGFGRERKP

SEQ ID NO: 132878 - protein, 66 aa, Glycine max
  Coding DNA Sequence Number=SeqID_41193
MEKSEKKNHSEKKLKKAYITWDENDLESSDDSENEEINLCLMAKSYESDEEKRTWHINLLLQEKLQ

SEQ ID NO: 132879 - protein, 270 aa, Glycine max
  Coding DNA Sequence Number=SeqID_41194
  Gene Ontology: Biological process=transposition, DNA-mediated
  Homolog annotation: Hit_ID=Q1J7G7; Match level="QueryCoverage=12%, HitCoverage=47%, E-value=2e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPLTGLDDQAYRYRRPRGGARYQLLFPLVRVNFELGVIMVIAVSFGKPVVPAALMNRPTRGERRFAYWALAECILAYYVGTDEGVSEVLHVGRRKKGCTGASAEYVIQDIFRFLGSLTRYARSFDCGERKWLTNGAEISWKMPGRYLTG

SEQ ID NO: 132880 - protein, 17 aa, Glycine max
  Coding DNA Sequence Number=SeqID_41195
MGQTGFVADLGVAFVDD

SEQ ID NO: 132881 - protein, 59 aa, Glycine max
  Coding DNA Sequence Number=SeqID_41196
SYGLLVSIVFLDFGAYREFGRGGAILEVILSPEARGHPKSYLDKKHSIVSESTYIGRLK

SEQ ID NO: 132882 - protein, 157 aa, Glycine max
  Coding DNA Sequence Number=SeqID_41197
MNRKPGANREDEKEGGTHVVTVVPTWPNSPPAQQCHYSANIIPSYYPPPYQPIIPNQPQRPPLNQPQGPPAAHPIPNTTLNTNQNTNQGRNFPAKKPVEFTPIPVSYANLLPVATCPSWASEGKALGCAFQRRKDARSRHQRLFVENVGKTEGNWSK

SEQ ID NO: 132883 - protein, 183 aa, Glycine max
  Coding DNA Sequence Number=SeqID_41198
MMVDTLPVFYYEKLVGYMPSSFADLVFAGERIEVGLKRGKFDYVSSTSTHAKRVGATGAKRKEGDTHAVTLAPAWVKPPQTSHGTHQYAQHHPSFSARAGISSNSAPVQPKAPIQRETPQAPAPTTTRPAGNSNAMRELSPEANSRIHPTPNDVRRPLAVPYRQPNGRNNSREDLPTPFPKVV

SEQ ID NO: 132884 - protein, 74 aa, Glycine max
  Coding DNA Sequence Number=SeqID_41199
MKLRKKEQSREEKKLLQDRTIASILEEEAHSSNSTSSDSPSSRESATYLPEAVIMADEHQQRVTLEDYLSSLVP

SEQ ID NO: 132885 - protein, 120 aa, Glycine max
  Coding DNA Sequence Number=SeqID_41200
RATRPRHQRATRPSPSEGLTPSTFRGTTHPQPSELHVLTIRGLHVLTFRGLHALAFKGLHVLAFRGLHALAFLRTTRPHLHRAARPHLQRTTRPRHLEGYTSSPLEDYMPSPSEGYALAF

SEQ ID NO: 132886 - protein, 73 aa, Glycine max
  Coding DNA Sequence Number=SeqID_41201
MHTGARFRPDRHRETSADHAHHLNFDLPLSKCQLGARPPQQGITPTRHPVDPKKSNKVLGFPALITGLCQGIL

SEQ ID NO: 132887 - protein, 96 aa, Glycine max
  Coding DNA Sequence Number=SeqID_41202
  Subcellular localization annotation: CTP_CleavageSite=80; ConfidenceScore=5.36e-01
MLVRMVRTLLFAAAQVKSCPSMHSSCVIASLSGCARTVGPPPISGGGPGTVKRKLLARKCSPLKLKVHDPLKARTCSPLRYMTLLKARTCSPLKVK

SEQ ID NO: 132888 - protein, 232 aa, Glycine max
  Coding DNA Sequence Number=SeqID_41203
MTSRDQVWSFCTLVSSKGGGPDDTRRYLTVIRTLLSSRGGGPDDQAETKFGHSAPLYHPEAAGPMTSRDQFGHSAPLYHPEAAGPMIRGDTLRLSAPFCHPEAAGPMTSRDKIWSFCTLASSRGGGPDDTRRYLTAAGPMIRGDTLRLSAPFCHPEAAGPMTSRDKVWSFCTLVSSRGGGPDDTRRYLTVIHAPICHPEAAGPMTSRDQVWSFCTLVSSRGGGPDDTRNTLR

SEQ ID NO: 132889 - protein, 94 aa, Glycine max
  Coding DNA Sequence Number=SeqID_41204
IILFEEHIAAVGTTSNNKFSKRKALDEAESPTVATYPSAGGRRVTRGMRVPRKEYAAESATNVYLRKTSGKTGKDAIYELLSERVRELYLRTGK

SEQ ID NO: 132890 - protein, 365 aa, Glycine max
  Coding DNA Sequence Number=SeqID_41205
MEVETLEDRITWELGYNVRTKFLGDDMVLLPGMSDDKAKLLIQSETESDDSLFYSLEKWTPKCRPNNRVVWLQLWGFPIQVWEMKNLRRAVAAIGDVIESDDDTEDRRRLDRARVLVQTPLPPLIRSEVIVRVGELEYRVWIVEETGVRRWVEPERKLVVRWVVGDDNIGRRWGAANQKLSPSRTQRAEGGTDVRCCDLRPLGNIQADVTPKEKSKGTVEGMLGSSFGKLNLGDSFAGTEEEAANTKEVTCYNTLQDDQRHRNHIEGKYLNGGAKVAADQTFIGEEEGHVTQSLSPSLSGEIQQGIGPGCIKGPISTPGGCNKEDIHPVELLGVQAVQNQKEGGLSNDLGPILKTDGCHKEESLP

SEQ ID NO: 132891 - protein, 90 aa, Glycine max
  Coding DNA Sequence Number=SeqID_41206
  Subcellular localization annotation: CTP_CleavageSite=61; ConfidenceScore=5.03e-01
MKRSMIDAASGGALGDMTPAENAASPSKPYVPPPMQQHQQQQQRQQATESPPQPSLEELVRQMTIQNMQFQQETRVSIQSLTNQMGQMTT

SEQ ID NO: 132892 - protein, 143 aa, Glycine max
  Coding DNA Sequence Number=SeqID_41207
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MDTEQRCNSIHLLPQFFARSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132893 - protein, 232 aa, Glycine max
  Coding DNA Sequence Number=SeqID_41208
  Gene Ontology: Biological process=transposition, DNA-mediated
  Homolog annotation: Hit_ID=Q1J7G7; Match level="QueryCoverage=17%, HitCoverage=71%, E-value=6e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIKAMHPLRRGPRLASAMCDGGVMATLPTARAGGAPCALRVNFELGVIMVIAVSFGKPVVPAALMNRPTRGERRFAYWALAECILAYYVGTDEGVSEVLHVAGEKRLH

SEQ ID NO: 132894 - protein, 129 aa, Glycine max
  Coding DNA Sequence Number=SeqID_41209
MRGVPSEETIMPSITRGFNEDNTKILQKIHKAWNKVGRKDKELRGRSNDVMGDYHKWRKSRVQGKAWHKKLEGLNGEETEVPEESEEVQVLKAELEKTKVAKEKLKVVVTRVRKECDRLRDINMFRMKR

SEQ ID NO: 132895 - protein, 182 aa, Glycine max
  Coding DNA Sequence Number=SeqID_41210
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MKHFTDTLISANIGTKAGTGPPLEVDGIDKLDKSVHANGSLMNMRWNLHSSGFCLAFESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132896 - protein, 42 aa, Glycine max
  Coding DNA Sequence Number=SeqID_41211
LQVVPYVVVLMNPAFAFLLKSKRKRLATLGISKGRDTIKVDS

SEQ ID NO: 132897 - protein, 16 aa, Glycine max
  Coding DNA Sequence Number=SeqID_41212
MALSLTGDAILSRKGI

SEQ ID NO: 132898 - protein, 189 aa, Glycine max
  Coding DNA Sequence Number=SeqID_41213
MGVTTLITRTLFRLKDLPIIFNNIAYDLTKMDEKDFKDHAIQLHDIQKPQREKFFCRAKHAEAVLSDECALSPTDELSSTTLASIATPFGLEFIPQVKKLLDEGLVRKSLNPCALLVPKIGVPMNPKRIKVNPEWPTPPTSLIELVRNHVPSWEDAQEMGVNGRSPEYEEPQDLRSNPFQGVGNDAILT

SEQ ID NO: 132899 - protein, 53 aa, Glycine max
  Coding DNA Sequence Number=SeqID_41214
MPISPCRCIARASGPLLIELSSRSTAPPGRHMAKHHSSLGMANSGQQTHRHHL

SEQ ID NO: 132900 - protein, 76 aa, Glycine max
  Coding DNA Sequence Number=SeqID_41215
MDKILKEKGKEAMKTLQKKPNQMMNFQKNGKPQKIIPSTTLLVIFKRESLEQIHIHGQILKEKGKEAMKTLQRANQ

SEQ ID NO: 132901 - protein, 165 aa, Glycine max
  Coding DNA Sequence Number=SeqID_41216
MGAKHLKMTKYKLHATKPRSPDEIRGSKDKILISFLSVDESRGLFVLQIAKRNVYTDNHSGISARQRDSKVSMTDLVSAEDDTAKKNVYTDNHSGISARQRDSNVSMTNLVSAEDDTAKKNVYTDNHSGISARQRDSNVSMTDLVSAEDDVKLRVSTGLSAAIDE

SEQ ID NO: 132902 - protein, 73 aa, Glycine max
  Coding DNA Sequence Number=SeqID_41217
  Homolog annotation: Hit_ID=A0ST23; Match level="QueryCoverage=36%, HitCoverage=55%, E-value=2e-08, Identity=100%"; Hit description =Putative reverse transcriptase
MENWRTIKLIDTVDLQGGPVGKPVVPAALMNRPTRGERRFAYWALAECILAYYVGTDEGVSEVLHVAGEKRLH

SEQ ID NO: 132903 - protein, 120 aa, Glycine max
  Coding DNA Sequence Number=SeqID_41218
  Subcellular localization annotation: CTP_CleavageSite=47; ConfidenceScore=5.38e-01
MGQMATQLNQAQSQNFDKLPSQSIHNPKNVSVITLRSGKQYQGPQPVASSSSANEPAQIHSTLEKDDDKNLKTAAYPSSILMQCYPARALDRRLQVDWARDPREGPRVLMSLRVDFEPMG

SEQ ID NO: 132904 - protein, 271 aa, Glycine max
  Coding DNA Sequence Number=SeqID_41219
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSITSGGVENVLAEHINLYNMGIGIHIKTNTGRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132905 - protein, 162 aa, Glycine max
  Coding DNA Sequence Number=SeqID_41220
MVISKRNANIQNLIYGYGGFHQQTLLSLVDALFVTQKKGGICCSKSVGIFVSLLKHVCIFSGENTETFSSLTSYPELRRFEFLIGGYVGAKALLLSTAPLSVTMTQELVARGDTLRLSAPRHSVTPSVIDEQRPMWSSVPFPEMSASSGGDFFKSHKLSRTT

SEQ ID NO: 132906 - protein, 182 aa, Glycine max
  Coding DNA Sequence Number=SeqID_41221
MKREKHASYSSHNSCKSLSEELRDYYEGRHRSHLRPHSHRREKERKTQEANINLPYFHGKDNVEANLVWEIRVEQQLIKKSTSKFYGSHSYPKKDQGQGILGVTPSKPKGGHITSQCPTTKTMIMRSQDIYSSQDEATTSPSSSESEEAKGEESSEEIYPQEEGQPLMVKEECKEEVSPPRG

SEQ ID NO: 132907 - protein, 76 aa, Glycine max
  Coding DNA Sequence Number=SeqID_41222
MGFKNKVKINIRGQISLLKHKGLRGFFKGSVKTPYYSTQHIKDTKELKLARRRFRSQDYLKENLKWRIEGFPPSNL

SEQ ID NO: 132908 - protein, 130 aa, Glycine max
  Coding DNA Sequence Number=SeqID_41223
TYQGNPCGVYPDLSSFIGSGVYPDLSSFTGSGVYPDLSSFTGSGVIQKLYRLYQVIRPVSGVYPDLSSFTGSGVYPDLSSFTGSGVIQNLRSLYQTIRPVRFISSGIRASALDTAYSNSVWGKNCLIAEC

SEQ ID NO: 132909 - protein, 149 aa, Glycine max
  Coding DNA Sequence Number=SeqID_41224
  Homolog annotation: Hit_ID=Q6UUU1; Match level="QueryCoverage=40%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALLLFLPFGLPVSFRCYGRVCLIPRPDTHFR

SEQ ID NO: 132910 - protein, 118 aa, Glycine max
  Coding DNA Sequence Number=SeqID_41225
MTSRDQVWSFCTLVSSRGGGPDDTRRYLTAAGPMIRGDTLRLSAPFCHPEAAGPMTSRDQIWSFCTLVSSRGGGPDDTRRYLTVIRTLLSSRGGGPDDKQRPSLVILHPCIIQRRRAR

SEQ ID NO: 132911 - protein, 348 aa, Glycine max
  Coding DNA Sequence Number=SeqID_41226
  Pfam annotation: Domain name=Transposase_23; Domain location=258-328; Score=-15.8; E_value=0.064; Accession=PF03017.5; Description =TNP1ENSPM transposase
MVSMTLFAKSTTLARRSDPFVIAAKTLRGRICERRHKPFRKQNIVPHMLSRGGYEFLENKLMEEKKKKQLKEAAKSRSTDTVIDPPSPIRRHVKWKMAHTKKTGQMTSKAAKKITDKIINSLEELASQGSFVAHGRQYILYATIGRPKHHGRVRAAGASVTIKQYIGSTPRTSRKSSSMAPKDLEQLAQKIRDQLKESITEKVTRQLMLSFNQMQSQFQSQMQSQGLILPSKPEVGPSIAHVSTKESYVDPSGNDRDTGDSDKCGLYVEESPPRLVALGRLCEGSTTVHNIPLLHDQVKVGVEEVRDVDAPIPVPNEEAKLVRQTHNTFLAWARHLVKRLSKQVFQLD

SEQ ID NO: 132912 - protein, 120 aa, Glycine max
  Coding DNA Sequence Number=SeqID_41227
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=72%, HitCoverage=73%, E-value=1e-24, Identity=67%"; Hit description=LacZ protein
MQQSIHMSLREMSIPGDPLVLERPPPRWSSNSPYSESYYNSLAVVLQRRDWENPGVTQLNRLAAHPPFASWRNSEEARTDRPSQQLRSLNGEWDAPCSGRIKRGRVWWLRAAVTATLCQR

SEQ ID NO: 132913 - protein, 115 aa, Glycine max
  Coding DNA Sequence Number=SeqID_41228
MWNLLSMLGFKRDSPQISASPHQLDLAPYASEPYNAQWNAPGLLRDKHTLRSSRILGEMEVDEPWLGVVFVIGVRNDIVGFGGKLGRIGMAVTAWVSPSFLPSSFAPVFSVVLVG

SEQ ID NO: 132914 - protein, 58 aa, Glycine max
  Coding DNA Sequence Number=SeqID_41229
  Homolog annotation: Hit_ID=A1FW85; Match level="QueryCoverage=48%, HitCoverage=9%, E-value=3e-09, Identity=100%"; Hit description =Endonuclease/exonuclease/phosphatase precursor
MLSRFRRPALSALLALALPAVAWAVTPAPLKVMSFNVRTPADTEPGKRWPDRRDAMVK

SEQ ID NO: 132915 - protein, 271 aa, Glycine max
  Coding DNA Sequence Number=SeqID_41230
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSINELSHFYETFQVIWEDNVDPDNMTQYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132916 - protein, 137 aa, Glycine max
  Coding DNA Sequence Number=SeqID_41231
MDPWVLVPITLRGLHVLAIRGLHVLNLRGLHVLAIRGPHVLALRGLHALTSRGLHVLALRGLHALTLVTLTVERTTRPRLERTTRPSPSEGCTALTVERATRPHLERTTCPRQQKAARPHLQRTAPPRLERAARPHL

SEQ ID NO: 132917 - protein, 76 aa, Glycine max
  Coding DNA Sequence Number=SeqID_41232
MCLSGKKKETLGPTKIGENHSKCINLTQGKDYGELGFWLKACRTAGHDTCQDLASGSGIKGMSPHYSHDTHATNDD

SEQ ID NO: 132918 - protein, 197 aa, Glycine max
  Coding DNA Sequence Number=SeqID_41233
PLVEVECKHTGVEQHNEQVEHNERMEPRTKQIVHTESAVREEQKKSMEQWTWVEEELAHGSHQDDDNKTMHHVQSCNILGTEHRRNNRCHHHCVLNCNHHGYDGQSSNHHDHRKSISSIIVGGIVTRSLRSQIDLDYQGKDIGVRCEAGEHEAQLVEAIEVNLSHVNFEKSNSKTASKKSPTRKMTEGREGEKKRKT

SEQ ID NO: 132919 - protein, 111 aa, Glycine max
  Coding DNA Sequence Number=SeqID_41234
  Homolog annotation: Hit_ID=Q2HU20; Match level="QueryCoverage=63%, HitCoverage=32%, E-value=1e-07, Identity=37%"; Hit description =Ribonuclease H
MDSFSNQSRGSSSQLSAQDLKNQLKNQLAIEYAQQFLEQGKQAACAGVFRDMHGRWVLGFVYEKSASVIMSKFWGVATALQMAWHSGIPKLTVESDSKIAFESLENPFFCI

SEQ ID NO: 132920 - protein, 196 aa, Glycine max
  Coding DNA Sequence Number=SeqID_41235
  Homolog annotation: Hit_ID=Q8LDE6; Match level="QueryCoverage=28%, HitCoverage=20%, E-value=7e-07, Identity=50%"; Hit description =Similar to MtN3 protein
MSAHVGLELTEPASPIPSHSEEPSGHGISTLVMILIADIGGLALTMLIIITFAVKAINRVHAVGWICAISSIAVFAAPLSKMNFSHKGARGSGPLAKNMKATFGTVCSLNIVFCDEENDFNDGGAVTDNSLDDDNGDGRIVVIGVITGYRKACKLKDRLRHKTAAIPSDTPNIKKTKLYPLFMFLYKGPKNDRETF

SEQ ID NO: 132921 - protein, 799 aa, Glycine max
  Coding DNA Sequence Number=SeqID_41236
  Gene Ontology: Mol. function=sugar:hydrogen symporter activity; Cellular component=integral to membrane; Biological process =carbohydrate transport
  Homolog annotation: Hit_ID=O48537; Match level="QueryCoverage=53%, HitCoverage=99%, E-value=1e-174, Identity=70%"; Hit description =Putative sugar transporter
  Pfam annotation: Domain name=MFS_1; Domain location=411-746; Score =70.8; E_value=4.4e-18; Accession=PF07690.7; Description=Major Facilitator Superfamily
  Pfam annotation: Domain name=Sugar_tr; Domain location=407-795; Score= 254.3; E_value=2.6e-73; Accession=PF00083.15; Description=Sugar (and other) transporter
  Pfam module annotation: Pfam domain module=MFS_1::Sugar_tr; Domain location=411-746::407-795
  Subcellular localization annotation: CTP_CleavageSite=29; ConfidenceScore=5.00e-01
MADFFGRRKLFDNIKCLFNTLPFHKGRVSSKALSICIRFLGRQGRIKESLSLFEEMETVFRCKPDNLVCNNMLNVLCKRESSVEMIELALSIFHKIVLLIPFPEIGVLHTHSAVNMLIGELCLMSAKEGSVGKVRVRNTRRPCTILVPNIGGNSGAIQPAIQVFWVVCNSGLLPSAFVVVKLMSEFSCLGNKEEADRVLRIVEERKLTCVQEGYSVVITALWECGRVEEACDLFGRIEHDQLDQCVKLERKLENQKLQNLCKGDELDAAYEKAQSMLGKGIPLSAYARDIFQQVFQKCGKIKIARQLLEKTERVQEPIMFNGAAWWVQIQKQRERVFVIASVGSWCGLWPGSFNMETELTIRGKSFGGIFGSSAKPRSLRVQSSDEDVEDLVPSNISGKPSGTVLPYVGVACLGAMLFGYHLGVVNGSLEYLAKDLGITQNTVIQGWIVSALLAGATVGSFTGGALADKFGRTRTFQLDAIPLAIGGFLCATAQSVQTMIIGRLLAGIGIGITSAVVPLYISEISPTEIRGALGSVNQLFICIGILAALLAGKISEAEKAVKTLYGKERVALVMHDLTAASEGSSEPEAGWFDLFSSRYRKGATLFLLQQLAGINAVVYYSTSVFRSAGIASDVAASALVGASNVFGTIVASSLMDKKGRKRLLITSFSGMAASMLLLFVSFTWKVLAPYSGTLAVLGTVLYVLSFSLGAGPVPALLLPEIFASRIRAKAISLSLGTHWISNFVIGLYFLSVVNKFGISIVYLGFSIVCLLTVVYIARNVVETKGRSLEEIERALSPAT

SEQ ID NO: 132922 - protein, 85 aa, Glycine max
  Coding DNA Sequence Number=SeqID_41237
MTGLSAVEIIGSFQSGKTYNLTGSKSPETTDAVTRNHRCSHQKPPPAAEQVWRFPAEAVARERTKDFERSCCKRMKEPENEGATE

SEQ ID NO: 132923 - protein, 981 aa, Glycine max
  Coding DNA Sequence Number=SeqID_41238
  Gene Ontology: Mol. function=binding; Cellular component=endoplasmic reticulum membrane; Biological process=electron transport
  Homolog annotation: Hit_ID=A7PAN9; Match level="QueryCoverage=41%, HitCoverage=19%, E-value=5e-85, Identity=42%"; Hit description =Chromosome chr14 scaffold_9, whole genome shotgun sequence
  Pfam annotation: Domain name=NAD_binding_1; Domain location=683-800; Score=33.1; E_value=1e-06; Accession=PF00175.12; Description =Oxidoreductase NAD-binding domain
MHKNPKSVVLALVLLGYKCIREASTEAEPDDSVFPLRDMFRTCLSVVAALTKDCIEGFHLQEVKSFNQRRLIHTKLAFSLEQIISISTLALESKYAKDCEARNSICVGAVRYCIQCFHTVLSDSNMQVQVIGLQFLKARIQRGVNTEDNSFIMFLVGELIADIFTLIQKMLKNTITRESVTIASECLSLLVLLQTLSKGDDCQRSFMNLLLEAIVMIFLSTEDGISQEVNNLRSTTVKLVSRLAQIPSSAIHVKDVLLSMPPLHRQQLQGVIRASVTHDKNPTDIKVPVLDIKMPKPSEGTEEKHTIPSSAAVMQTDENDKEEDEFSEDDWDAFQSFPVSKSEDEDDSKTEHVAEGKDPSTVKMSSEIESSIGGVEFQDFFISKSINSEKELKGDECLEAVKEKHDQTYPSTNKPHDNENQEMEGKLQTSVAREKGTSIPGSELVSCDQKPEVEAKMEENLQNSGLQGEGASIPGNERVSCDQKPEVEAEASIPGNERVSCDQKPEVEAEMEKKLQNSGLQEEGTSIPGNELISCDQKREVEAEGSIEEEVVSDSLTLQQGVSEQPNRCDEDAEKDSVNENESHHPQLEMSESPIESVHNSTKSEPFAEDHKEMLSMIKPEFLPNGPDVVIQDTVLIHQPKVQITYHNIANDKSHFSSASGIHVPAWFHKGLLPTPSPSLPLILVGPGTGCAPFCGFVEERALQSRTNSTDPIIFFFGCWNENGDFLYRDFWLSHSQNKGVLSEAKGGGFYVAFSRDQPQKVYVQHKMREQSQRIWNLLAEGAAVYIAGFSRKMPADVTSAFEEIVSKENEVSREDAVRALKHCENHEFLSKNSFLGSWDAPRDPKEAEAKLTRLRREYALQVKEVRKEYIREMEVMKIEKERKDEARREALRVANEERKKLKAQAAQLRAQERDIERQQFRETLLKERAEKLENWKMKVKMHEEKKAEKKEFLHRQSSAWIEEGNLEKKVVEAMVEIMHL

SEQ ID NO: 132924 - protein, 88 aa, Glycine max
  Coding DNA Sequence Number=SeqID_41239
  Homolog annotation: Hit_ID=A7QT98; Match level="QueryCoverage=65%, HitCoverage=5%, E-value=7e-11, Identity=62%"; Hit description =Chromosome chr1 scaffold_166, whole genome shotgun sequence
  Subcellular localization annotation: CTP_CleavageSite=68; ConfidenceScore=5.52e-01
MLGGASATAAYAMGMVSDALSSVAFTTSAIVVSAAGALVVGFPLLWDSPLVTVGSLRLQGISLFRMLQASAEMWLLETGQMQNNPVLA

SEQ ID NO: 132925 - protein, 98 aa, Glycine max
  Coding DNA Sequence Number=SeqID_41240
MGFDRRKSLATLKGFHYSIFQSSECPQTWRSSGTLRPAEAFITAAIMQIENFKLNGNQEKIIMIDHNQLKTHPDQNHGANSCPTVMIDKHLERVQAKI

SEQ ID NO: 132926 - protein, 1050 aa, Glycine max
  Coding DNA Sequence Number=SeqID_41241
  Gene Ontology: Mol. function=ubiquitin-protein ligase activity; Cellular component=ubiquitin ligase complex; Biological process =protein ubiquitination
  Homolog annotation: Hit_ID=A2Q2S4; Match level="QueryCoverage=98%, HitCoverage=98%, E-value=0.0, Identity=58%"; Hit description=U box
  Pfam annotation: Domain name=U-box; Domain location=581-656; Score =45.7; E_value=1.6e-10; Accession=PF04564.6; Description=U-box domain
MASSLEELLAEEGFKGIRRVTRSRSSFHHGASSEPLYSLDGRFSVSSERVRTQRTKSDASQYQITSRQLKTDTHTATNRMSRDNLFSRDKMDQRLKNSSTDTDSGKGIDMPRNEITEVTEQEANIVKDNYSNQVSLKRGKEKNFNELVEEEDPVKDAKMHSRSSSIHMLGHSSETRKNIKPQKDSYTRSNSSRNKDSNHAMQAASSLALDQVAVQAVVSILNGYIKRFSKDVNFRSTLRGKCFSSLNLIEMEEENITETKVIRSLEQAIEAIDQTAEEPISTMYLKRTTMQLSIITGLSLNDFKYECTCGIPNYKLSACAHLYLSVARTVLLPELWEHLFSPQFSHLKAWYIKEAEFLEDAPSKTRKLKLLQKVYNEHLDSGTHVFAIYYKDWLTEGVESPPIPSIGIPSASVTGSQEGNSLGYSFESASSIDPLSPQPMVSKKLYDSMFGDSSKSRVYQVKDINDDDNLDNCMKGSCGSTIVRQTLTYESETVKFTDQDIEDFSIGVAIDTIKPHNGNSMTASEEWQKRNLVDDINNSFSMKTNLSSHSIDALSHEKASELVLKKPNKTSSTLEGSYFPSIPHEFICPLTGDLFEEPVTLETGQTFEREAIKAWFEKGNRTCPVTGNNLECVTMPFTNLILKRLIDNWKSERLDYLIDFSFQTVENLEELKLKKRDEAAVFKLESHFSSLKEEDKSTYAKHLISLGVLPFLFRRFEQGNVKEKSHVVSLLLNCIQVDSGCIYQIARSVNRKCLVELLHSKEATPTTNAIIFLTELLSMKRRKDVTSFISGLAGEKVFNIMHILLMYLKNPSPFEKPLIAVLLLHFDLLVEPQKFGIYREVAVNAIAEALDASLNDEKGREKCCRALLILCSHFSSTGKIPTMTSILKQAGYNNDSLEVKPPGHEEEGQQLYVTISVSSEDEEKRGEELLKKLLESLIGDGESPFLKSISRCLDTNHLDLVRTCLITVTWLSSSLSSLFSAGLHLPAFLSIISQLKGILENGELELKTLASLSLLNFSKISEDIAPLLHGLVDVAWTAKQLHAIVSRENL

SEQ ID NO: 132927 - protein, 196 aa, Glycine max
  Coding DNA Sequence Number=SeqID_41242
MGEGCCTQPYPCICKEAVSGFEPMTNKEGIGGSQVDGVGGYCGKGKGRDGIGGIDCKGGNGSVLLRWLVTEATQVELLIKVAWQSDTIVEPSMQLTPSTDGMSNLYTPYWSVVLFTEKLICSLVFGEVALNLHLALFRESAGGAGITINSSHHTDVRDNWTWRLSNEHKWATEERCNKKKKENRKLIHENSEGSKN

SEQ ID NO: 132928 - protein, 105 aa, Glycine max
  Coding DNA Sequence Number=SeqID_41243
  Gene Ontology: Mol. function=aspartic-type endopeptidase activity; Biological process=DNA integration
  Homolog annotation: Hit_ID=A5AXT6; Match level="QueryCoverage=89%, HitCoverage=20%, E-value=6e-13, Identity=43%"; Hit description =Putative uncharacterized protein
MLPEIQQNSSKKTIEITQWSLDQVLRLSTGALQLLQLIFCGFKLYSELAVPHLTPMVLCDNSSAVLMAHNPVLHAETKHMELDLFFAREKVLSKKLIVQHIPGYD

SEQ ID NO: 132929 - protein, 970 aa, Glycine max
  Coding DNA Sequence Number=SeqID_41244
  Gene Ontology: Mol. function=molecular_function; Cellular component =small subunit processome; Biological process=rRNA processing
  Homolog annotation: Hit_ID=A7PNQ3; Match level="QueryCoverage=88%, HitCoverage=98%, E-value=0.0, Identity=74%"; Hit description =Chromosome chr8 scaffold_23, whole genome shotgun sequence
  Pfam annotation: Domain name=Utp21; Domain location=664-865; Score =220.6; E_value=3.7e-63; Accession=PF04192.3; Description=Utp21 specific WD40 associated putative domain
  Pfam annotation: Domain name=WD40; Domain location=171-209; Score =21.1; E_value=0.0042; Accession=PF00400.23; Description=WD domain, G- beta repeat
  Pfam annotation: Domain name=WD40; Domain location=214-253; Score =25.5; E_value=0.0002; Accession=PF00400.23; Description=WD domain, G- beta repeat
  Pfam annotation: Domain name=WD40; Domain location=258-296; Score =25.4; E_value=0.00021; Accession=PF00400.23; Description=WD domain, G-beta repeat
  Pfam annotation: Domain name=WD40; Domain location=304-342; Score =21.7; E_value=0.0027; Accession=PF00400.23; Description=WD domain, G- beta repeat
  Pfam annotation: Domain name=WD40; Domain location=463-501; Score =15.6; E_value=0.19; Accession=PF00400.23; Description=WD domain, G -beta repeat
  Pfam annotation: Domain name=WD40; Domain location=505-542; Score =5.2; E_value=7.3; Accession=PF00400.23; Description=WD domain, G -beta repeat
  Pfam annotation: Domain name=WD40; Domain location=546-584; Score =48.4; E_value=2.6e-11; Accession=PF00400.23; Description=WD domain, G-beta repeat
  Pfam module annotation: Pfam domain module=Utp21::WD40::WD40::WD40::WD 40::WD40::WD40::WD40; Domain location=664-865::171-209::214-253::258 -296::304-342::463-501::505-542::546-584
  Subcellular localization annotation: CTP_CleavageSite=62; ConfidenceScore=5.00e-01
MGIFEPYRAIGCITSSVPFSVQRLGTETFLTVSVGKAFQVFNCAKLNLVLVGPQLPKKISALASYREYTFAAYGNNIAVFKRAHQVATWSSHNAKVKLLLLFGDHIVSVDARGNMFLWPFKGIDENLFPFGHIMLDEKFSPSCIMHPDTYLNKVLVGSEQGPMQLWNISTKKKIFEFKGWNSPISCCVSSPALDVVAIGCTDGRIHVHNIRYDEELVTFTHSTRGSVTALSFSTDGQPLLASGGSSGVISIWNLEKKRLQSVVREAHDSVITSLHFFANEPVLMSSSADNSIKMWIFDTSDGDPRLLRFRSGHSAPPLCIKFYANGRHILSAGQDRAFRLFSVEDQQSRELSQRHVSKRAKKLKLKEEEIKLKPVIAFDCAEIRERDWCNVVTCHMDTAQAYVWRLQNFVLGEHILNPCPENPTPVKACAISACGNFVFLGTAGGWIERFNLQSGIRRGAYIDISESRNCAHDGEVVGVACDSTNTLMISAGYKGDIKVWNFKERDLKTRWDVDCSIVKIVYHRYNGLLATVADDLTIQLFDVVALRLVRKFEGHTDRITDLCFSEDGKWLLSSSMDGSLRIWDVILARQIDAIHVDVPITALSLSPNMDILATAHVDQSGIYLWVNQAMFSSTSNVDSYASGKEVVSVKLPSISSAEHSRDEHYDEPMNASQPKDALYFSTQDKQIPELVTLSLLPKSQWLNLINLDIIKVRNKPIEPPKKPEKAPFFLPSVPSLSGEILFESDAAFTDYIKGLSPSTLDMELRMFQIIDDDDDQQEAEKRPELVSIEWLLDYFIHELSCRNNFEFLQAVIRLFLKIHGETIRQQSCLQEKARKLLDIQCMVWQRVDKLFQSSRVKNRTSSLTTMHKSNTLSPTSNYASRLQNPQTLGFSFEQDLTVKILAPTSMNRSPKRSQILKQKENHLSLFGSGWRWWHVADLVVGCGVRVAACLGTELVLEVGREVERMREEML

SEQ ID NO: 132930 - protein, 312 aa, Glycine max
  Coding DNA Sequence Number=SeqID_41245
  Gene Ontology: Mol. function=oxidoreductase activity; Cellular component=extracellular region; Biological process=lignin catabolic process
  Homolog annotation: Hit_ID=A7PIS1; Match level="QueryCoverage=90%, HitCoverage=54%, E-value=1e-112, Identity=60%"; Hit description =Chromosome chr13 scaffold_17, whole genome shotgun sequence
  Pfam annotation: Domain name=Cu-oxidase; Domain location=145-273; Score=25.2; E_value=6.8e-06; Accession=PF00394.13; Description =Multicopper oxidase
  Pfam annotation: Domain name=Cu-oxidase_3; Domain location=19-135; Score=194.6; E_value=2.5e-55; Accession=PF07732.6; Description =Multicopper oxidase
  Pfam module annotation: Pfam domain module=Cu-oxidase::Cu-oxidase_3; Domain location=145-273::19-135
MRKKHLKILWRLCTFQQPHDKYKKVSRLYHTKSMVTVNGQFTGPRIVAREGDRLLIKVINHVQNNISIHWHGIQQLQSGWADGPAYVTQCPIQIGQSYVYNYTIGGQRGTLFWHAHISWLRSTLCDPIIILPKHGVPYPFTKPYKEVSIIFGEWWNADPEAVITQALQIGGGPNVSDAYTINDTFKLKVKPTKTYLLGLINAALNDKLFFSIANHTFTVVDTICDWPGHSLHSTSSIKKLSLFKPILPSLNDTSFSTNFANNLRSLASAQFPANVPQKVDRPFFFTVDLGTTPAHETKLVKDPPIQQNLQHQ

SEQ ID NO: 132931 - protein, 180 aa, Glycine max
  Coding DNA Sequence Number=SeqID_41246
  Homolog annotation: Hit_ID=A7NZA1; Match level="QueryCoverage=78%, HitCoverage=89%, E-value=1e-58, Identity=68%"; Hit description =Chromosome chr6 scaffold_3, whole genome shotgun sequence
  Pfam annotation: Domain name=ATS3; Domain location=21-159; Score= -10.3; E_value=4.8e-07; Accession=PF06232.2; Description=Embryo -specific protein 3, (ATS3)
MGMLIMKSIGGHLICCCVLLQVLVAGGESLEAPELKKNCTYVITIETTCTWGAETSNIVSLRFGDTNSNVILVRHLNSKHLRKVDPLEPEVLDDMPRKPFTAPCVNSPICYLYLKLIGNDDWRPGFAQIQVLEGSHLNSDYFYFRRFVPRHVWHGSDVCDSEVTPFGLKKKRNVYVNNIP

SEQ ID NO: 132932 - protein, 305 aa, Glycine max
  Coding DNA Sequence Number=SeqID_41247
  Gene Ontology: Mol. function=hydrolase activity; Biological process =metabolic process
  Homolog annotation: Hit_ID=A7NY75; Match level="QueryCoverage=23%, HitCoverage=20%, E-value=3e-19, Identity=62%"; Hit description =Chromosome chr6 scaffold_3, whole genome shotgun sequence
MTTKFFWMWRIFIGQVKAGEIHQIKEHKLDHFRMTRAFNKVITLSITGALNAVLTEEHRKEICRYLYNHQVLGVYEWSGNNPLPPEIWLLPYMLPFHPVSYRIKISLRVLLYGDDDNGDDSNGDDRDIRDVCGGDDSGIGCVDGDDVVVVAVLVVTSNDYGVVVVSGDRGDVCDDCDDVDGDSNKCGISGSNFSGVSSGYDGGDVGGGDSDTSGWQQSVIIKFSLNIGKSTYETVTVNSWFMSGVNRNMVCSILDETLQAVGAKAMVVGHTPQTIGVNCKYNCSIWLKDCGMCSGVLNSRPEVPL

SEQ ID NO: 132933 - protein, 192 aa, Glycine max
  Coding DNA Sequence Number=SeqID_41248
  Homolog annotation: Hit_ID=Q00M75; Match level="QueryCoverage=17%, HitCoverage=5%, E-value=4e-10, Identity=93%"; Hit description=PPR -repeat containing protein
MSNQEFFLLTKDDDKEDLSNFEIVKRHTLTLSSSSNSQHSQKEEKKSNHQEIIEECQQQICRITKAHDSESSTSKLKEEDEEEDGFKTPTSLDHKIPLVPSQCPPAPRKTKPSLKRKTSYYNNHCNYCRHPLDLSKEVLERANPGAAVKLCLGDLLVMGSNPETASLHMQGFYNEGVGLNNGNTGNKYPKPN

SEQ ID NO: 132934 - protein, 92 aa, Glycine max
  Coding DNA Sequence Number=SeqID_41249
MAFHIYQRPYVLSVICIAMIFAAGVVTCFESPLLSCQERCIDDPTCDFICHKKGFVKGGSFTIFMLRKLSVNIINEATNYNLIRVGAASQPA

SEQ ID NO: 132935 - protein, 115 aa, Glycine max
  Coding DNA Sequence Number=SeqID_41250
MTIMILGTLYYKKAPQEATYGKFPASFKCNISQYEAFRTNKGYIIRVGDDKQGNVEHFFREVEEIGLVVYILNSTGNCEERLWNGEKKEWAVTWNSHQLHIHIMLILVLCLGVAI

SEQ ID NO: 132936 - protein, 268 aa, Glycine max
  Coding DNA Sequence Number=SeqID_41251
  Gene Ontology: Mol. function=ubiquitin-protein ligase activity; Cellular component=ubiquitin ligase complex; Biological process =protein ubiquitination
  Homolog annotation: Hit_ID=A7NZ27; Match level="QueryCoverage=78%, HitCoverage=41%, E-value=2e-44, Identity=40%"; Hit description =Chromosome chr6 scaffold_3, whole genome shotgun sequence
  Pfam annotation: Domain name=Arm; Domain location=159-199; Score =13.5; E_value=0.21; Accession=PF00514.14; Description=Armadillobeta -catenin-like repeat
  Pfam annotation: Domain name=Arm; Domain location=201-237; Score=6.6; E_value=1.6; Accession=PF00514.14; Description=Armadillobeta-catenin -like repeat
  Pfam annotation: Domain name=Arm; Domain location=95-136; Score=24.8; E_value=0.00032; Accession=PF00514.14; Description=Armadillobeta -catenin-like repeat
  Pfam annotation: Domain name=U-box; Domain location=31-95; Score= -8.2; E_value=0.004; Accession=PF04564.6; Description=U-box domain
  Pfam module annotation: Pfam domain module=Arm::Arm::Arm::U-box; Domain location=159-199::201-237::95-136::31-95
MESGNNIVSPTEDFSRHTHEPYAKLCPESLHIPYEFRCPISLVIMKDPVIICTGQTSDASSELIDPDILVSKLSSNDIEELQCAVGELRLLTKKNGQNRMLIAEAGAIPCLVDLLYALDTQTTCENAAATFFSLSGVDGNRIAIGKVDAAKALLNLCLSQGNKGQAITASIVPKLIEMLTEPDGDMRDEAFAVMAVVAAGHSDGQATIGSMNVVSTLVELVSNGPPRNKENATSVSLGVVNPLLDLAGNGSERAKRKASQLFELIGNH

SEQ ID NO: 132937 - protein, 93 aa, Glycine max
  Coding DNA Sequence Number=SeqID_41252
MLRPLGSSWKLRLFPCFRSYWARIFFSLLITAAVFKLERFTKKESMTTLKDFITKHNVPHDVPDESLEASSDDDDADDIPEKPQAKSKKTKLT

SEQ ID NO: 132938 - protein, 139 aa, Glycine max
  Coding DNA Sequence Number=SeqID_41253
  Gene Ontology: Cellular component=membrane
  Homolog annotation: Hit_ID=A7QBC8; Match level="QueryCoverage=89%, HitCoverage=69%, E-value=2e-26, Identity=49%"; Hit description =Chromosome chr4 scaffold_73, whole genome shotgun sequence
MVDVNSSRKFIPKPLALVSATYAYAIFNLVPAITFVLSILCGYENLNVRTAAGKAKVLGTILGINGSMLPSFFKGVKINIWNFHINLLHSHLGMQTPKTEWLQGTVTSGFVIIATTGCVRKRGPLYASVFNPLYLVLVA

SEQ ID NO: 132939 - protein, 95 aa, Glycine max
  Coding DNA Sequence Number=SeqID_41254
MENESSSHGSTLILGRPFLMTAKTKIDVHVGTFSIEFGDDVVHSNIYEAMRHLEKEHSIFLVDIIGRCNPTPQGYWIEDSKRLGLELLKKALGFS

SEQ ID NO: 132940 - protein, 73 aa, Glycine max
  Coding DNA Sequence Number=SeqID_41255
MSKHIWTYEITQSMLGAPYPLGIGDKYIVQPWYKFLQEGDFSHGDELSFYYRRDEKIWEVVIRRAIDWDDNDM

SEQ ID NO: 132941 - protein, 292 aa, Glycine max
  Coding DNA Sequence Number=SeqID_41256
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSDLRASTLIDPATPPVWTSKHTNTIKIDDDCKIIDLDQAYRYRRPRGGARDQLLVPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132942 - protein, 246 aa, Glycine max
  Coding DNA Sequence Number=SeqID_41257
  Subcellular localization annotation: CTP_CleavageSite=16; ConfidenceScore=5.06e-01
MASASLKFEPALQASRASSVAVPAGAMAGGAAWVAELAARAVMTTANAVFLVLIAGPSIGCATKAQRPCRAAAPCHQLLAAFTASAASTMPGPQPPGQFAAAIGRAVDSEDVLDLVWLWARVALLHQRDRDVGAAIEVPEESKDVVCPGFEAYALSAGLLAVAQGHALRRDLASAAGITFVIVTGNHRLFGVGVFVDRGHRPGLGEALRIDTVQVDEDALLALGDVHIGMGDGIAEQGDWRGFRLE

SEQ ID NO: 132943 - protein, 264 aa, Glycine max
  Coding DNA Sequence Number=SeqID_41258
  Homolog annotation: Hit_ID=A0TM48; Match level="QueryCoverage=55%, HitCoverage=67%, E-value=9e-13, Identity=35%"; Hit description =Putative uncharacterized protein
  Subcellular localization annotation: CTP_CleavageSite=57; ConfidenceScore=5.13e-01
MAMTEPRMASPKGSWNHMAKLAQIAKTRVNRMKTNLPAMRTGADFRREDICIPYSSVAAAGNYSVCGNRGDTDMICIVMSWGLAVAGVRTHQTPQQQRADDPGIDDRFGRPAFHRHDEMDRAARDCQIDQLVQAVPAPPELADRPVVGGKRQRHQQNKADHADGDEGPPHDIGDDGGNIQALIQQHVGGEVHQRIIEGEETERPAVAQQRNAGQVADRRDHEGENEEAQRPQAERVFKGLDRIGAEIAACAQIESPDSRDETDR

SEQ ID NO: 132944 - protein, 91 aa, Glycine max
  Coding DNA Sequence Number=SeqID_41259
  Subcellular localization annotation: CTP_CleavageSite=48; ConfidenceScore=5.66e-01
MLSAVIRSALGYPAFTVGTITGTPELRPPFTGASVVGSPVISRPGLVTATPFVRRHPFSRSYGAILPTFLRESCLAPLGILYLPTCVGFGY

SEQ ID NO: 132945 - protein, 263 aa, Glycine max
  Coding DNA Sequence Number=SeqID_41260
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDAADLHPARQLDQGRKRVDAGQVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132946 - protein, 230 aa, Glycine max
  Coding DNA Sequence Number=SeqID_41261
  Subcellular localization annotation: CTP_CleavageSite=41; ConfidenceScore=5.70e-01
MAEPPKKRKGSSSTTTAAAHRRHGPSGGRTTPIPPSLSSPRSSTLFSSDDQRLRYLSQFSSRIILDPKYLDVEFFNDETFDCYQVFQNSGLVDFMSLKLSYYPELVKVFYCNLKIQDGIIMSEVHGTSMVIDQSLFFSLTHLPSQGAPFEGTIVDDWKFDYSSHNARRMVCNDQAEMTVTSFGYRKDRNGQWLKKDALPPQDERTPSPPPQREDSALMNEVLSELWGLRS

SEQ ID NO: 132947 - protein, 93 aa, Glycine max
  Coding DNA Sequence Number=SeqID_41262
  Homolog annotation: Hit_ID=A0ST23; Match level="QueryCoverage=29%, HitCoverage=55%, E-value=2e-08, Identity=100%"; Hit description =Putative reverse transcriptase
MAATLTLLKLPILPNKPLLPRPSTSKIKLIDTVDLEGGPVGKPVVPAALMNRPTRGERRFAYWALAECILAYYVGTDEGVSEVLHVAGEKRLH

SEQ ID NO: 132948 - protein, 282 aa, Glycine max
  Coding DNA Sequence Number=SeqID_41263
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132949 - protein, 116 aa, Glycine max
  Coding DNA Sequence Number=SeqID_41264
  Homolog annotation: Hit_ID=B0FXD9; Match level="QueryCoverage=25%, HitCoverage=6%, E-value=4e-09, Identity=96%"; Hit description=AprX
  Pfam annotation: Domain name=HemolysinCabind; Domain location=70-87; Score=22.8; E_value=0.0013; Accession=PF00353.10; Description =Hemolysin-type calcium-binding repeat
MVKVGTSYVPINVSFSPKVGPGLPGINRDTRIYLFCEVIFRHRANWSSTAVAAALELVDPPGCRNSILIYGAGGADQLWGGAGNDTFVFGASSDSKIKLIDTVDLEGGPGTSFCSL

SEQ ID NO: 132950 - protein, 78 aa, Glycine max
  Coding DNA Sequence Number=SeqID_41265
MTEHSIAVSPMCMSCKVFCVVSISKQMLKPWNDGIDVSSIGACRPRIFFINGFLCFLEDEWQWNGEGRERGDETSRRR

SEQ ID NO: 132951 - protein, 179 aa, Glycine max
  Coding DNA Sequence Number=SeqID_41266
MSKHLIRHPSKHNVINIYLCNHQVFSILFDKESLVNFSLPIPLLSKELCQPFIPSSWSLLQSIESLLEPVYMIWMSWVYKSPWLLHIDFFIQVSIQKCALHIHLVQLEFEDASYTNLIKVYTFNLSVALSNQSGLVSGYDTFFIGFVLEDPLGAITLVPSGLGTSSQTSFLLNAPILLA

SEQ ID NO: 132952 - protein, 91 aa, Glycine max
  Coding DNA Sequence Number=SeqID_41267
MEGGNPGFSLKACNELQNKERGNIGSKGQSKELIQGRLIWLEAYKNKMPKSSPNMHMKQEVSTRVKPRLLCKQSMEQNTPNKIDDDGSNSH

SEQ ID NO: 132953 - protein, 237 aa, Glycine max
  Coding DNA Sequence Number=SeqID_41268
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLETMYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132954 - protein, 172 aa, Glycine max
  Coding DNA Sequence Number=SeqID_41269
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=55%, HitCoverage=10%, E-value=1e-08, Identity=35%"; Hit description =Gag/pol polyprotein, 3'-partial, putative
  Pfam annotation: Domain name=G-patch; Domain location=38-82; Score =34.2; E_value=4.6e-07; Accession=PF01585.14; Description=G-patch domain
MPYVEAAEESLETAFQSFEVVSIASVDSFSGQPCLSDTAVMVARVMLGNGYEPGMGLGKDNDGRTSMISARGNRVKFGLGYKPTQMDIRKSVAGRKSGSQGSRLGQEVKGGPPYHISRSFISTGLGHEGQVVAICEDDSPSGSDLVRPCPPGFRLGNWRVEERPNIYATSIM

SEQ ID NO: 132955 - protein, 161 aa, Glycine max
  Coding DNA Sequence Number=SeqID_41270
MVPRKLASKRSRKDKAAEGTSSAPEYDSHRFRSAVHQQHFEAIKGWDDEYTDFQEEIGRRRWTSLVTPMAKFDPEIVLEFYANAWIPLMPMLSASSWDIRWCWKRARSASMARGGTGLTGSMRRPSPSCYVLPGQDFARTAAGEASANYAHQHDHPDSDMG

SEQ ID NO: 132956 - protein, 297 aa, Glycine max
  Coding DNA Sequence Number=SeqID_41271
  Homolog annotation: Hit_ID=Q652R5; Match level="QueryCoverage=54%, HitCoverage=84%, E-value=6e-17, Identity=36%"; Hit description =Putative uncharacterized protein P0603C10.50
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNTRLADSARGATGSGHDGALTLSGAPSRGLGPGPPLRTLLQTTIRTPRATDFHGGLFPVSLGAVRARKGSSMGPELTGSHVIGLEPYTPAQQHCYMFALGKRCVTPRQACPRPNGFGRKLAFKDSMVHGILQFTP

SEQ ID NO: 132957 - protein, 83 aa, Glycine max
  Coding DNA Sequence Number=SeqID_41272
  Homolog annotation: Hit_ID=A5AZ88; Match level="QueryCoverage=79%, HitCoverage=6%, E-value=8e-08, Identity=46%"; Hit description =Putative uncharacterized protein
FPDESLSEALERFKGLLRRTPTHGFFKPIQLNMFIDGLRPQTKQLLDASAGGKIKLKTLEEATELIVIMPFYETEPTNPRRKA

SEQ ID NO: 132958 - protein, 68 aa, Glycine max
  Coding DNA Sequence Number=SeqID_41273
  Subcellular localization annotation: CTP_CleavageSite=55; ConfidenceScore=5.33e-01
KWLRKSFPQSDLGGMPRLKGPVPLSSLIAIVSGAPSISSISRPSKDGRSTERDASSSGTMSTPTFRKR

SEQ ID NO: 132959 - protein, 105 aa, Glycine max
  Coding DNA Sequence Number=SeqID_41274
MSFLILNTFKVPLSNEPFVQIKHSFAIEADVATSFGYKKDLDGQWVRKQDHQANVPYERFPSPPPRDPSSALLNNVLNEIRDLRAFVGKRFDSMDSCITHLEDDM

SEQ ID NO: 132960 - protein, 289 aa, Glycine max
  Coding DNA Sequence Number=SeqID_41275
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPNDELVWGKFEDKFWPREVLIVKRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 132961 - protein, 267 aa, Glycine max
  Coding DNA Sequence Number=SeqID_41276
  Gene Ontology: Mol. function=motor activity; Cellular component=cell projection
  Homolog annotation: Hit_ID=UPI00016621D1; Match level="QueryCoverage =97%, HitCoverage=41%, E-value=4e-20, Identity=32%"; Hit description =UPI00016621D1 related cluster
GLHILAFRGLHVLAFRGLHALAIRGLRVLAFRGLRALASVGLHALTFRGLRVLAFRVLHTLNIRGLHVLTFRGLHVVAFRVLYVLTFGGLHALAVRGLHVLAFRGLHVLTFEGLHVLTFRGLHALAFRGLHVLAFGGQHFLAFRGWHALAFRGLHVLAFRGLHILTLGGIHVVAFRGLHILTFGGLHALAVRGLHVLAFRGLHVLTFRGLHGLAFSGLHVLAFRALHVLTFRGLHVLAFRGQHVLVFGGQHFLAFRGPHALAFRGLH

SEQ ID NO: 132962 - protein, 131 aa, Glycine max
  Coding DNA Sequence Number=SeqID_41277
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MAPRKLVSKRSRKDKAAEGTSSAPEYDSHCFRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 132963 - protein, 99 aa, Glycine max
  Coding DNA Sequence Number=SeqID_41278
  Gene Ontology: Mol. function=aspartic-type endopeptidase activity; Biological process=DNA integration
  Homolog annotation: Hit_ID=A7PVN8; Match level="QueryCoverage=97%, HitCoverage=20%, E-value=2e-36, Identity=74%"; Hit description =Chromosome chr9 scaffold_33, whole genome shotgun sequence
  Pfam annotation: Domain name=zf-CCHC; Domain location=68-85; Score =17.8; E_value=0.0031; Accession=PF00098.14; Description=Zinc knuckle
MTCDLHEMLNLLIDYENQISSEKKKGTVMVVGKSSREKGKVPKLKHLGPKGGMAQPKNKMNKIDQTDAECFFCKEKGHWKRNCKYLDSLKNKKQGTTDN

SEQ ID NO: 132964 - protein, 147 aa, Glycine max
  Coding DNA Sequence Number=SeqID_41279
MRGAPLEEELAPIIARGFNNTNVEALQKVRKAWEMVQKKDKELRGSNNGPIGGYRKWLKAHMQGLDWLLSLRTTKGVEVEAPEEDKEVQALRAELEQAQTVKERFKSTSLKIRKQNAELRDVNIATTKALEQATKRARREEHGRNKF

SEQ ID NO: 132965 - protein, 158 aa, Glycine max
  Coding DNA Sequence Number=SeqID_41280
  Pfam annotation: Domain name=Transposase_23; Domain location=31-101; Score=3.9; E_value=0.00044; Accession=PF03017.5; Description =TNP1ENSPM transposase
PPEPLVGPGSSGPRVSTKGSCVDPSGNDPEKGDSDRCGLYIEADPAHLVAMGRVYEGFTVVHNTPLLPGQVKVSVEEVTDADAPVPVPTDEVSLVGQALHIFLAWPTHLVKSLSQQVLIVLTISVSPAKPPPKPDPKVDDSLYLMTLTIPELFLRPYQ

SEQ ID NO: 132966 - protein, 154 aa, Glycine max
  Coding DNA Sequence Number=SeqID_41281
MLLRGVYADLPRAPASWLVEIWVHGRLRRDKMVDEPRSRPITCEPVSSGPIDDPLRARTLPTRPQSGERPQWRTGPSPLEGAPERVRAPSCPDLSHHEALSASRVVWECSPNRAGSGWGPAMCPGRMWNGESRSADRLGTLTDADCDGGPSPGC

SEQ ID NO: 132967 - protein, 165 aa, Glycine max
  Coding DNA Sequence Number=SeqID_41282
MLLIVRRKKEVDSDECNIGECGLDDLDFKSALRELHIDGEHGSSSGRRMNKFRGLDAILMQANFVIGKSTVENEVRNSFKIKTFKHNHNCCREVNSTNKQIDSGWSVNLRANSECSQPLNVLKLWNISSKSLECTLKLQRCGELERSKATSGDREWDRGNNDATK

SEQ ID NO: 132968 - protein, 53 aa, Glycine max
  Coding DNA Sequence Number=SeqID_41283
MNRPTLGERRFAYWALAECILAYYVGTDEGEKKGCTGASAEYVIQDIFRFLAH

SEQ ID NO: 132969 - protein, 80 aa, Glycine max
  Coding DNA Sequence Number=SeqID_41284
VEPSSCFYEKVHQVKLKYGSNHLAKIGAKDGSLLRLLLSQRALHGRARARLTGALYKGGKMRGVATNVYLWKTLGKPKET

SEQ ID NO: 132970 - protein, 136 aa, Glycine max
  Coding DNA Sequence Number=SeqID_41285
MDDEEGMQEQMKADLSALKDQMASISEVMLKLQKTIEDKATATASSTVREAEPVLQPALNPGLDRNMAVFGRRYSPQAYPYGLPPNFTPRATPEDLSQAPTFEGQLPPYEDYPGQDDGERRYPSWPPAPPQRSVPT

SEQ ID NO: 132971 - protein, 232 aa, Glycine max
  Coding DNA Sequence Number=SeqID_41286
  Gene Ontology: Mol. function=chloramphenicol O-acetyltransferase activity; Biological process=response to antibiotic
  Homolog annotation: Hit_ID=P62577; Match level="QueryCoverage=78%, HitCoverage=83%, E-value=1e-106, Identity=98%"; Hit description =Chloramphenicol acetyltransferase
  Pfam annotation: Domain name=CAT; Domain location=6-182; Score=390.0; E_value=3.8e-114; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGEQGADAAGDSVVLLHVFPGWTQDDSYRIRRSGRTERGVRAYSPAWSELPTRN

SEQ ID NO: 132972 - protein, 98 aa, Glycine max
  Coding DNA Sequence Number=SeqID_41287
MMTFKNEFKNEFKIESRTLQGSRGKNQESRFKIQDSRIIKIKIQDSKIQESREDLIKISIKKFFKQLSSTRSFHKIITKEFYSLIIDYQIIVIDYQWF

SEQ ID NO: 132973 - protein, 279 aa, Glycine max
  Coding DNA Sequence Number=SeqID_41288
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGFACYEGKQVLSQKFPRTYLEATAHLNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 132974 - protein, 163 aa, Glycine max
  Coding DNA Sequence Number=SeqID_41289
  Homolog annotation: Hit_ID=Q2HW90; Match level="QueryCoverage=89%, HitCoverage=30%, E-value=2e-10, Identity=25%"; Hit description =Putative uncharacterized protein
MGSNQVPSFKKGFYHVKVKSLELASLRKLRPRMDQVQCQAFHKAYGKIWDLAMIEVSVEAIASLTQYYNQSLRCFTFGDFQLVPTIEEFEGILGCPLGRRQQYLFSGFYPSMARVAKMVKISTQELDRVKQNRNRVVGIRRRAWRKGSKLWQIKESELHSLIY

SEQ ID NO: 132975 - protein, 185 aa, Glycine max
  Coding DNA Sequence Number=SeqID_41290
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MKHFTDTLISANIGQPQQWVNPFLQQEERQQTVAQSHQQVLLASLGASKRSHPLYLQKVDKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 132976 - protein, 242 aa, Glycine max
  Coding DNA Sequence Number=SeqID_41291
  Gene Ontology: Mol. function=motor activity; Cellular component=cell projection
  Homolog annotation: Hit_ID=UPI00016621D1; Match level="QueryCoverage =92%, HitCoverage=40%, E-value=2e-19, Identity=33%"; Hit description =UPI00016621D1 related cluster
RTTRPPLQRTTCRRLRELHILAFIGLHALTFSGLDVLAFRGLHALTFRGLHALAFRGLHVLTFRGLHALAFRGLHVLAIKGLQALTFRGLHILTFRGLHGLHVIVVRGLHVLAFRGLHTLAFRGLHTLTFRGLHVLAIRGLHALTFKGLHVLIFRGLHALTFRGLHVLAIRGLHALTFRGLHVLTFRGLHVLAIRGLHALTFRGLHVLTFRGLHVLAFRGLRVLIFSGLYCHTLREFKVLCP

SEQ ID NO: 132977 - protein, 149 aa, Glycine max
  Coding DNA Sequence Number=SeqID_41292
  Gene Ontology: Mol. function=endonuclease activity
  Homolog annotation: Hit_ID=Q9AY32; Match level="QueryCoverage=42%, HitCoverage=95%, E-value=7e-27, Identity=96%"; Hit description=RRNA intron-encoded homing endonuclease
MVVTVKKLVVGPWVGSIGPPPVCTGRLVPSAGDALLSLTGRVVPPHGITPQDSDPIVLAFGIGVMINRDSRGHSYFIVRERKLGARRRSDTVLVSTINDADQGSADVAFRTPLAPYEKSKSLGSGGSMVARLKLKGIDGRAPPGVEPAA

SEQ ID NO: 132978 - protein, 144 aa, Glycine max
  Coding DNA Sequence Number=SeqID_41293
  Homolog annotation: Hit_ID=A6H5B3; Match level="QueryCoverage=43%, HitCoverage=78%, E-value=4e-25, Identity=87%"; Hit description =Putative ribosomal protein S3
KESKSDSRSSGERNGSSLNRENGVVGELYKCRAARRSSRECCTLDGESPVAESITSLRSDPSSMGHVESRVNQQGPPCKAKYSWVTDRKPPGAVAKASLHRAIVTAYGPEPGGSIHDQDEAWVKLSGRSEPTDVEESADEVVVR

SEQ ID NO: 132979 - protein, 191 aa, Glycine max
  Coding DNA Sequence Number=SeqID_41294
  Subcellular localization annotation: CTP_CleavageSite=59; ConfidenceScore=5.64e-01
APLSFKRIRGMSSPGGILNALATALHGSIRTAPSIPSFTARTTGVSNPIRSPSFRLSVSVSAQQSAFAVGVLSDLYAFHRSTGNSLCPYHALRPIIPDNACILCLTAAAGTELADAYSPDTVIASSPGKEVHDPPSVADHPLGPAIDHRLGKLLPHQLANQTRAPPRADSSFCSSAYGVLAAVSSCCSPPK

SEQ ID NO: 132980 - protein, 210 aa, Glycine max
  Coding DNA Sequence Number=SeqID_41295
  Homolog annotation: Hit_ID=UPI00016621D1; Match level="QueryCoverage =88%, HitCoverage=41%, E-value=6e-13, Identity=30%"; Hit description =UPI00016621D1 related cluster
MIDPLNESISCFLIKVDPWVLVPITFRGLHVLASKGLYAFSIRGLHIFTFRGLYVLPLRGLHVLAFEGLHALTFRGLYVLPLRGLHVLAFGGLHALIFRGLNVLPFRGLHALAFRGLRVLTFKGLYAFAIRGLHGLTFKGLHVLTFRGLHCLTFRGLHVLTFRGLHALAFKGRHILNFRGLHALAFKGLCVITFDGLHIHILREFKVLCP

SEQ ID NO: 132981 - protein, 147 aa, Glycine max
  Coding DNA Sequence Number=SeqID_41296
MVKVGTSYVPINVSFSPKVGPGLPGINRDTRSLFMIWWDECFERQQSISTSSLSQYPVPPVQLLKWCYPLTIPHKHTSRNISASVAWGCAAFAIQGNLRQLLNEATPGMRRAFAITPAGAKGRMCIRLTMLGRIAELATVGDAARSR

SEQ ID NO: 132982 - protein, 116 aa, Glycine max
  Coding DNA Sequence Number=SeqID_41297
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=100%, HitCoverage=26%, E-value=1e-51, Identity=76%"; Hit description =NAD(P)H-quinone oxidoreductase chain 2, chloroplast (EC 1.6.5.-) (NAD(P)H dehydrogenase, chain 2)
MAITEFLLFILTATLGGMFLCGANDLITIFVALECFSLCSYLLSGYTKKDVRSNEATTKYLLMGGASSSILVHGFSWLYGSSGGEIELQEIELVQASPAPSHQWTPDVYEGVRFVR

SEQ ID NO: 132983 - protein, 147 aa, Glycine max
  Coding DNA Sequence Number=SeqID_41298
MVGKDLGSTDDPMMCKFKTSTPSRHMVCLPNYTPPNVVYIPNEDVNNSTPILIKSQQPQSDHAHVSRPMEETHEIPHHDLANFEPCLGYATEGQAVGGIPFENTLEGPQFRPQPQPLHFAVGRAPPAMAEKGKADHLKERLRAIERR

SEQ ID NO: 132984 - protein, 187 aa, Glycine max
  Coding DNA Sequence Number=SeqID_41299
MSPNVVGEEEADNIHANRNDHDEGELINIVQRNFLIMQMATPPSSPPPPPPTGAASYLSSTLKQTRKATHLRSLATRPVGAETPLVHVDPATGKADGPYRKKLRIYLGIITRDKVDVTYENWKQVPAAQKDLIWEDIQWRQFKSNLTSKWALAADKDSVDDTICEKYDISKEKWAQFCQTRRDPSWE

SEQ ID NO: 132985 - protein, 142 aa, Glycine max
  Coding DNA Sequence Number=SeqID_41300
  Homolog annotation: Hit_ID=A5AS07; Match level="QueryCoverage=46%, HitCoverage=8%, E-value=4e-09, Identity=37%"; Hit description =Putative uncharacterized protein
MDPIKYIFEKSALTGWIAQWPVLLSDFNVKLLKVYEDSTLVIHQLRGEWETRDHKLIPYKAYIKELAASMFQLTPHGDLPYIEFRCRGRLAQYCLVEEERDGSSSSMDSFASWKMNGSGMEKEEREETPLQGEDESRRSSPP

SEQ ID NO: 132986 - protein, 158 aa, Glycine max
  Coding DNA Sequence Number=SeqID_41301
  Gene Ontology: Biological process=transposition, DNA-mediated
  Homolog annotation: Hit_ID=Q1J7G7; Match level="QueryCoverage=25%, HitCoverage=71%, E-value=2e-12, Identity=74%"; Hit description =Transposase
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDQAGFDIPEASDLRMKKKIL

SEQ ID NO: 132987 - protein, 344 aa, Glycine max
  Coding DNA Sequence Number=SeqID_41302
IHTRGLDWLTKLKVIDEENFEAPEEDEEVRALKLELGKARLAKEKFKLAATHIRKECAELQEENAATAKALEQETKRARKEEYGREKFRGALWGSNNELKLRREERDRSKRSLAQHLEATEQSMLAIIGQYKEELNQSMAHEQKLVEDFAEVYAEKEARGRVIDALHQEATMWMDRFALTLNGSQDLPRLSAKAKAMAEVCTAPEEIHGNFIITKKTPRHPYHTRSRKMDNEEGVQEQMKADLSALKDQMASISEVMLKLQKTIEDKATATASSTVREAEPVLQPALNPSLDRNTAMFGRRYSPKAYPYGLPLDLTPRATPEDLSQAPTFEGQLPPYEDYPGQD

SEQ ID NO: 132988 - protein, 83 aa, Glycine max
  Coding DNA Sequence Number=SeqID_41303
IQVGSVRATAKVTEWTTGRHPGPEHVVKEAHWACFDRVSGAQLNVDIMNARCRIPGRETRATTPYVPIASASRAPAPSSAGEA

SEQ ID NO: 132989 - protein, 230 aa, Glycine max
  Coding DNA Sequence Number=SeqID_41304
  Homolog annotation: Hit_ID=Q6WAY4; Match level="QueryCoverage=43%, HitCoverage=18%, E-value=2e-10, Identity=34%"; Hit description =Putative uncharacterized protein
KEGVLFSCGDYPNIPLKGTRGCINYNPALAIRQLGYPMREAPMEESLSPFLVRDFGVQSFKIVQRVHKAWENPLRKDKELRGIRNGIIGGYHEWLKVHTQGLDWLSKFKIINEENFEAPEEDEECAELREENAATARALEQETKRARKEEHGRDKFRGALWGRNMELKLRREERDQSRVYSMVLKEELVACSRSKREFGPTLRSHGAKHASYNRAVQRGVKPVFWLMSKS

SEQ ID NO: 132990 - protein, 130 aa, Glycine max
  Coding DNA Sequence Number=SeqID_41305
MAIQADEGRAEEKVEGYKQQLAAESALEPVFDFVELEEVVEDEDDQQEKETPIKDSQEKNEKEKEKVDEEKKKSKSEVSREKKREITSAEGKEVPYPLVPSKKDKEQHLARFLDIFKKLEITLPFGETLQ

SEQ ID NO: 132991 - protein, 99 aa, Glycine max
  Coding DNA Sequence Number=SeqID_41306
MEIALGGVVEGGTMKFSIGACRPRIFFINGFLCFLEDEWHWNGEGRERRCHYKEKMSLEEAHHHRRPWIRAWKKIEMNEGRGREEYKILCSKRALKSEV

SEQ ID NO: 132992 - protein, 174 aa, Glycine max
  Coding DNA Sequence Number=SeqID_41307
MIMRGQDIYSSQDEASTSPSSSESEEAKGEESSEEIYPQEDGQPLVVKEKCKDVSVSFKRLAMKETHFTIKTNIEETFPHRQPPHFLFCKKTLVSTATPRGLEVIPQVKELLDEGLVRKSLNPCALLVPKIGIIRHQIPTISDTMNVLSVATLFYKLSHAPNVFMIDAHRDSLG

SEQ ID NO: 132993 - protein, 210 aa, Glycine max
  Coding DNA Sequence Number=SeqID_41308
  Homolog annotation: Hit_ID=Q6WAY6; Match level="QueryCoverage=33%, HitCoverage=12%, E-value=6e-11, Identity=44%"; Hit description =Putative uncharacterized protein
MSSRGKKTISFLRVSPLLSRIATVVKDLARGLDRIKQTRNGIAGLPQKYLEDKARGMANQRRLGPVYGCVSFANFRGRPLSKRGWFGVKRVAHGSSVAYPPSVFGWFPPLFQQDTRHPCPLLSHRSCTEKRRIDWDQLLAGIGGRTISWFPRWKEGKEGVLFSCGRYPNIPLVGTRGCINYNPALAIRQLGYPMRGAPTEESMSPFRGIL

SEQ ID NO: 132994 - protein, 123 aa, Glycine max
  Coding DNA Sequence Number=SeqID_41309
GPLVLVPITFRGLYVLAIRGLHILAYRELHALAFRGLRVLIFIPGPPLDIGGQPTVRAHPERETITHLLCILGQDFTRAVAKRRVRIMRTNMTTLTNRAHKTPSGPEEVQQGPGVSSSGYGPL

SEQ ID NO: 132995 - protein, 138 aa, Glycine max
  Coding DNA Sequence Number=SeqID_41310
METCLEVKELLQRMIDQGRLEVGIEEKKEQHICMQSTEGSGVAKPKPLVIYFTKNAASQKPGHPLIAKPVPFPYQNSHAVPWRYTPPGKKEEEVTDVSSLSAKWSCVRTSGPTSPIRRRQGKRKSGGGTRGRSTPRFE

SEQ ID NO: 132996 - protein, 56 aa, Glycine max
  Coding DNA Sequence Number=SeqID_41311
LAFVDHPTFAIMTQESGSRQRHLLVIRTSSFGDPEFDWQAEANVVICALSGDVSIS

SEQ ID NO: 132997 - protein, 130 aa, Glycine max
  Coding DNA Sequence Number=SeqID_41312
MMVDTLLVFYYEKLVGYIPSSFADLVFAGKRIEVGLKRGKFDYVSSTNANAKRIGATGAKRKEGDAHAISSTPAWVKPQQTPHGTHQYAQHHPSFSAHTGNASSSTPVQPKAPTQREAPQVPTPNTTRPA

SEQ ID NO: 132998 - protein, 61 aa, Glycine max
  Coding DNA Sequence Number=SeqID_41313
MVKVGTSYVPINVSFSPKVGPGLPGINRDTRIWDLAILSNGTISSVTGSAATNPPHTPPEA

SEQ ID NO: 132999 - protein, 156 aa, Glycine max
  Coding DNA Sequence Number=SeqID_41314
  Gene Ontology: Mol. function=nucleic acid binding
  Homolog annotation: Hit_ID=Q2A9Z4; Match level="QueryCoverage=88%, HitCoverage=26%, E-value=2e-12, Identity=33%"; Hit description=Zinc knuckle family protein
MYLVCFLSKKITGHDIKKLDHASLRLISKLQKDNLDNLGKFASKCDNGIFLWYSETLKTYRVYESRTLIVEEVIHVKFNNTNADKELLEADESFAYLRLDDGIKNFVSSSYNTKIAASNPPLDSPQEEIREPTGHNMRKNHPESQIIGDLTKQIPN

SEQ ID NO: 133000 - protein, 224 aa, Glycine max
  Coding DNA Sequence Number=SeqID_41315
  Gene Ontology: Mol. function=phosphoprotein phosphatase activity
  Homolog annotation: Hit_ID=A2Q4S5; Match level="QueryCoverage=72%, HitCoverage=26%, E-value=2e-18, Identity=34%"; Hit description=IMP dehydrogenase/GMP reductase, putative
  Pfam annotation: Domain name=DUF1723; Domain location=111-160; Score =57.7; E_value=3.9e-14; Accession=PF08330.1; Description=Protein of unknown function (DUF1723)
MTENVPHMTEDVPHMAEDAPKMTADVQADDGAEGSHADDAEGFPSGPCDPSVLTSFADHVAHAIWSEHERPELKLVLHRRKVTLIGRPVPEIEGLVAATGLSPLIGCSVVIDDPRLISAFVERWHRETNTFHLPVGELTITLDDVSSLLHLLISGAFHSFHALSVDEAIFFLTELLEVSAEEARAETTRSRGAYVRLGWVRDIYEIRCQARRWIVAARAYLLHL

SEQ ID NO: 133001 - protein, 132 aa, Glycine max
  Coding DNA Sequence Number=SeqID_41316
MVKVGTYYVPMNSHFAKSWPSASRDLPSQELQWLLLLSAVPLVQLLTGWCVTAKAPPDISAGKCSGHDARNHHTRRAYCAATGRVPFAIRAAQLLGRAIGAGVFAITPAGERGMCCKAIKLGNARVFPVKTL

SEQ ID NO: 133002 - protein, 57 aa, Glycine max
  Coding DNA Sequence Number=SeqID_41317
MAKEFEEILGCPLGGRRPYLFSATRPTWAFQKIPPEGCCFWRKQPGSPGRAELAWAS

SEQ ID NO: 133003 - protein, 50 aa, Glycine max
  Coding DNA Sequence Number=SeqID_41318
MVIPKFKVPDFDKYKGNTCPENHLKIPGGTPNDEKGDDNNDSKHINSVLL

SEQ ID NO: 133004 - protein, 307 aa, Glycine max
  Coding DNA Sequence Number=SeqID_41319
  Homolog annotation: Hit_ID=Q6WAY4; Match level="QueryCoverage=53%, HitCoverage=30%, E-value=5e-20, Identity=36%"; Hit description =Putative uncharacterized protein
LKELGRLMGPLQRQAFRKVYGKILDLTTAEVFTEAIVSLAQYYDQPLRCFTFGDFQIVPTIEEFEEILGCPLGGRKPYLFSGFLPSLSKIAAVVGDSARELDRMKQTRNDVVGLPQKYLEGKARDMATQEEWVPFADILALLIFGVVLFPKVDGLVDLAAIDAFLAYHHSKESLVVAILADLFDTFDRSPETPQKSKGSRLARSVKFRNVAEIEKRCFCAIRGTNSNLAHLGPPEDSSRRLLLLQEATLLAWASWTACFSPILLQIGGEVKKKGPRHFRNVSVSNYVKILDRSSRFIVRSSFSSVFN

SEQ ID NO: 133005 - protein, 74 aa, Glycine max
  Coding DNA Sequence Number=SeqID_41320
WLLFLSAVPPCSATDGVVRNGKSTRRDISAGKCSGHAAAAIGAGLFAITPAGERGMCCKAIKLGNARVFPVTTL

SEQ ID NO: 133006 - protein, 138 aa, Glycine max
  Coding DNA Sequence Number=SeqID_41321
  Homolog annotation: Hit_ID=Q6UUU1; Match level="QueryCoverage=43%, HitCoverage=40%, E-value=1e-18, Identity=78%"; Hit description =Putative uncharacterized protein
LPLFNFERLDELCPRIGHLCEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133007 - protein, 151 aa, Glycine max
  Coding DNA Sequence Number=SeqID_41322
  Homolog annotation: Hit_ID=A0PAV3; Match level="QueryCoverage=25%, HitCoverage=17%, E-value=5e-07, Identity=76%"; Hit description =Restriction endonuclease
MVKVGTSYVPINVSFSPKVGPGLPGINRDTRIYLFCEVIFRHSGFCFYQLSLPVQLLTGVVRNGKKHRRTSALASVAVPLRVTTTPAALNAPLQGASHSPFRLRNCWEGRSVRASSLLRQLAKGGCAARRLSWVTPGFSQSRRCKTTASEL

SEQ ID NO: 133008 - protein, 170 aa, Glycine max
  Coding DNA Sequence Number=SeqID_41323
PGQHPGVPGRAGQHHLADRGGGRGDVHRARRAVRKLYPPDHHPLYPADGGRGGTAGINAGGQRAGRDCHHRYHPAHRDREEKRHHDDRLRPGRRARAGHVAARCDFPGLPAAFSPHPDDHAGRPAGRAAADAQHGRRRGAAPSAGYRHGRRSAGEPGADAVHHAGDLPAV

SEQ ID NO: 133009 - protein, 222 aa, Glycine max
  Coding DNA Sequence Number=SeqID_41324
MAQRRNQVDGFDEEAIAQLLCIPGQDFARTAAGRRVQIMRTNMTTLTQIWMTLLLSNIQPSDHNSDLPLPKCQLVYAVLTRMSIHVAQLIADAIYLFAGMAPTRHPLDPDKSNRALGFPALITGLCQSFGVPVAPSKATNHRAHVQTHDCLYQLSLSLQSQGFTSFPCPTLDQFRAEVAWPGDWPEAQAGEAPAEAPGEADEAREDEEMTDLLDFLGGSGAT

SEQ ID NO: 133010 - protein, 167 aa, Glycine max
  Coding DNA Sequence Number=SeqID_41325
  Gene Ontology: Mol. function=RNA-directed DNA polymerase activity; Biological process=RNA-dependent DNA replication
  Homolog annotation: Hit_ID=A5BBZ6; Match level="QueryCoverage=50%, HitCoverage=7%, E-value=3e-10, Identity=41%"; Hit description =Putative uncharacterized protein
KHPFLSYLHTCHSSCIESESEFEFDPGSDFYAESKFEFESGSDFLGVVSLDAEELSYFSPTLVPPTVQPPPTPVLKLLLVNLKYAYLEDKKKFPVIISTSLAVEQEEKLLLDTFRGWSYASEAATEATQPHHSRCGEKGGLTVIKNERDELIPTRVQISWRVCIDYM

SEQ ID NO: 133011 - protein, 212 aa, Glycine max
  Coding DNA Sequence Number=SeqID_41326
MERSMIDAASGGALGNMTPAEARNLIEKMASNSQQFSARNDAIVIRGVHEVATNSAASSETKKLEGKLDALVNLVTQLALNQKSVPVARVCVCATLLTTIQTFALPCSNLERLSSLKLMLQIFTIDLLNLSSKINHSRTIMTSPAIDTTLDGGITLTSDGPALSNNNSSLLLPSKMLLAQADHTFLHQSNNNNNPRNNQQLRPLHNLPSKNL

SEQ ID NO: 133012 - protein, 88 aa, Glycine max
  Coding DNA Sequence Number=SeqID_41327
MIRGDTLRLFAPFCHPKAAGPMTSRDQVWSFCTLVSSRGGGPDDTRKYPSGYPYNILLLSAICEILGATSHGHPRLSLTERNEISVIH

SEQ ID NO: 133013 - protein, 119 aa, Glycine max
  Coding DNA Sequence Number=SeqID_41328
MELIENMATSDHTILQNRAYAPTKKNLLELTSQDAILAQNKLLAKQLETLPETLSKLPQQLHAVHPSPPPIMHIGGCNICGGAHELGLFMAQKDASKEVNYMANQNHQGFHQEGLLGCH

SEQ ID NO: 133014 - protein, 113 aa, Glycine max
  Coding DNA Sequence Number=SeqID_41329
  Homolog annotation: Hit_ID=A5C9B4; Match level="QueryCoverage=95%, HitCoverage=56%, E-value=6e-50, Identity=85%"; Hit description =Putative uncharacterized protein
  Pfam annotation: Domain name=PPR; Domain location=25-59; Score=15.4; E_value=0.12; Accession=PF01535.11; Description=PPR repeat
  Pfam annotation: Domain name=PPR; Domain location=60-94; Score=21.4; E_value=0.0034; Accession=PF01535.11; Description=PPR repeat
  Pfam module annotation: Pfam domain module=PPR::PPR; Domain location =25-59::60-94
MTNHSFLSQLYDIVRKEIWYRPDMFFYRDMLMMLARNKRVEEAKKVWGDLKTEEVLFDQHTFGDIIRAFLDNGLPSEAMDIYEEMRQSPEPPLSLPFRVILKGLIPYPELREK

SEQ ID NO: 133015 - protein, 231 aa, Glycine max
  Coding DNA Sequence Number=SeqID_41330
  Homolog annotation: Hit_ID=UPI00016621D1; Match level="QueryCoverage =91%, HitCoverage=41%, E-value=4e-16, Identity=31%"; Hit description =UPI00016621D1 related cluster
TSTLTFKGPHILTFRALHVLAFRGLHALTFRGLLALAFRGLHVLAIRGLHVLTFRGQHVLAIRGLHVLAFIGQQVLAFRKLHAPGFRGLHVLAFRALHVLAIRGLHALTFRGLHVLAIRGLQVLVFRGLHALAFRGLHVLTFRGLHVLPIRGLQVLAFRGLHALAFRGLHVLALRGLHVFAIKGLHAHTFKGLHVLAIRGLPVLAFRRATTRPHLQRTTRPHLQRATRPHL

SEQ ID NO: 133016 - protein, 129 aa, Glycine max
  Coding DNA Sequence Number=SeqID_41331
  Subcellular localization annotation: CTP_CleavageSite=36; ConfidenceScore=5.36e-01
MPISPYGNISWSVPSRHRDRAHKTPSGPRKVQQGPRVSSSGYGPLSILQGARTPPARSCHPDIGKDRARRTPGGPKEVQQGPGVSNSDYGPLSVLRSARRPNKVIRPRINRAFIKKYCAPRRAQGETPQ

SEQ ID NO: 133017 - protein, 235 aa, Glycine max
  Coding DNA Sequence Number=SeqID_41332
  Subcellular localization annotation: CTP_CleavageSite=29; ConfidenceScore=5.07e-01
MTTSQCIWSFQMKTSRPCSKHPVDSLRCRCSESVPRPPTGLGGGLAVEMGANHAHQHDLPFPDMDNVSVHMAQLISDAIYQFAGTVPTRHPMDPERSNSALGFPALITGLCQFYGVPVTPSKVIRPPITRAFIEKYCTPRQAADAPPSPPESTSAHLRRLEHCIRHVASQKVANHRGQMEAGPAGTSGGGDKAQEDEDMADLIDFLLYYVRYVWTKYAIVTFNYLLLITSDFYRV

SEQ ID NO: 133018 - protein, 189 aa, Glycine max
  Coding DNA Sequence Number=SeqID_41333
ELHRPRLQKTTCLAFKGLHILAFGGLHVLAFRGLLALAIRGLHVLAFRGLHALTFRGLHVLTFRGLHALAFIGLHALAFIGLHALAFRGLRVFTFRASSFILSVLGPPPDIGGDHAQQTPSGPREVQQGPGVSSSGYGPLSILQGARPPQRGIASARHPVDPKKSNRVLGFPAWITGLCQFYGVPVPQQ

SEQ ID NO: 133019 - protein, 197 aa, Glycine max
  Coding DNA Sequence Number=SeqID_41334
  Gene Ontology: Mol. function=non-membrane spanning protein tyrosine kinase activity; Cellular component=integral to membrane; Biological process=capsule polysaccharide biosynthetic process
  Homolog annotation: Hit_ID=A8GC49; Match level="QueryCoverage=85%, HitCoverage=23%, E-value=8e-51, Identity=57%"; Hit description=Non -specific protein-tyrosine kinase
  Pfam annotation: Domain name=CbiA; Domain location=1-196; Score= -10.6; E_value=0.00033; Accession=PF01656.14; Description=Cobyrinic acid a,c-diamide synthase
MISGATPEAGKTFISSNLAAIMSLTRQRVLLIDADMRRGTGHKVFGVSNATGLAEVLSGEAPFPTAITRVQKDNYDFDFLPRGKTPVNPAERLMGPILPELIKWASNNYDLVIIDTPPVLAVTDAVLIGKHIGTLLLVARYQTNTVREIELSIKRFTQCNITVQACVLNMITNSFRNYYTYGYGNNTYAYDETRIKH

SEQ ID NO: 133020 - protein, 203 aa, Glycine max
  Coding DNA Sequence Number=SeqID_41335
  Homolog annotation: Hit_ID=A5FL18; Match level="QueryCoverage=98%, HitCoverage=47%, E-value=1e-24, Identity=39%"; Hit description=All -trans-retinol 13,14-reductase precursor
MEIRSTLKLINEKRLRKSFLNRVLSWEPISSCFSVYIVLKPGNIPYFNHNIYHYSCIEQVWNAYQYENETWPETYMLSSTPSKHHPEFAENHYNEEILHLNTRRFIESITSDKKLQAILLGSNFLYGGDSEKTPFYVHALTVNSCIQSAYKCAKGGSQISKLLIRKLREYGADVHKHSEVSEMIFTEDVLVAVRTKTGKEYAA

SEQ ID NO: 133021 - protein, 219 aa, Glycine max
  Coding DNA Sequence Number=SeqID_41336
MQVGGCSIYGGAHESGCCIPQDNVAKEVTNKAEISIKIWGKDGGHIQEISSVSMSNHKSTESAIKNLEIRVGQLAIQVGGCSIYGGAHESGCCIPQDDVAKEGQGWRSHPGNQFNKDQGRPSNRPPNQEPNLYERTTKIEETLAQFMQVSMSNHKSIESTIKNLEIRVGQLAKKRAENSFGGFGANTEKNLKEECKAVMTRSKMETIVEDESRTIEEKK

SEQ ID NO: 133022 - protein, 177 aa, Glycine max
  Coding DNA Sequence Number=SeqID_41337
  Homolog annotation: Hit_ID=A5BTM1; Match level="QueryCoverage=64%, HitCoverage=4%, E-value=4e-12, Identity=35%"; Hit description =Putative uncharacterized protein
MTRGNPSDLQPFDPEIDRTFHRLVRHHFIPFDHSEHSITGEYVHSVIGDFEHPDLEHYNFEHSDSEHSDFAHSENMAQPPPRERTLREMAAPDFTYESLCIQYPDEDVPYVLKTGLIHLLPKFHGLAGEDPHKHLKEFHIVCSTMKPPDVQEDHIFLKAFPHSLEGVAKDWLYYLAP

SEQ ID NO: 133023 - protein, 72 aa, Glycine max
  Coding DNA Sequence Number=SeqID_41338
MVWRLQSPFLLLHSAVIDLQEAKDSIDEEYPRPTSPFLLLHSTSIDLQEAKESIDEEDPRPTSSTWSYIMWY

SEQ ID NO: 133024 - protein, 97 aa, Glycine max
  Coding DNA Sequence Number=SeqID_41339
MAPPLSASRLSSAAFPCLAVEARLRGECDSKNNSSESKKISSKSRTSQEFKNQEEFKTQEESLESRIKIQDSRSQESRSRFKTQDSRMKKRLNQDKY

SEQ ID NO: 133025 - protein, 124 aa, Glycine max
  Coding DNA Sequence Number=SeqID_41340
MTPEVAQEIADKIEQATHGSFVPHGRQDILNTSLGRPEHPGRVRVAGTGVTISQYFGQASRASSTSSPSINQQQLADIISGIKDDIRKQLQDEIRKEVQDEIRKEVRQEHKQQQEAWMRAIEEK

SEQ ID NO: 133026 - protein, 293 aa, Glycine max
  Coding DNA Sequence Number=SeqID_41341
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRSSARKLVDKPSDDTSKLPKAEAEANHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133027 - protein, 148 aa, Glycine max
  Coding DNA Sequence Number=SeqID_41342
  Gene Ontology: Mol. function=glutamate-tRNA ligase activity; Cellular component=cytoplasm; Biological process=tRNA aminoacylation for protein translation
  Homolog annotation: Hit_ID=A6TC43; Match level="QueryCoverage=55%, HitCoverage=17%, E-value=3e-39, Identity=91%"; Hit description =Glutamyl-tRNA synthetase
  Pfam annotation: Domain name=tRNA-synt_1c; Domain location=67-148; Score=-156.7; E_value=0.0001; Accession=PF00749.12; Description=tRNA synthetases class I (E and Q), catalytic domain
MTGSNRRPPPCKGDALPTELITPAVWSRIIGILRKKRTSARAASVTVIEESASPARICALFFRVNPPTGYLHVGGARTALYSWLYARHNQGEFVLRIEDTDLERSTPEAIEAIMDGMNWLNLDWDEGPYYQTKRFDRYNDVIDEMLEA

SEQ ID NO: 133028 - protein, 126 aa, Glycine max
  Coding DNA Sequence Number=SeqID_41343
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKNTRRTSALASVAVTLRVTTTPAALNAPLQGASHSPFKLRNCWEGRSVRASSLLRQLAKGGCAARRLSW

SEQ ID NO: 133029 - protein, 153 aa, Glycine max
  Coding DNA Sequence Number=SeqID_41344
  Gene Ontology: Mol. function=structural constituent of ribosome; Cellular component=ribonucleoprotein complex; Biological process =translation
  Homolog annotation: Hit_ID=Q2PMT2; Match level="QueryCoverage=88%, HitCoverage=75%, E-value=2e-57, Identity=67%"; Hit description =Chloroplast 30S ribosomal protein S2
  Pfam annotation: Domain name=Ribosomal_S2; Domain location=13-152; Score=122.3; E_value=1.4e-33; Accession=PF00318.11; Description =Ribosomal protein S2
MTKRYWNIILEEMMEAGVHFGHASEGKQFLIVGTKKKAADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALSRMYNFGNSNNLFNRYKL

SEQ ID NO: 133030 - protein, 46 aa, Glycine max
  Coding DNA Sequence Number=SeqID_41345
CHIGNEKLRIGAILWLEEFDQESKGPTSLRAIGLRNSKLSETLKRE

SEQ ID NO: 133031 - protein, 198 aa, Glycine max
  Coding DNA Sequence Number=SeqID_41346
  Gene Ontology: Mol. function=two-component response regulator activity; Cellular component=intracellular; Biological process=two -component signal transduction system (phosphorelay)
  Homolog annotation: Hit_ID=P69229; Match level="QueryCoverage=91%, HitCoverage=75%, E-value=3e-84, Identity=86%"; Hit description =Transcriptional regulatory protein baeR
  Pfam annotation: Domain name=Response_reg; Domain location=11-122; Score=110.7; E_value=4.3e-30; Accession=PF00072.15; Description =Response regulator receiver domain
MTELPIDENTPRILIVEDEPKLGQLLIDYLRAASYAPSLISHGDQVLPYVRQTPPDLILLDLMLPGTDGLTLCREIRRFSDVPIVMVTAKIEEIDRLLGLEIGADDYICKPYSPREVVARVKTILRRCKPQRELQVLDAQSPLIVDESRFQASWRSKLLDLTPAEFRLLKTLSHEPGKVFSRLLAGIKKLDVSDVASA

SEQ ID NO: 133032 - protein, 148 aa, Glycine max
  Coding DNA Sequence Number=SeqID_41347
MEDGFSQGSILIILGRPFMKTARTKINVYAGTLSMEFGDITVHFNILDAMKYASEDLSVFRAEIIDDVVDEYMTDLYSNMHATHCSSSCIESEIVLDHMFEFDAESESESDIDCMSGGGVLPLEINFIESDRTNHVSGSTHTSDFLYE

SEQ ID NO: 133033 - protein, 109 aa, Glycine max
  Coding DNA Sequence Number=SeqID_41348
MTVRSLGFDGPYDVYPPHGKRPRGGHDIQRMWQSIDIVRERLTFMAFPYMDAAITFHGEPVITCFQDLPGHSMPIGVRSKRTLVDFLDHVVHLFGIHASQESHVMVSFI

SEQ ID NO: 133034 - protein, 282 aa, Glycine max
  Coding DNA Sequence Number=SeqID_41349
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINSLGGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133035 - protein, 99 aa, Glycine max
  Coding DNA Sequence Number=SeqID_41350
MACGGHRWSWVVEKKVLGFGWVFREEEGENIVFFMLKNRESTFAAKCDNSCLAQFPLKLEFALSVIICTEHNFSCAKHNNSRSTQFPLGLELRLAHFSR

SEQ ID NO: 133036 - protein, 164 aa, Glycine max
  Coding DNA Sequence Number=SeqID_41351
MSSVIACLQKATMSSSIFQRRQCLQSLHAFKRRQCPHLHFKDDNFFSHCIPSKGDNGLHLHFKDENVFSHCMPSKGDNDHHLHAFKGNNDHHLHFEDENDILQPLGPPGPIRRLRREETSSPGRAWEAEGKGFSTLSEQIPLKLVRRRRKKKKNQGRGASVTLL

SEQ ID NO: 133037 - protein, 67 aa, Glycine max
  Coding DNA Sequence Number=SeqID_41352
GVVLAEVLLADSRFTRPDMGFHPTKLNFVPSDADERHSIGVKSCEREGGMSGNRDVFVARLHACACN

SEQ ID NO: 133038 - protein, 52 aa, Glycine max
  Coding DNA Sequence Number=SeqID_41353
MGETHEMPHHNLDDFEHCLGYATEGQAVGGKIPPIMEEMGEVGSSRGKAQGR

SEQ ID NO: 133039 - protein, 61 aa, Glycine max
  Coding DNA Sequence Number=SeqID_41354
MGHLSDQGVSTDPKRIKVIPDWLTPPCVEGRSPEYEEPRDLRSNPFQGGGDDAILPPKGIG

SEQ ID NO: 133040 - protein, 123 aa, Glycine max
  Coding DNA Sequence Number=SeqID_41355
MFLQKAVASGGSNLARMGELGGKLLPYFPINRGRSEEEKGSALLVIWRRFSTVLHRSSFILRRSSVFNRETKAKINSQSQARPQKITKKDFKVRYLSFSHQVKMGHFKVQRLKKISFQVKRIA

SEQ ID NO: 133041 - protein, 230 aa, Glycine max
  Coding DNA Sequence Number=SeqID_41356
  Gene Ontology: Biological process=transposition, DNA-mediated
  Homolog annotation: Hit_ID=Q1J7G7; Match level="QueryCoverage=17%, HitCoverage=71%, E-value=6e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQLSGHKRGGGFQVEGVNFELGVIMVIAVSFGKPVVPAALMNRPTRGERRFAYWALAECILAYYVGTDEGVSEVLHVAGEKRLH

SEQ ID NO: 133042 - protein, 118 aa, Glycine max
  Coding DNA Sequence Number=SeqID_41357
MLSFNQMQSQMQSQGLELPPKPEVGNDLDTGDLEKCGLYIEENPSCLVALGRLYEGFTTVHNIPLRHDEVKVGVEEARDANALIPVRTEKGAVGPTELADGPDHDVDGSLYLMTLTIP

SEQ ID NO: 133043 - protein, 78 aa, Glycine max
  Coding DNA Sequence Number=SeqID_41358
  Subcellular localization annotation: CTP_CleavageSite=62; ConfidenceScore=5.05e-01
TYQGNPCGVYPDLSSFTGSGVYPDLSSFTGSAVYPDLSSFTGSGVIEICDPFLVRFTSSGIRASALDTVSILSYYFSL

SEQ ID NO: 133044 - protein, 287 aa, Glycine max
  Coding DNA Sequence Number=SeqID_41359
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSILAALSAPVPADFQRLEAMFQSIHQGQIILLQSLQMVAPPVSIPSVEQFNEWVAWPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133045 - protein, 144 aa, Glycine max
  Coding DNA Sequence Number=SeqID_41360
MAPKKLSMKRSRRDAATEGSSATPEFDSHCFRSAEHQQLFEAIKGWSFHTESDGESLQTLGVAGALPGRRDAGMRSRADASLDADLTGRSRWVTRHRALSTALGSASRCQPPGAGYRYIVSTASTLVTTGQGFALFACRYRRAV

SEQ ID NO: 133046 - protein, 108 aa, Glycine max
  Coding DNA Sequence Number=SeqID_41361
  Subcellular localization annotation: CTP_CleavageSite=46; ConfidenceScore=5.30e-01
MKRIRIWGSHGHVAPLLPKKSNRLVISSSMWGSSIPPGGPTGSSPTWASGQSLGLPIAEEHLRVTVGCPRMPPDSWVTITKGGVVDKSRAFAPTYPQFVMRNSDLRSS

SEQ ID NO: 133047 - protein, 139 aa, Glycine max
  Coding DNA Sequence Number=SeqID_41362
  Gene Ontology: Mol. function=hydrolase activity, acting on acid anhydrides, catalyzing transmembrane movement of substances; Cellular component=ATP-binding cassette (ABC) transporter complex; Biological process=ferric iron transport
  Homolog annotation: Hit_ID=A8GGH7; Match level="QueryCoverage=82%, HitCoverage=39%, E-value=4e-40, Identity=66%"; Hit description=ABC transporter-related protein
  Pfam annotation: Domain name=ABC_tran; Domain location=1-109; Score =29.7; E_value=2.7e-09; Accession=PF00005.18; Description=ABC transporter
MVFQSYALFPHMSALDNIMYGLQSSGMSKKEAQDRAREGLKLVGLESQGQRLPSELSGGQQQRIAVARALVLEPQVLLLDEPLSNLDERLRRREEALAVSDKIIVMKEGDIAQQGRAGKPGEGSEALVRLGQGALSRAA

SEQ ID NO: 133048 - protein, 181 aa, Glycine max
  Coding DNA Sequence Number=SeqID_41363
  Homolog annotation: Hit_ID=Q84VI1; Match level="QueryCoverage=71%, HitCoverage=25%, E-value=2e-46, Identity=60%"; Hit description =Envelope-like protein
KRKEISSSDSDDDVELDVSTSKRAKKSGKKVPENVPDAPLDNISFHSIGNAERLKFVYQRRLAVERELGRDALDCKEIMDLIKAAGLLKTVTKLGDCYESLMEWWDIAVSEHQIAKEITAKQVQHWPKKREAVCREAKCEICNPAQDWELQTGYPPIIRPLLPQGTHVPDIVSTSGKAAAS

SEQ ID NO: 133049 - protein, 142 aa, Glycine max
  Coding DNA Sequence Number=SeqID_41364
MSDGFCGTHLQIMVRTKGLCRALGQVTGRGVGRGDHDDSDNAPQHQRPTASARRQRRAVTMDHVDEPVILDPDIQDDPMEAPAAVEDIPADVGAEAAEDQHQGFPGGPSDPSVLTAYADHVACSVWMGEERPELKLSSHGRK

SEQ ID NO: 133050 - protein, 54 aa, Glycine max
  Coding DNA Sequence Number=SeqID_41365
MGVQIAPRPTWALQNIPPEGCCFWRKQPGSPGNFAKVQPFFDVFIRSSSVFDLN

SEQ ID NO: 133051 - protein, 135 aa, Glycine max
  Coding DNA Sequence Number=SeqID_41366
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=65%, HitCoverage=74%, E-value=3e-24, Identity=67%"; Hit description=LacZ protein
  Subcellular localization annotation: CTP_CleavageSite=31; ConfidenceScore=5.07e-01
MVAHACNPSTLGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 133052 - protein, 239 aa, Glycine max [sequence omitted]

SEQ ID NO: 133053 - protein, 294 aa, Glycine max
  Coding DNA Sequence Number=SeqID_41368
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIGDYFPGNDKALAQQTVRQFGRNLPKDKNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133054 - protein, 172 aa, Glycine max
  Coding DNA Sequence Number=SeqID_41369
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=72%, E-value=5e-24, Identity=69%"; Hit description=LacZ protein
  Subcellular localization annotation: CTP_CleavageSite=34; ConfidenceScore=5.65e-01
MTMITPSSKLTLTKGNKSWYRAPPRGCGRTGAPSAGPGPCRCPGSSRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133055 - protein, 203 aa, Glycine max
  Coding DNA Sequence Number=SeqID_41370
MARMKKTREMKTEVAKEIVEKIDFFEEQATQGSFIPHGRQDHPGRVCAAGVGVTIKQYFGSAPQTSHSSSSLPPEELQQLTQQIRDQLEESITEKVTRQLMASFSQMQSQGLALPPEPLVGPSGPRVRTKGSCVDPLGNDPKPGDSDRRGLYIEANPTRLVVLGRVYEGSIVVHNTLLLPGQVKVGVKEVKDPDAPVPVPTNE

SEQ ID NO: 133056 - protein, 590 aa, Glycine max
  Coding DNA Sequence Number=SeqID_41371
  Gene Ontology: Mol. function=aspartate-tRNA ligase activity; Cellular component=cytoplasm; Biological process=tRNA aminoacylation for protein translation
  Homolog annotation: Hit_ID=A6TB35; Match level="QueryCoverage=99%, HitCoverage=98%, E-value=0.0, Identity=93%"; Hit description =Aspartyl-tRNA synthetase
  Pfam annotation: Domain name=GAD; Domain location=307-406; Score =173.0; E_value=7.9e-49; Accession=PF02938.5; Description=GAD domain
  Pfam annotation: Domain name=tRNA-synt_2; Domain location=117-559; Score=726.9; E_value=1.4e-215; Accession=PF00152.11; Description =tRNA synthetases class II (D, K and N)
  Pfam annotation: Domain name=tRNA-synt_2b; Domain location=140-292; Score=-36.3; E_value=0.01; Accession=PF00587.16; Description=tRNA synthetase class II core domain (G, H, P, S and T)
  Pfam annotation: Domain name=tRNA_anti; Domain location=18-102; Score= 99.4; E_value=1.1e-26; Accession=PF01336.16; Description=OB-fold nucleic acid binding domain
  Pfam module annotation: Pfam domain module=GAD::tRNA-synt_2::tRNA -synt_2b::tRNA_anti; Domain location=307-406::117-559::140-292::18-102
MRTEYCGQLRQSHVGQQVTLCGWVNRRRDLGSLIFIDMRDREGIVQVFFDPDRADALKLASELRNEFCIQVTGTVRARDEKNVNADMATGAIEVLASDLVIINRAEALPLDSNHVNTEEARLKYRYLDLRRPEMAQRLKTRAKITSLVRRFMDDHGFLDIETPMLTKATPEGARDYLVPSRVHKGKFYALPQSPQLFKQLLMMSGFDRYYQIVKCFRDEDLRADRQPEFTQIDVETSFMTAEQVREVMEALVRSLWNDVKGVELGDFPIMTFAEAERRYGSDKPDLRNPMELVDVADLVKSVEFAVFAGPANDAKGRVAALRVPGGAALSRKQIDDYGNFIKIYGAKGLAYIKVTERAKGLEGITSPVAKFLNAEIVEAILERTGAQDGDMIFFGADNKKIVADAMGALRLKLGKDLNLTDESKWAPLWVIDFPMFEDDGEGGLTAMHHPFTSPKDMTAAELKAAPEDAVANAYDMVINGYEVGGGSVRIHSGEMQQTVFGILGINEQEQREKFGFLLDALKYGTPPHAGLAFGLDRLTMLLTGTDNIRDVIAFPKTTAAACLMTEAPSFANPAALAELGIDVVKKEEKN

SEQ ID NO: 133057 - protein, 92 aa, Glycine max
  Coding DNA Sequence Number=SeqID_41372
MGYVLAFKVKVQPKFNNVVVLRYSNDIELINVVVDMLPNAEACSKVHAPILDSDDPSQLESILSNHDPLLGLSLTPTKRITSVDCDDEPKSS

SEQ ID NO: 133058 - protein, 224 aa, Glycine max
  Coding DNA Sequence Number=SeqID_41373
MAEKTKKKLEEAAQTRSTAAVIDPPSPIRQHASQGSFVPHGRQDVLTAAIGRPKHPGRVRAVGAGVTIKKYFGLASQTSRTSSSMAPKELEQLTQQIWDQLEESITEKVTQQLMLSFSQMQSQLQSQMQSQGLALPPEPEVGPSTARVSTKDSCVDPSGNDPDTGDSDKCGLYIKENPPCLVALGRVYEGSIIVHNIPLLHDQVKVDVEEVKDADAPVPVPTDK

SEQ ID NO: 133059 - protein, 182 aa, Glycine max
  Coding DNA Sequence Number=SeqID_41374
  Gene Ontology: Mol. function=protein binding; Cellular component =intrinsic to membrane; Biological process=defense response
  Homolog annotation: Hit_ID=A2Q4E5; Match level="QueryCoverage=85%, HitCoverage=17%, E-value=2e-31, Identity=45%"; Hit description =Disease resistance protein
  Pfam annotation: Domain name=LRR_1; Domain location=114-136; Score =7.0; E_value=16; Accession=PF00560.24; Description=Leucine Rich Repeat
  Pfam annotation: Domain name=LRR_1; Domain location=12-34; Score=9.1; E_value=6.3; Accession=PF00560.24; Description=Leucine Rich Repeat
  Pfam annotation: Domain name=LRR_1; Domain location=90-112; Score =9.7; E_value=4.8; Accession=PF00560.24; Description=Leucine Rich Repeat
  Pfam module annotation: Pfam domain module=LRR_1::LRR_1::LRR_1; Domain location=114-136::12-34::90-112
MESIFGGVKFPALKTLYVVDCHSLKSLPLDVTNFPELETLVVQDCVNLDLDLWKEHHEEQNPKLRLKFVAFVGLPQLVALPQWLQETANSLQSLAIKNCDNLEMLPEWLSTLTNLKVLHILACPELISLPDNIHHLTALERLRIAYCPELRRKYQPHTNRNDLLRHISVEAPLATPGRGSGM

SEQ ID NO: 133060 - protein, 30 aa, Glycine max
  Coding DNA Sequence Number=SeqID_41375
MVSMPPVATCPSRASEGEAHGCAFQRRKGR

SEQ ID NO: 133061 - protein, 160 aa, Glycine max
  Coding DNA Sequence Number=SeqID_41376
MIEVSTEAIASLAQYYDQPLRCFTFGDFQLSPMVEEFEEILGCPLGGRKPYLFTGLAPFSPRSEACLPIRKPPFMHRERKGELGSTLSKKRRSICQLLPSMKGRKNRSSYFMRRISKCSLDGDKGLHQLQSRSCYKTTWLSYERSTTRGRDRACHFMRFQ

SEQ ID NO: 133062 - protein, 49 aa, Glycine max
  Coding DNA Sequence Number=SeqID_41377
MKLASTFSLVKLDVILPMKGPVPRAMSRRLQEDWARAAEEGPTVLMNLR

SEQ ID NO: 133063 - protein, 163 aa, Glycine max
  Coding DNA Sequence Number=SeqID_41378
  Homolog annotation: Hit_ID=O52175; Match level="QueryCoverage=50%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAGKAKLKGQVLVTALLQPVTSVQEL

SEQ ID NO: 133064 - protein, 153 aa, Glycine max
  Coding DNA Sequence Number=SeqID_41379
IIRHQIPMIGGMMNVLSGATLFCKITHAPNIFMICVHRDSLGSDQGLPMDPKRIKVIPEWPTPPSIREIWGFNDASSIGACKPRIFFINGFLCFLEDEWQRNGERERERRRHFKEKMSLEEAHHHRRPWIRAWRKKEMNEGRGREEHEILCSK

SEQ ID NO: 133065 - protein, 254 aa, Glycine max
  Coding DNA Sequence Number=SeqID_41380
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=37%, E-value=1e-136, Identity=83%"; Hit description =Photosystem I P700 chlorophyll a apoprotein A1
  Pfam annotation: Domain name=PsaA_PsaB; Domain location=32-254; Score= -178.5; E_value=0.00092; Accession=PF00223.10; Description =Photosystem I psaApsaB protein
MIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTG

SEQ ID NO: 133066 - protein, 75 aa, Glycine max
  Coding DNA Sequence Number=SeqID_41381
MYLFSMYVLHQLKSFSKGKGIVHTENQAGKTLTRGANAAVVGFAYFLECYQTQEFTQIRESSIDWIRRLVRVYFI

SEQ ID NO: 133067 - protein, 118 aa, Glycine max
  Coding DNA Sequence Number=SeqID_41382
GLHVLALRGLHVLTIRGLHALTSRGLHVLALRGLHVLTLGASYPHRQRAARPRLLRATRPRQQRAARPHLERTTPPRHQRAASPHLERTTPPRHQRVARPHLQRTTHPRLERAARPYL

SEQ ID NO: 133068 - protein, 204 aa, Glycine max
  Coding DNA Sequence Number=SeqID_41383
VDPWVLVPNTFRGLYVLAIRGLHILAYRGLHALSFRGLRVLIFIPGPPPNIGGRPTVRAHPEREAITHLLCIPGQDFPRAVAKRRVRTMRTNMTTLTDHVASLLVYPMKSNRALGFPTLVTGLYSPTGCPFPRQGIVSLTPRGSEEGQQGLGVASSKYGSLSVLGSSCRPQQGHQVPPPDRAFIKKFCVSRQAQGETPQQPGDG

SEQ ID NO: 133069 - protein, 259 aa, Glycine max
  Coding DNA Sequence Number=SeqID_41384
  Homolog annotation: Hit_ID=A2Q4S5; Match level="QueryCoverage=40%, HitCoverage=17%, E-value=7e-10, Identity=33%"; Hit description=IMP dehydrogenase/GMP reductase, putative
DEEATLETRQAGGPHVRLGWLRDLYQSQCSTRRWVVAARTDLAQTRGFAWGAAALVHMYDHLNDASQASTRQLGVHTSVVHDAYDEGSPRACRWLTGKAHITGIKGAPYRRRLDALSVTDVCWMPYGEHRRVRAFDLISSYTGQLRWGQIVVDDIDDQWLNFPDHLVPSGELCVVPGQVATDYMEWFFRISHPFVMRTEETVALRHPPPPHHEEFVEPPIPEISVATDLPTHSVGMAQDLGAIAEDLERVINLRMSLRH

SEQ ID NO: 133070 - protein, 289 aa, Glycine max
  Coding DNA Sequence Number=SeqID_41385
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDQNAGLNNRQNTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133071 - protein, 97 aa, Glycine max
  Coding DNA Sequence Number=SeqID_41386
  Subcellular localization annotation: CTP_CleavageSite=72; ConfidenceScore=5.44e-01
KLLRKSFLRRGLGETLRLKGPVPPPSLIATVSGAPSTSSASRPSKDGRSTERGASSSGRMNALSQFLGDPLVLEEGQECEFSQRRNRADEFDEEAIA

SEQ ID NO: 133072 - protein, 137 aa, Glycine max
  Coding DNA Sequence Number=SeqID_41387
  Homolog annotation: Hit_ID=Q6UUU1; Match level="QueryCoverage=43%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKILGRFSPGASLVRSLVPAFRVYRCHSAVMA

SEQ ID NO: 133073 - protein, 31 aa, Glycine max
  Coding DNA Sequence Number=SeqID_41388
MWAGYAYTEKMHWRHLGDIRGNKPSAAEWLD

SEQ ID NO: 133074 - protein, 284 aa, Glycine max
  Coding DNA Sequence Number=SeqID_41389
  Gene Ontology: Biological process=transposition, DNA-mediated
  Homolog annotation: Hit_ID=Q6UUU1; Match level="QueryCoverage=21%, HitCoverage=40%, E-value=1e-17, Identity=76%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIRHWLKINGIKHKESVNFELGVIMVIAVSFGKPVVPAALMNRPTRGERRFAYWALAECILAYYVGTDEGVSEVLHVAGKKRLHRCVSRICDTGYIPLPRSLTRYARSFDCGERKWLTNGPEISWKMPERYLTG

SEQ ID NO: 133075 - protein, 194 aa, Glycine max
  Coding DNA Sequence Number=SeqID_41390
MVKVGTSYVPINVHFGFVKIGPWLLGTLCGHLIILHPKLSITAYCAIPSTSGGPVPAFDSSVPPVQLLKRVVLSVTIRTQAYRAGSISAGKCKAWGLPFAFRLPTVRERADRCGPLLLRTPTRRKGDVLQVAIKLGNAGFPVTDVEFVRFTGFAKIPLPRLLTRYARSFDCGERKWLTNGAEISWKMPGRYLTG

SEQ ID NO: 133076 - protein, 249 aa, Glycine max
  Coding DNA Sequence Number=SeqID_41391
  Gene Ontology: Mol. function=chitin binding; Cellular component =extracellular region; Biological process=chitin metabolic process
  Homolog annotation: Hit_ID=UPI000069F178; Match level="QueryCoverage =82%, HitCoverage=99%, E-value=3e-16, Identity=32%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=47; ConfidenceScore=5.79e-01
MHSSSVIASLSSCARTVGPPPISGGGPGTVWMSSTLKMRTRSPLKVRACSPLEMRACSPLLARTCSPFKVRACSPLTVKACNPLMVRTCSPLKARTCSPLNGEGMPPFENGEHVRACSPTKVKAHDPLTAGTCSPLKVKVKAHDPLTARTCSPLKVKVKAHDPLTVRTCSPLKLKVHDPLKARTCSPLKVKARTYSPLEVRACSPLMVRACSPLKARTYSPLEVRACSPLVLRTRSPLKARTCSPLNGE

SEQ ID NO: 133077 - protein, 96 aa, Glycine max
  Coding DNA Sequence Number=SeqID_41392
  Subcellular localization annotation: CTP_CleavageSite=67; ConfidenceScore=5.25e-01
MGYQLGKRVFSLCKELKNFDILTFRNTRKVATPLKKARLWLRGGGGSSRSTSASSSGGGSSGKQNVRVVAGRSSRRDEVVQAIVGVLGRCTYKHRL

SEQ ID NO: 133078 - protein, 98 aa, Glycine max
  Coding DNA Sequence Number=SeqID_41393
EPARTRQRTVEWILPTPTPYRLVEPIQVIEVTSSEEDPKEDPEELPPEPAMDALDFLEGDEDPLPEVDSPEDVMSAFEADSMEESGPGEMATSGGSPS

SEQ ID NO: 133079 - protein, 155 aa, Glycine max
  Coding DNA Sequence Number=SeqID_41394
MSLATLFGKLQEHEMKLQRLNQNEENDKKKRSIALKASSSIQEGNEEDDSDDEEDFSFFVKKFQKYIKKRRIDRRQNFNNGRKSQDDSQANCPSNKEWSEKSEKKRFDERRTKKAYIAWDDNDSSDGSEMEINLLTKYYKVTRTSLKDDKQGEKA

SEQ ID NO: 133080 - protein, 55 aa, Glycine max
  Coding DNA Sequence Number=SeqID_41395
MASYGVASPLSLPFFIPLPFIFQEAKESIDEEDPRPTSSNGAYIRRVYPLWIFGL

SEQ ID NO: 133081 - protein, 132 aa, Glycine max
  Coding DNA Sequence Number=SeqID_41396
MTIQMQRLLNRNKEELYRQIAKSSLFTLKPLSPREVCDDQIRMREKREQEKENSEAPQRNMKKKSDAPEEKSDTHKRESDTHERKFCAILLNLSTTTKIESTPLWVLGSLRTKSILMSTQGADGMGKGVYSP

SEQ ID NO: 133082 - protein, 442 aa, Glycine max
  Coding DNA Sequence Number=SeqID_41397
  Gene Ontology: Mol. function=motor activity; Cellular component=cell projection
  Homolog annotation: Hit_ID=P15305; Match level="QueryCoverage=100%, HitCoverage=98%, E-value=5e-35, Identity=24%"; Hit description =Dynein heavy chain
HVLAIRGLHTLAFGWLHVLTFIGLHALTFRGLEFLTLRGPNVLAFKGLHALAFRGLHILPFRGMHALAIRGLHALAFRGLHVLVIRGLHVLSFRGLHVLTFIGQHVLTFRGLHAFAFRGIHVLAIRVLNVLAFRALHVLTFRGLHVLTFGGLHVLQFRGLHVLAFRGLHVLTFSGLHVLTLRGLHVLTLRGLHVLPFKGLHVLTFSGLHLLTLRGLHVPTFRVQHALAIRGLHVLAFGGLHALVFRGLHALTFRGLHVLTFRGLHALAIRGLHALAIRGQHAFTFSGLHVLSYRALHALIVRGLHVLTFIGLHVLAFIGLHVLAFRGLHILAIRGLHVLAFRGLHVLPFIGLHVLTFRGLHALAFIGLHFHAFRGLHVLTIRGLHILAIRVLHDLAFRGLHILPIGGLHVLAFRGLHVLAFIELHVLAFRGLQILAFRGLHV

SEQ ID NO: 133083 - protein, 51 aa, Glycine max
  Coding DNA Sequence Number=SeqID_41398
NHVQNKVMVQLWFGIRVKEPGGPFGPTIKSCSEPHELIAIHASSTIESGAP

SEQ ID NO: 133084 - protein, 88 aa, Glycine max
  Coding DNA Sequence Number=SeqID_41399
MYAFKKTTWTLHRGIIPFDKHIAAVGTTSNNMLSKRKTLDEGSLLSSKSETQHDHRFTSTPYVPMDPGIGPLFNSPCVQKGVGVVCIK

SEQ ID NO: 133085 - protein, 109 aa, Glycine max
  Coding DNA Sequence Number=SeqID_41400
  Homolog annotation: Hit_ID=A7QYP9; Match level="QueryCoverage=77%, HitCoverage=44%, E-value=1e-22, Identity=67%"; Hit description =Chromosome undetermined scaffold_252, whole genome shotgun sequence
  Pfam annotation: Domain name=DUF1218; Domain location=4-91; Score =42.3; E_value=1.7e-09; Accession=PF06749.3; Description=Protein of unknown function (DUF1218)
LNKCWGGVGVENVFDTATLQRREMFVFDTFMVTFIIAASCLLAGSVRNAYHTKYRDLMGERAPSCQTLRKGVFGAGAAFIVLTGITSELYYVSFSKANNNGPPPYARDT

SEQ ID NO: 133086 - protein, 104 aa, Glycine max
  Coding DNA Sequence Number=SeqID_41401
  Subcellular localization annotation: CTP_CleavageSite=57; ConfidenceScore=5.47e-01
MSPPPLEHHNHSQTHLKFSGRLPLQARFSTGLHTAKSLKLSGTWTFLSLENPRHLSACFSRSADGLKRCASLDDPSLSANAQLILLPDSSSRSTEECCALRMAR

SEQ ID NO: 133087 - protein, 309 aa, Glycine max
  Coding DNA Sequence Number=SeqID_41402
MDVCVYWRRVCAIFVLRVAFLGKTNFPNVCLRRKWPRGKLASKRSRKDKAAEGTSSAPEYDSHRFRSVVHQQCFEAIKGWSFLRERRVQLRDDEYTDFQEEIGRRRWTSLVTPMAKFDPEIVLEFYANAWPTEEGVRDMRSWVRGQWIPFGADAIGQLLGYPLVLEEGQECEYGQRRNRSDGFDEEAIAQSLCIPGQDFSRTAAGRRVRIMRTNMTTLTQIWMTLLLSNILPSDHNFDLPLPKCQLVYAILTRMSVHVAQLIADAIYIFAGMAPTRHPLDPDKSNRALGFPALITGLCQSFGVPVAPTK

SEQ ID NO: 133088 - protein, 212 aa, Glycine max
  Coding DNA Sequence Number=SeqID_41403
MVIDQSLFYDLTQLTSEGVPFEGALDDDWKFDFSMHNAHRLVCTNQADMTRRLLSGSLALESRILHYLIVRILLPRSSNHAQVSKEDLIVMWAFHTGRKIDWAHLVRYRMHKVLRLNALLPYPHLVTLFLQHFNIPLDSEPYIPIKRSFLIGAVVVASFGYRKERDGSWVKKDAQPNDDEGQLPIEGDSSLLQSLMLWNNKWTCDSMQWTQG

SEQ ID NO: 133089 - protein, 154 aa, Glycine max
  Coding DNA Sequence Number=SeqID_41404
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPLVQTRPEHDPGALTGFPHRLSKGCMPQLGLLAFKGNRNKVVDILVGHVQCIGWCIVG

SEQ ID NO: 133090 - protein, 33 aa, Glycine max
  Coding DNA Sequence Number=SeqID_41405
MKKIIQKMTVSYKDWHEMLPFALHSYRIGFFQP

SEQ ID NO: 133091 - protein, 82 aa, Glycine max
  Coding DNA Sequence Number=SeqID_41406
MERYLQHLVRQQAANHRVQGQGFAPFASPTPEQFGAEIAWPGDWPEAQAGEEHVGSPGEVEEARMDEEMIDLLGFLGGSGAT

SEQ ID NO: 133092 - protein, 248 aa, Glycine max
  Coding DNA Sequence Number=SeqID_41407
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=A5NA30; Match level="QueryCoverage=49%, HitCoverage=10%, E-value=6e-24, Identity=45%"; Hit description=Multi- sensor hybrid histidine kinase precursor
  Pfam annotation: Domain name=HisKA; Domain location=188-248; Score =43.8; E_value=6e-10; Accession=PF00512.16; Description=His Kinase A (phosphoacceptor) domain
LYPGKLRLTELKPAQEAAIAFGISRSEPELQDIMNKALAAIPAGMMTDVLTHWQATPAAHFDTWKLYRQTDAPHQSAAAPGNSAARSPDQWSAAAVLCGLAGWDDRAHQSGVYPVFHPGRANPSGLFAEFVIDDGRQKRHIRHWMTSYTGDEVGSGGLICGWQDVTDYLQLLEDLSLAREATELASQSKSDFLATMSHEIRTPLSAVIGLLELQTQEGRADTELIRVAHEAAVSLMDIVGDILDMAKI

SEQ ID NO: 133093 - protein, 182 aa, Glycine max
  Coding DNA Sequence Number=SeqID_41408
  Gene Ontology: Mol. function=siderophore-iron transmembrane transporter activity; Cellular component=cell outer membrane; Biological process=siderophore transport
  Homolog annotation: Hit_ID=Q1ID49; Match level="QueryCoverage=54%, HitCoverage=13%, E-value=6e-42, Identity=84%"; Hit description =Putative TonB-dependent ferric siderophore receptor
IPARVQNSGTDDYEGHQAINVPRLRAALQADYSLPVPGLALLGGARYSASKYASQAGNVEVGGYTVFDLGSRYRTRIGGYETVLRLTVDNVFDKRYWRDGLPGSPIAGQDGLHSSPEPKDEQTKSPRHFCAGASCGMWRPCCPCPVAARGAAQTLTDRSALSLYLTGVAGYRRRHVTQRTLS

SEQ ID NO: 133094 - protein, 165 aa, Glycine max
  Coding DNA Sequence Number=SeqID_41409
MPISPCGSISWSVSSRHRDRAPYEESHGPGEVQQGPRVPSSDHQAPINQAFIEKYYAPRQAQGEAPQPPEGGQQRATDAPPPPPESTSAHLQRLKRSLRHVADQQATKSKAKDIKEVQLGGNLELAAKKLPVKRSRKGTIEESSSAAPQADTGFEKHQFQSVEHQ

SEQ ID NO: 133095 - protein, 311 aa, Glycine max
  Coding DNA Sequence Number=SeqID_41410
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=63%, HitCoverage=28%, E-value=2e-47, Identity=45%"; Hit description=DNA polymerase
MEPAIAKGLYNNVKGYNLKSFDERIIPEPILDEFLKIGLISPEDVTNAAGYAKANIIFYFKNREVGDIAKPLNKQSIPLTFDDGSPISKSEIYAKELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRIFPTFEERSCQMLKSFIFRVAAITRQNRSAKTIYFHNLGRFDGIFLLKHLALYHPNYTVTPLMRDNRLYEVAVYSKKRLLFTFRDSLHLLPGKLDDLAKNLCPELGSKGSISYED

SEQ ID NO: 133096 - protein, 57 aa, Glycine max
  Coding DNA Sequence Number=SeqID_41411
MSVRSLGLYGSDHIYPPHGKGPRCGQYIQWQGRSIDIVCKRLAFVALPYMEATVAFH

SEQ ID NO: 133097 - protein, 192 aa, Glycine max
  Coding DNA Sequence Number=SeqID_41412
VAESPPKPPPKPDPEVDDPLYLMTLTIPELFLRPYQVRWDATVVNVFYIKHEDLFEIAHGGQCLSISVLQLLILHLTETCMRVGNSDIYGFLEPQFIQRSGQSQFESESYIKSWMQSSQRDVYLGAYLNGFHCNRHWQMVVILPKEHLVVWFCSLHNRPDNYLKGIINSAIKGLDDAPQPKSKASARWIVVK

SEQ ID NO: 133098 - protein, 159 aa, Glycine max
  Coding DNA Sequence Number=SeqID_41413
MVRTRGLGRALGTGRGRGISEDVHHADVPRRCMPTASARRQRVHVREDVTERPEDVPQLHEDVPHVSDATPEMTGAVDVVHTEGVTTDGSLGSPAADEGFPGGPRDPSVLTAPEIEGMIAATGLSPLIRCSVITTDPGLIFAFVERWHRETSTFHLPVA

SEQ ID NO: 133099 - protein, 183 aa, Glycine max
  Coding DNA Sequence Number=SeqID_41414
MGDDKRSSYVIGIRVNSGVGLVGKFLIALEPTPKWALPAERVGVGAGAWGASLWMGAGALGCTGAELEESPTRAEKLGCSGPPSVGTCGGDVIKLPSLQTYFNSFPGEYHVRKAGGHVPPSLSVLFKGLTFLFNHVLQLSAIGSHIEIVLILPKEGSNKILPSADAGSFQISVPNDCWRCNWF

SEQ ID NO: 133100 - protein, 100 aa, Glycine max
  Coding DNA Sequence Number=SeqID_41415
MEACLAIEDLLQQMIDQGRLEVGDEGGEEQHICMQSADEESLRKPKPLVIHFTRDAAPQMPRHLSVVRPIPFPYKNSHAVLWRYAPPSERKEGATDVSSL

SEQ ID NO: 133101 - protein, 133 aa, Glycine max
  Coding DNA Sequence Number=SeqID_41416
MEVIGNKQIKKKGQFNIISKNYPLKPDEIKKKYNLKDGGERYLIFTQSKKAIASVAVSCKKIQAGGNKNTLKLEEGAERYSDDVQKGGETHGHDATAEHKEAAVAEKHGTEAPKTDSTAAAKPVEAEKAKAEH

SEQ ID NO: 133102 - protein, 76 aa, Glycine max
  Coding DNA Sequence Number=SeqID_41417
  Homolog annotation: Hit_ID=A6FJQ2; Match level="QueryCoverage=50%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLAQSCVGSRQRSDVTRSIFCPNFLQAGYFHT

SEQ ID NO: 133103 - protein, 212 aa, Glycine max
  Coding DNA Sequence Number=SeqID_41418
  Homolog annotation: Hit_ID=UPI00016621D1; Match level="QueryCoverage =98%, HitCoverage=41%, E-value=2e-19, Identity=35%"; Hit description =UPI00016621D1 related cluster
MNTLVFRGLHALTIRGLHVLAIRGLHALAFVGLQALTFRGLHVLVIRGLHVLAIRGLHALTFVGLHALTFRGLHVLLFRGLHVLAFTFVGLDALTFRGLHVLTFRELHVLTFRGLHVLTFIGLHTLTFRGLDVLAFRGLHVLTIRGLYALAFRGLHVLTFRGLHVLALKGSCTFAFVGLHALTFRGLHVLAFKGSCTFAIVGLHALTFRGLH

SEQ ID NO: 133104 - protein, 137 aa, Glycine max
  Coding DNA Sequence Number=SeqID_41419
MISSSLLVGIGVLKAYIPFSRCDDWRCHFKNKEIHDKLSVAKPSVASYLRKEIQPEQEADRVHGLPAQPPVKFNNMVVISLSMKLKEEHCSIGFSRPLTNQNKNPLTYGSMENHKPEGHEVSAAGVNIDNHMNEGSG

SEQ ID NO: 133105 - protein, 129 aa, Glycine max
  Coding DNA Sequence Number=SeqID_41420
MPVHSQLISFHTRHLFTEYSFTKSHKFPESSILSSYRFILLARSGALAATEQVFGTVAGNFFLFGKSPTGNLVPLDLEIKATLRRNRAERIRKLLQDKTVASILEEETHFSDSSLSDSPSLRESATYLP

SEQ ID NO: 133106 - protein, 86 aa, Glycine max
  Coding DNA Sequence Number=SeqID_41421
MGCAYAPTRAGTNSSAVNPSTKNRISKIWKKLANEPTSLRDAPPPGSLLAAIDIAAIDIKNLNRQASVAGATRLPPSSGKSGEPPL

SEQ ID NO: 133107 - protein, 103 aa, Glycine max
  Coding DNA Sequence Number=SeqID_41422
MEAMKEKMATMMEAMMSMKKIMEANAVAIAATRLLLRYGRQRFRKYGRSHDVQIQNEHAFPPYGLPLNYTPPNVAYTPNKNVNNSTPIPIESQQPQTDHAHVS

SEQ ID NO: 133108 - protein, 263 aa, Glycine max
  Coding DNA Sequence Number=SeqID_41423
  Gene Ontology: Mol. function=transporter activity; Cellular component= membrane; Biological process=transport
  Homolog annotation: Hit_ID=A8GHA6; Match level="QueryCoverage=93%, HitCoverage=65%, E-value=1e-48, Identity=40%"; Hit description =Putative outer membrane protein precursor
MAGVIMRKNTTPIFIGGVLLSALSAGAQAEITILDKNPQSNVLLAPLSLKVGGSIRPEWIFNNGPEPGYDKNGHDGGTRFRFSGDYALTQNTSIIGYYEWGVDLAHALSWDGHYNEDGKRDYQRQLYAGFKDDRYGTLTYGHQYGIYYSVVGIKSDVWDNDGHAGGTGIGISGDYDGGNKPKNSIKYTNDFGPVTLYANYLLPEDDLHTADNLIYRRKGGGGLGFDYKVTKDFTFSAAYSYTDAKIKDNLYSEKDYHQQLSGT

SEQ ID NO: 133109 - protein, 68 aa, Glycine max
  Coding DNA Sequence Number=SeqID_41424
MTEARQKGVRKVMKTRIKYTKQMGTTTGLWEFYGSITGVPEASKSHFSTKRGVWWPPSSPRRARLLQP

SEQ ID NO: 133110 - protein, 88 aa, Glycine max
  Coding DNA Sequence Number=SeqID_41425
MIMRGQDIYSSQDEATTSPSSSESEEAKGEESSEEIYPQEDRQPLVVKEKCKEVLRKKSPEFQEPRDLRSNPFQGGGNDAILPRKGIG

SEQ ID NO: 133111 - protein, 69 aa, Glycine max
  Coding DNA Sequence Number=SeqID_41426
MYSLDFRIVIIIKGEIMEAMPSKIILIQESRSRQDSRIIKIKIQDSRFKNNQDQDSRFKNNQDQDSRFK

SEQ ID NO: 133112 - protein, 98 aa, Glycine max
  Coding DNA Sequence Number=SeqID_41427
MARTRGLGRAISRVVGRDRPAGDVPERRRPTASARRLRVHQMTTEGRDMAEDVADMTDDVPEQPTEAPEMRVDAQGADSGEGSDGDDAAEGFPGGPRD

SEQ ID NO: 133113 - protein, 92 aa, Glycine max
  Coding DNA Sequence Number=SeqID_41428
MLDKHGVVGPAKPADWQDHEVMWDATVFGVFNEDFPLYIKHEDLSEIAHGGQCLNISIIQLWILQSQFESQSYMKNWMQNSERNVYIGAYMN

SEQ ID NO: 133114 - protein, 482 aa, Glycine max
  Coding DNA Sequence Number=SeqID_41429
LVRVDGDLSAAVVDIDRAVIVHDPGGTVREEQQQPVVGHDGGGADLDERLVPGAWRRRVHRLGVGRPGGPVDEVVAGRPVDRPLTEVHPPLPVHLLRHDDPGLGPVEAARVQGLERVEVVEQRTVLGPGAQVGRGGQAQLGAVPIPARVGEVVGAVDERDARVLAAVPLVVLRWRQDRRVLAGEGHPVLRPCQADVGDDVVGVRAVQEYHLVAVDERGGVVQVRRFPAVAARAQDRVALVGPLDGCTEVGGAEEALEHDEQDDDGERERCCPGEDGAVGVRRGLGHVGDVVRERHRQRLQARVLGDEEGPQELVPGSDERHEHDGHQHRADERDRDRGEQADLPGAVDTGGFEDLHRQRLEELHEDEHRRRVDEERQDHAQVRVAQAVVPGDLHVERDHQQLERHHLHQQHQHPDHAAPPEVEAGDGVAGEQTEYHGAQQHPCREDQRVRERADQVDARVDRDEVVDGPPARREQLVGGVRR

SEQ ID NO: 133115 - protein, 20 aa, Glycine max
  Coding DNA Sequence Number=SeqID_41430
MREYPERILGNRSDSISVRS

SEQ ID NO: 133116 - protein, 96 aa, Glycine max
  Coding DNA Sequence Number=SeqID_41431
SRGSALDNEEHIGEWRIALEGPHYAIMKNGSKLIGGGCMNENAIHGAPNKRRGWRIALEGPHKSIMKHGSKLFGGGCMNENAIHGAPKKREDGGLH

SEQ ID NO: 133117 - protein, 271 aa, Glycine max
  Coding DNA Sequence Number=SeqID_41432
  Homolog annotation: Hit_ID=A5B5G7; Match level="QueryCoverage=77%, HitCoverage=15%, E-value=4e-08, Identity=21%"; Hit description =Putative uncharacterized protein
MASHKRKALASVSQAQYDRSKFTSQDARDKYADNILGRKILPERNVKMFYAKFDAFRREVEKRNWHKELTNFSEGSIDVAIVRVRGHLIKFDVDALNTFLKTPVVIEEGESLPAYSRFANLRPVPQELVARLCIPGRGFELNADGLPLKILRKNLTTLAQTWSVLSFSNIAPTSHTSDITLDRAKLMYGLIMKMDMNLGSLISGQISLIAHHDSSRLGFCSASLTVHFFFFSFLFETRKWGHVCYRQAHQIVKYFKLKQSDPSIEHRELVD

SEQ ID NO: 133118 - protein, 81 aa, Glycine max
  Coding DNA Sequence Number=SeqID_41433
MGERNNSQSQVVAYLWFGIVATYPSAGGRREARGMRVPRKEYARSRHQRLFEENVGKTGKDEIYELFSERFGSCIYARGRY

SEQ ID NO: 133119 - protein, 82 aa, Glycine max
  Coding DNA Sequence Number=SeqID_41434
MISRLESGFTQPTVENIRSNLQARGKTIMSKKIAETSRADVRPKKPTGGEDPRRETRREGQKKMIALRLPRLQNARSMRWSN

SEQ ID NO: 133120 - protein, 163 aa, Glycine max
  Coding DNA Sequence Number=SeqID_41435
FEEILGCPLGGRKPYLFSGFYPSTTRVAKVVKISAQELDRVKQNRNGVVGVPRKCVLFPNMEGSVDLAAIDAFLAFHHGKESPVVAILAMYDTFDRGCEKSSARIVCCALALYVWLVSHLFLQEVTTMRGYSKEFARHGMRREERTESLGEAVMGSSAAIISG

SEQ ID NO: 133121 - protein, 126 aa, Glycine max
  Coding DNA Sequence Number=SeqID_41436
  Subcellular localization annotation: CTP_CleavageSite=58; ConfidenceScore=5.31e-01
VRACSPLEARTCSPLKVRVCSPLKARTCCPLKVRVCSPLKARTCSAPKARMCSPLKARACSVEVKLHGESKVIQRCFDDKNVITKDDDKDDDKKLKDQSKNNSSESRTIQDFKIRIKKNSRLKKKV

SEQ ID NO: 133122 - protein, 125 aa, Glycine max
  Coding DNA Sequence Number=SeqID_41437
MDAMCMIFLKSWEDCGSNAFQGYFDDAKESRVKQSFKQRFKNQVSTFKTQESSFKNQDSRIIKIKIQEEDSVKISIKKFFKTLSSTRIFHKIFYQRVLLSGNQLPEGSNRLPVASIVFQTDLQRL

SEQ ID NO: 133123 - protein, 385 aa, Glycine max
  Coding DNA Sequence Number=SeqID_41438
AADAQSLLSANGLSLAAFAPTPLWLPETASGWTLYCLDGYLVARQPDGRGALYAREMTDDDTPSTLARTLGPDAAACAAGARQWIGAVPAQWRGDAPDPVLPEAACGVMADIPWSIAAAADGHAAAGAWGWGRATALAMAAAAVWMAGLALQATRLEHGAQALRQQQAQALRQVFPSITTVVDPLAQARRQLAARRAGTGDDWRELGVPVAGGARTHGLRRGRRAGLALRGGRPGAGHAARGPSRDAGCARRRQAGGYARLGPGGAPGGLGGPGHRDRLAPAPRAGGCRGREGGTLMTLAPPPSPLGLPALWRGRWRARRQAWQARGVAAWTRLSHSEKRLLALCACVVGAALCWLAVIEPSLARIERSRQALRQLEAGARELDA

SEQ ID NO: 133124 - protein, 110 aa, Glycine max
  Coding DNA Sequence Number=SeqID_41439
MEDKVVRHVNGPLIVTKNYWATFKLDAKMRKPVVLLLVVGQPAQSASQKASSLSGWILKMLTHKVDGMSEIGSGEGHVSRVCRVGGGTGWEITSLGDEGIYCLGLDWVWM

SEQ ID NO: 133125 - protein, 165 aa, Glycine max
  Coding DNA Sequence Number=SeqID_41440
MVVIWNQSGGSVTGKVQGGGVERLQRHFIWIDHETSMGWHIVAWEILTQPNTLYAVSSTVDYDTCPICFEEPEMDLHLLRDCGQSRHGFFLGSLHQWIAKNLERGPPHWKTLFGVEQTGPVRCQCGFMQMDLMWGASVRLPTPTSLLKWRPPPSGGLRLCLGTGL

SEQ ID NO: 133126 - protein, 177 aa, Glycine max
  Coding DNA Sequence Number=SeqID_41441
  Gene Ontology: Cellular component=integral to membrane; Biological process=electron transport
  Homolog annotation: Hit_ID=A9PGK5; Match level="QueryCoverage=100%, HitCoverage=68%, E-value=8e-80, Identity=69%"; Hit description =Putative uncharacterized protein
AFYYEGKAIMSNEEFDNLKEELMWEGSSVVMLSSDEQKFLEASMAYVSGKPIMSDKEFDELKLRLKIEGSEIVAEGPRCSLRSRKLPEPFSFIFTWFAAVPLIVWIALSLTNAIVKDFVILKGPCPNCGTENTSFFGTILSISNGGSTNTVKCSNCGTAMEYDSTTRLITLPEGSNA

SEQ ID NO: 133127 - protein, 232 aa, Glycine max
  Coding DNA Sequence Number=SeqID_41442
  Gene Ontology: Mol. function=aspartic-type endopeptidase activity; Cellular component=extracellular region; Biological process =proteolysis
  Homolog annotation: Hit_ID=A7PVJ5; Match level="QueryCoverage=72%, HitCoverage=39%, E-value=7e-51, Identity=56%"; Hit description =Chromosome chr9 scaffold_33, whole genome shotgun sequence
MKDRGHCSEKKIDWNRRLQKQLILDDLRVRSMQNRIRRVASTHNVEASQTQIPLSSGINLQTLNYIVTMGLGSKNMTVIIDTRSDLTWVQCEPCMSCYNQQGPIFKPSTSSSYQSVSCNSSTCQSLQFATGNTGACGSSNPSTCNYVVNYGDGSYTNGDLGVEALSFGGTTKVYLEESLALWGWEEVTSHWYLKLMPHLEEFSHTAYQQQKLEFLPNIPFCIVRFLSSGEWK

SEQ ID NO: 133128 - protein, 89 aa, Glycine max
  Coding DNA Sequence Number=SeqID_41443
  Pfam annotation: Domain name=CCT; Domain location=42-77; Score=20.7; E_value=0.0043; Accession=PF06203.5; Description=CCT motif
MGEGCCTQPYPCICKEAVSGFEPMTNRSPRHNFTAAPGLALRSMTLLMLVRVVRYQSRKRLADQCLRVKGQFVRQVQDDHPVADVGGGS

SEQ ID NO: 133129 - protein, 591 aa, Glycine max
  Coding DNA Sequence Number=SeqID_41444
  Gene Ontology: Mol. function=oxidoreductase activity, acting on CH-OH group of donors; Cellular component=vacuole; Biological process =alcohol metabolic process
  Homolog annotation: Hit_ID=A7QKE2; Match level="QueryCoverage=90%, HitCoverage=98%, E-value=0.0, Identity=76%"; Hit description =Chromosome chr2 scaffold_112, whole genome shotgun sequence
  Pfam annotation: Domain name=DAO; Domain location=57-433; Score= -44.2; E_value=0.0086; Accession=PF01266.15; Description=FAD dependent oxidoreductase
  Pfam annotation: Domain name=GMC_oxred_C; Domain location=417-571; Score=101.0; E_value=3.6e-27; Accession=PF05199.4; Description=GMC oxidoreductase
  Pfam annotation: Domain name=GMC_oxred_N; Domain location=56-341; Score=60.3; E_value=6.5e-15; Accession=PF00732.10; Description=GMC oxidoreductase
  Pfam module annotation: Pfam domain module=DAO::GMC_oxred_C::GMC _oxred_N; Domain location=57-433::417-571::56-341
MGQLKNALVLVGCTEFQPLNLNLDFDMPDQQYDYGDPIPNYTFMHNATTAPDVSYYDYIVIGGGTAGCPLAATLSQNYSVLLLERGGSPYGNPNISDLAAFGAALSDTSPTSPAQRFISEDGVINSRARVLGGGSCLNAGFYTRASPQYVREAGWDGRVVNESYEWVEKIVAFEPQLKQWQSSVRDGLIEIGVVPNNGFTYDHIDGTKVGGTIFDQNGFRHTAADLLQYAKPTGITLLLDATVHRILFRVKDRSKPMAHGVVFRDSLGRRHKAYLKPDPRNEIIVSAGALGSPQLLMLSGIGPEEHLKAHNIRITLDQPLVGQGMSDNPMNAIFVPSPVPVEISLIEVVGITTFGTYIEAASGENFAGGSPKDYGMFSPKIGQLSTVPPKQRTPEALAKAIEVMETLDQAAFRGGFILEKIMGPISSGHLELRSRDPNDNPSVTFNYFQDPRDLQRCVQGLSTVEKIIESKAFSPFRYPNMPVPVLLNMTASAPVNLLPKHTNSSLSLEQYCKDTVMTIWHYHGGCQVAKVVDRDYKVLGVDALRVIDGSTFNYSPGTNPQATVMMLGRYMGVKILSERLGGAAAADETEQ

SEQ ID NO: 133130 - protein, 346 aa, Glycine max
  Coding DNA Sequence Number=SeqID_41445
  Gene Ontology: Mol. function=catalytic activity; Cellular component =nucleus; Biological process=regulation of transcription
  Homolog annotation: Hit_ID=A7QKD8; Match level="QueryCoverage=97%, HitCoverage=94%, E-value=2e-77, Identity=51%"; Hit description =Chromosome chr2 scaffold_112, whole genome shotgun sequence
  Pfam annotation: Domain name=TCP; Domain location=59-254; Score =145.3; E_value=1.7e-40; Accession=PF03634.4; Description=TCP family transcription factor
MDQDDDEAGTTNLSTSDADVAEKETTNNLNGVPKQNNAFEETTGFQVLPLKKEEPTYSDPDTEIVPVKLPKRSSTKDRHTKVEGRGRRIRIPATCAARIFQLTRELGHKSDGETVRWLLEHAEPAIIEATGTGTVPAIAVSVGGALKIPTTSSNSNEEAAAAAASSNKKRKRPSNSEFVDINININDAVSKSSGLAPVHVPQGLVPVWAVSNPSMVIPANTFWMIPQAATTPNPSGGVAGPASQQPQLWALSPSVFNVAARPISPLVTTNIPEARPVMTACSNGSNSAVSTSTVGAKLATKSSMAPSVSSSGTKSGKTQMLRDFSLEICDKQELQLLGRSGTHAQS

SEQ ID NO: 133131 - protein, 531 aa, Glycine max
  Coding DNA Sequence Number=SeqID_41446
  Gene Ontology: Mol. function=drug transporter activity; Cellular component=membrane; Biological process=multidrug transport
  Homolog annotation: Hit_ID=A7QKF4; Match level="QueryCoverage=86%, HitCoverage=79%, E-value=0.0, Identity=70%"; Hit description =Chromosome chr2 scaffold_112, whole genome shotgun sequence
  Pfam annotation: Domain name=MatE; Domain location=289-452; Score =156.7; E_value=6.5e-44; Accession=PF01554.9; Description=MatE
  Pfam annotation: Domain name=MatE; Domain location=64-225; Score =139.1; E_value=1.3e-38; Accession=PF01554.9; Description=MatE
  Pfam module annotation: Pfam domain module=MatE::MatE; Domain location=289-452::64-225
MRQLSPTSNPKVQDEPNMLATLIPKSPTCQQQQQMQNHHNNNNNTTHLSLSLNEAKCIANISFSMVLTGLLLYSRSMISMLFLGHLGELALAGGSLAIGFANITGYSVLSGLAMGMEPICGQAFGARRFKLLGLTMQRTVLLLLVTSCLISLFFWLNMRKILLLCGQEEDIANEAELYILYSLPDLVLQSLLHPLRIYLRSQSITLPLTCCAAVSILLHVPINYLFVSILKLGIKGVALSAVVTNLNLVWLLIVYVVVSGTHKKTWPGISRECFQGWNSWKTLMNLAIPSCVSVCLEWWWYEIMILLCGLLVNPHASVASMGVLIQTTALIYIFPSSLSFGVSTRVGNELGAGNPRRAKLAAMVGLCFSFVFGLSALAFAVSVRNVWASMFTLDGQIIALTSAVLPIIGLCELGNCPQTTVCGVLRGTARPKLGANINLGCFYLVGMPVAVWLGFFAGFDFKGLWLGMLAAQGSCMMTMMFVLARTNWEGQALRAKELTDSDSGEEKNLMEEEEQEEEGFLGSCATKEGSV

SEQ ID NO: 133132 - protein, 408 aa, Glycine max
  Coding DNA Sequence Number=SeqID_41447
DDLLKSTRKVKHKSNDDEGGVYEKSEEAEGYVKEMDQPYKNKLLSHKGAIPFSPFDGRRLVQALERVSHGDYVREASRIYDVEAKLNNIWARKGRSLSREEGGPRGKVSGDGRVKAGIVPPVRAESQVQGVKDITLNEEGVEEEEQLEPEVSQRLSSWKAKQLSFLGRVMLVKSILQALPSYAMQSAHLPRSVCDEPKDVGEFGLRPTRMVNIFYMMIVGWTLCAYRDDLWVQILRTKYECGDGIVPIIDFNRAGSNLWNDLALTTIPSYQNASMVSQYVDNHVRKTRHLTVDASSRNCGEDIEILDHIFRWCPRARVVWQWMASNGKSDVLVISRILESADVVAESMNYMKFIALDEARVQDMKKVATSVVLKDSNGKVNFYFAIDIGHCSNVIAELWAIMLGIHIV

SEQ ID NO: 133133 - protein, 45 aa, Glycine max
  Coding DNA Sequence Number=SeqID_41448
MRVWKGGKIRYEIEEKGGKITDHVIGKRGTPDEMSRDMENMNVGV

SEQ ID NO: 133134 - protein, 41 aa, Glycine max
  Coding DNA Sequence Number=SeqID_41449
  Homolog annotation: Hit_ID=A7P1S4; Match level="QueryCoverage=82%, HitCoverage=8%, E-value=2e-08, Identity=85%"; Hit description =Chromosome chr19 scaffold_4, whole genome shotgun sequence
MVMVRLNLSILEDIRDDIDLCFKLAKEEYVIILPGSIPLVT

SEQ ID NO: 133135 - protein, 149 aa, Glycine max
  Coding DNA Sequence Number=SeqID_41450
  Gene Ontology: Mol. function=RNA-directed DNA polymerase activity; Cellular component=chromatin; Biological process=chromatin assembly or disassembly
  Homolog annotation: Hit_ID=A5C0Y9; Match level="QueryCoverage=45%, HitCoverage=5%, E-value=1e-08, Identity=43%"; Hit description =Putative uncharacterized protein
  Pfam annotation: Domain name=Chromo; Domain location=9-61; Score =48.4; E_value=2.5e-11; Accession=PF00385.15; Description='chromo' (CHRromatin Organisation MOdi
MNENWQLEPEPEEALDTRKNEQGVVEVLVKWKDLPDFENSWEPVEKLRSEFPGFLLEGKKSFEGGGIDKQQIVYTRKHGKGSVGDHPTRGVTNLVGNNCERLSSSTEDQEAGDTGAWRPEGARESQKWLENEMPQEISGLELRSWTQTR

SEQ ID NO: 133136 - protein, 85 aa, Glycine max
  Coding DNA Sequence Number=SeqID_41451
METASNGTGEFLDSASRRGLPAQRHLLCCIMLCVFIHNTATRAFGDPALAIPLPKPNTLAPGTKLPPAVDKVCEPATFIVTYTKL

SEQ ID NO: 133137 - protein, 129 aa, Glycine max
  Coding DNA Sequence Number=SeqID_41452
MAAQLIHDRVVMECLEGVWETLEGNERCRFRGTIRLIATSLVHPEEPARTLQQPVEWILPTPTPCRLDLEEDPEELPPEPAMDALDLPEDDEDPLPDVDSLEDIMSASEADSTEENGPGGTVNSDDSSS

SEQ ID NO: 133138 - protein, 426 aa, Glycine max
  Coding DNA Sequence Number=SeqID_41453
  Gene Ontology: Mol. function=endopeptidase Clp activity; Cellular component=cytoplasm; Biological process=proteolysis
  Homolog annotation: Hit_ID=A5ADV7; Match level="QueryCoverage=51%, HitCoverage=75%, E-value=1e-100, Identity=78%"; Hit description=ATP -dependent Clp protease proteolytic subunit
  Pfam annotation: Domain name=CLP_protease; Domain location=230-413; Score=302.9; E_value=6e-88; Accession=PF00574.14; Description=Clp protease
  Subcellular localization annotation: CTP_CleavageSite=33; ConfidenceScore=5.36e-01
MAVVPYTTGSAPLLSPPSTSSVATKLYSGLKLQAASPFGAAKPNVTAEFYGKEKLEGLEAKIDACMEEKIECMEISMTKMLLRKVLGKHLEDEQESSNCNETMREILPEMDVIWIIISFGEILYDSKKVELPTFNEEDPAPLTLEKIMAALVAGFEKLRPAPCNIPKLTERKSKALNEDGEVIAIEVAKDNKEEPVSYFQPWRQYANHNTSMARIRMMPIGTPKVPYRTPGEGTWQWVDVWNALYRERVIFIGQEIDEEFSNQILATMLYLDSIENSKKLYMYINGPGGDLTPSMAIYDTMQSLQSPVATHCVGYAYSLAAFLLAAGEKGNRSAMPLSRVALTSPAGAARGQADDIQNEANELLRIRDYLFNELAQKTGQPVEKITKDLSRMKRFNAQEALEYGLIDRIVRPPRIKADAPRKEAGT

SEQ ID NO: 133139 - protein, 102 aa, Glycine max
  Coding DNA Sequence Number=SeqID_41454
  Gene Ontology: Cellular component=membrane; Biological process =intracellular signaling cascade
  Homolog annotation: Hit_ID=A7QYS5; Match level="QueryCoverage=82%, HitCoverage=60%, E-value=4e-25, Identity=64%"; Hit description =Chromosome undetermined scaffold_254, whole genome shotgun sequence
  Pfam annotation: Domain name=Cornichon; Domain location=3-100; Score =42.0; E_value=2.2e-09; Accession=PF03311.5; Description=Cornichon protein
MADLFTWLISFFILIALIVLVIYQLMCLADLEFDYINPYDSSSRINKVVLPEYIIVGVLCGFYLVTGHWIMSLICAPYLYYNVRFVTAQEKSNLLMAQDKPI

SEQ ID NO: 133140 - protein, 583 aa, Glycine max
  Coding DNA Sequence Number=SeqID_41455
  Gene Ontology: Mol. function=receptor activity; Cellular component =membrane; Biological process=Golgi organization and biogenesis
  Homolog annotation: Hit_ID=A5AZC7; Match level="QueryCoverage=100%, HitCoverage=70%, E-value=1e-177, Identity=59%"; Hit description =Putative uncharacterized protein
  Pfam annotation: Domain name=COG2; Domain location=1-583; Score =383.6; E_value=3.1e-112; Accession=PF06148.2; Description=COG (conserved oligomeric Golgi) complex component, COG2
MEERIQNASLTVYASLGHCFVNGLENRDATAIFNCLRAYAAIDNTKNAEEIFRATVVAPLVQRIIPHGSSAVVAGSSGDGLENDYQLIKECIDKDCKFLLEISSAENSGLHVFDFLANSILKEVLSAIQKGKPGAFSPGRPTEFLKNYKSSLDFLAYLEGYCPSRLSVAKFRSEAIYTEFMKRWNIGVYFSLRFQEIAGSLDSVLTTSSLVPVLNSDAGEANYQGLTLKQSVTLLESLRSCWREDVLVLSCSDRFLRLSLQLLSRYSSWLSSGLTARKNHNTSTSPGCEWAVSAVIDDFIFVIHDIRYLEEQVRGDYLQHVLKLLSSCSPDVLEPIRQSILLGGQSLKSLEPLVIKAVVESLVEKSVEDLRQMKGITATYRMTNKPLPVRPSPYVSGVLRPLKCGVRSPYVVARGPQVYPSNLSQQLVSESMVQVGDRLRRVCKYRRWPEWLAVQRAPQAFLDGERATRYLASEIRNKILLCAATEITDRYYELASDLVSVARKTESSLQKIRQSAQRRAGASSDISDNNVSDTDKICMQLFLDIQEYARNLSALGVEAVNIASYRSLWQCVAPADRQNTINL

SEQ ID NO: 133141 - protein, 70 aa, Glycine max
  Coding DNA Sequence Number=SeqID_41456
MEGKKGQRLSPPLPNHNNHLQGDTKRENQKNTGNFPLFPHTKGKIHTWRTRRATVTATSHRRHHRHTYCM

SEQ ID NO: 133142 - protein, 206 aa, Glycine max
  Coding DNA Sequence Number=SeqID_41457
  Gene Ontology: Mol. function=protein serine/threonine kinase activity; Cellular component=cytoplasm; Biological process=protein amino acid phosphorylation
  Homolog annotation: Hit_ID=A7QBS4; Match level="QueryCoverage=99%, HitCoverage=35%, E-value=1e-68, Identity=53%"; Hit description =Chromosome chr1 scaffold_75, whole genome shotgun sequence
  Pfam annotation: Domain name=Pkinase; Domain location=1-188; Score= -1.7; E_value=1.6e-08; Accession=PF00069.16; Description=Protein kinase domain
  Pfam annotation: Domain name=Pkinase_Tyr; Domain location=1-184; Score=-166.0; E_value=0.03; Accession=PF07714.8; Description=Protein tyrosine kinase
  Pfam module annotation: Pfam domain module=Pkinase::Pkinase_Tyr; Domain location=1-188::1-184
MSSLREVNIFLSFNHPSIMNVKEVVVVDDFDGTFMVMEHMEYDLKGLTEVKKHPFSMSEIKSLVRQLLEGVKYLFHVGAPEILLGAKEYSTAIGMWSVGCIMAELIAKETLFRGKSELEQLDKIFPTLGTPDEKIWPGLFKLPGAKANFVKQLFNTLRKKFPAASFMLLTYDPEKRITAEDALLHDWFHEAPLPKSDFKPIFPSWQ

SEQ ID NO: 133143 - protein, 244 aa, Glycine max
  Coding DNA Sequence Number=SeqID_41458
  Gene Ontology: Mol. function=malate synthase activity; Cellular component=glyoxysome; Biological process=tricarboxylic acid cycle
  Homolog annotation: Hit_ID=P45458; Match level="QueryCoverage=98%, HitCoverage=100%, E-value=5e-52, Identity=67%"; Hit description =Malate synthase, glyoxysomal
  Pfam annotation: Domain name=Malate_synthase; Domain location=26-234; Score=-178.5; E_value=4.8e-09; Accession=PF01274.13; Description =Malate synthase
CNIGTYGYPTPAVKKIESYYDVPEGVDIRGRYNAEFAKILTKDALKFVAELQRALPGFDPATRYIREQEWVCAPVPPADALSPSWKNPMRGQVKLKDAVAGTISLHDKVRNRDYKLNDQTTKLFVQPRGQAERSEGSGLIPTCMKVFNNNMGNAPNLMEDAATAEISRVQNWQWLKYGDGLGVKIEEMHRIEKEVGTYKFMKGMYKEACKIFTRQCTSPSLDDFLTLDAYNYIVLHHPRETSKL

SEQ ID NO: 133144 - protein, 189 aa, Glycine max
  Coding DNA Sequence Number=SeqID_41459
  Gene Ontology: Mol. function=DNA binding; Cellular component=nucleus; Biological process=embryonic development ending in seed dormancy
  Homolog annotation: Hit_ID=A7QC14; Match level="QueryCoverage=74%, HitCoverage=21%, E-value=3e-43, Identity=58%"; Hit description =Chromosome chr10 scaffold_76, whole genome shotgun sequence
MGMGMRIAKSGFEANVASEPEEKFGFQSGSDFTLKEFQQYANVFKDFYFGLNDANEYEKQPIDEVEVYYEADLETRSLGSGFPKTSSLTKNESDRYALSGWNLNKFPRLPDSALCFEGSDISGVVVPGLYDGMCFPSFCWAYLDVDGGAQPNARPQCRQSKAPKHNARTNKGMKKKTTTQEEAERPNKR

SEQ ID NO: 133145 - protein, 67 aa, Glycine max
  Coding DNA Sequence Number=SeqID_41460
  Subcellular localization annotation: CTP_CleavageSite=14; ConfidenceScore=5.39e-01
MVPMVVALSARPCHVAMVSPFPPATLLFPTWRWSRHSSWRFGHGRGANQSGVLLCPRVAARLQVAGT

SEQ ID NO: 133146 - protein, 218 aa, Glycine max
  Coding DNA Sequence Number=SeqID_41461
MPYKSWPPLASRCIRVVVDESELGSEGNKPRGLGKLRSTDKTGGSTARAATARARHNILKVFRLERMFRRKKRNEIRIRPLKTLRELLGAPSNIAGAPSNLLKAFLLSSLFREKAFCLLLFFSARLLRLHLLREACLPFAFEDAGKNGGSLVTVSLPEDPLGVLPELPEEDLPEDFRKKGSSVGNETTSGRTDLPETLGTPLPECFRKMYLFRKHSGR

SEQ ID NO: 133147 - protein, 173 aa, Glycine max
  Coding DNA Sequence Number=SeqID_41462
  Gene Ontology: Mol. function=transporter activity; Cellular component= integral to membrane; Biological process=transport
  Homolog annotation: Hit_ID=A3F570; Match level="QueryCoverage=32%, HitCoverage=19%, E-value=3e-18, Identity=78%"; Hit description =Aquaporin
  Pfam annotation: Domain name=MIP; Domain location=73-173; Score= -118.0; E_value=0.045; Accession=PF00230.11; Description=Major intrinsic protein
MAAELGQQKVELSTLVTRAANDKSSDLLASLTYISIIMKSWKVLRQRHNVFLRGKCLKLYIKKKNSELLLKGNASKIDVSHYFVSLCVWKHSANVINHIHQKQLEVTSTLCKFSNAGGHINPAVTFRLFLERKLSLTRAIFYIIMQCFGAICGAGVVKGFEPHLYENTPLTYK

SEQ ID NO: 133148 - protein, 78 aa, Glycine max
  Coding DNA Sequence Number=SeqID_41463
MAFPYMDAAITFHGEPYAPAHEETGRQSPQCPFIIFRSPQWVFFAFNESLDIEIPRLTVSFLFHLTTMFGSATTPEFN

SEQ ID NO: 133149 - protein, 204 aa, Glycine max
  Coding DNA Sequence Number=SeqID_41464
MAFLGETSNQTIMNSTLAFIFPNGSIVHNDNGVYFQSSTLVPFRVPNVCDFQTLKTRIHNTLQLTNEQYLDEIYYRQPFIDTGNHLRFQCMQLKNDDDVNTMLLCNNQFSCVGPIELLCTIGRTPDGILNLLEATMTPTHDALLYYNGRWNMPCQNDFVSYSFTEKNPKKFDIPSGCTMDELKDLIIQLAPQGIPPYGIHQIQT

SEQ ID NO: 133150 - protein, 221 aa, Glycine max
  Coding DNA Sequence Number=SeqID_41465
AAFLNDVRATLAGVKDATVRVRAVYQGRAGRVEIGLSGSHFMGPVPTLIAHHAASHPQVSVLLNRDEPGGAAGGAARPPHRRQHLAHRGRRRRTAIVGAVVRSGGGGAARRPSPGGAQAPGPGRPGARRIRDAAHGHLGVRPRAGRHLRPRRPGAVGGAARGRSAGATGAGGGRAGRGAGAAVDLRSLRRAHRGVRAAGRGGQRHGLRGHAARRRQPRAAG

SEQ ID NO: 133151 - protein, 138 aa, Glycine max
  Coding DNA Sequence Number=SeqID_41466
MNEMKMKAKKTRNELKVSDSKTYPLKNEERTKNGEERRKTFTDLLTETSRKRYGGTSAWIFFTETIFFHPKQLKCIAKGVRDIWNSLPSPIYRKRGEEVAAQLAEASWVASSISNPASKLFWKAQITKFENFYLQPQS

SEQ ID NO: 133152 - protein, 184 aa, Glycine max
  Coding DNA Sequence Number=SeqID_41467
  Homolog annotation: Hit_ID=A5C169; Match level="QueryCoverage=82%, HitCoverage=13%, E-value=6e-07, Identity=28%"; Hit description =Putative uncharacterized protein
MTGRILAISLAFESRILHYLIVHILLPRSSNLAQVSEEDLIVMWAFHKGLQIDWAHLVRYRMHKALRLNAPLPYPHVITLFLQHFNIPLDSEPYVPIKRSFLIGASVIASFSYIKEHDGSWVKKGARNVGEERHEGEDSSLLSKILERFDGLQTFVGERFDTLELQVDMRFNEMESRMTKVEED

SEQ ID NO: 133153 - protein, 170 aa, Glycine max
  Coding DNA Sequence Number=SeqID_41468
MVQKKEKELRGSNNGPIGGYHRWLKAYTQGLNWLPNLRTTKGVEVEAPEEDEEVQALRENAELRDVNTATTKALEQETKRAHREEHGWNKFRGALCGSNSELKLRREERDQSRVDSLILKDELKVCLRSKRSLSQWLCETETNMLAIINKYQEELNLAMAHEHKVADEYA

SEQ ID NO: 133154 - protein, 166 aa, Glycine max
  Coding DNA Sequence Number=SeqID_41469
  Subcellular localization annotation: CTP_CleavageSite=60; ConfidenceScore=5.01e-01
MKQANVTQLKKTLKKVHDMGNQQQQGNQFNKDQGGPSNRPIQQGLNISQRTTKLEETLTQFMQVGQLAKQITDKLSNSFVANTEKNPKEECKAVMTRSKRFVENEEEKSVGLKKKVVEEKGIDGRKNDVRGENNQEKEKQIMVNKKELNDQEKEKEVEKEKENKKS

SEQ ID NO: 133155 - protein, 106 aa, Glycine max
  Coding DNA Sequence Number=SeqID_41470
MCGSSDFQDYFDDAKESRLQESSLKESRFKNNQDQDSRLKIQDSREEIEKQQSRLHKGSIFQNSKYSTVEAKLHGESKMMTKEMTKSSKINQRTTQVNQEQLKSSR

SEQ ID NO: 133156 - protein, 189 aa, Glycine max
  Coding DNA Sequence Number=SeqID_41471
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLDQTIGALNLMGMQAWHWPSFYNVVTGKTLALPNLIALQHIPLSPAGVIAKRPAPIALPNSCAA

SEQ ID NO: 133157 - protein, 280 aa, Glycine max
  Coding DNA Sequence Number=SeqID_41472
MADHVRGGADAVRRGRAGGRQRIADALDLVGGGQAGRDRRAHRARHHVRADLAHTTFAQQAGAQVADLLGAEPGIGDGIAHGQVGEGRRIAHEALLLAVDQAPPDRGRHDRRPGCAARFGMVARAVDFAIIHVHAGVRLGHHQLAVDDPADVDLVAHQLGVRQYLAGELYLAAAQCAALAGGAQPGQEEAGQLPHGVQAQAAGHHRVADEVAAEEPQVRADIQLGAYHALAVRSAVLVDVGDAVEHQHRIVGQTAGSGAEQFTACAGQQLFAVERVEFLS

SEQ ID NO: 133158 - protein, 92 aa, Glycine max
  Coding DNA Sequence Number=SeqID_41473
MLNQNNVPKSYTVIYKTKVERKDIELVDEEETQIGVDRSSATSNKCEIYKEEARNAAQKHKPKRVKSVNADAEAFDDHWKIQIALCILKPKH

SEQ ID NO: 133159 - protein, 95 aa, Glycine max
  Coding DNA Sequence Number=SeqID_41474
DAGSRQARQGASAGVGGCRGWLNYAASEQIVLRVHHMRAIGAGLFAITPAGERGMCCKAIKLGNARVFPDLGEIRDVRNMDLTAIIAQPVIGYPC

SEQ ID NO: 133160 - protein, 37 aa, Glycine max
  Coding DNA Sequence Number=SeqID_41475
YMMNSVITVLYFNGRVYEDNDGVIFEGSKKPIQSGIL

SEQ ID NO: 133161 - protein, 104 aa, Glycine max
  Coding DNA Sequence Number=SeqID_41476
MYIKYGPKYIMKHSQQNMLSNETKTPTLIPKTIPKLQNSLRIWKGKQGSKGLSKELIQGKSIWLEAYENQIASIISKYACELGSINKNQAKAIVQAINGAKHTK

SEQ ID NO: 133162 - protein, 89 aa, Glycine max
  Coding DNA Sequence Number=SeqID_41477
MSYFGVIQEIWEVDYTSFRVPVFKCQWVNGTTGRPSGMNYHNDESTLDIGQMSSFSKQLPSMNEADEVDDGHANRVDHDEGLWENIPTG

SEQ ID NO: 133163 - protein, 152 aa, Glycine max
  Coding DNA Sequence Number=SeqID_41478
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=74%, E-value=9e-25, Identity=67%"; Hit description=LacZ protein
MLARSLDSAIAVTFGFHCLLKHLNTFLISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133164 - protein, 124 aa, Glycine max
  Coding DNA Sequence Number=SeqID_41479
  Homolog annotation: Hit_ID=Q84VH5; Match level="QueryCoverage=64%, HitCoverage=11%, E-value=1e-25, Identity=76%"; Hit description =Envelope-like protein
MKRESPLSLHYKLFEGTHVPDIVSTSGKAAASGAVSKDTLIAELKDTCKVLEATIKATTEKKMELERLINRLSESGINDGEAAEQEDEAAEEEVEAAEEEEEAAEEEEDAAEDTESDDDSEATP

SEQ ID NO: 133165 - protein, 65 aa, Glycine max
  Coding DNA Sequence Number=SeqID_41480
CNQETGCLLDCENCNQETGCLLDGENLEHKGEGSQGVFKVYKGFTERVENLKWIARGLDVGTGSG

SEQ ID NO: 133166 - protein, 153 aa, Glycine max
  Coding DNA Sequence Number=SeqID_41481
  Gene Ontology: Mol. function=catalytic activity; Cellular component =chromatin; Biological process=auxin mediated signaling pathway
  Homolog annotation: Hit_ID=P33079; Match level="QueryCoverage=60%, HitCoverage=100%, E-value=3e-43, Identity=94%"; Hit description =Auxin-induced protein 10A5
  Pfam annotation: Domain name=Auxin_inducible; Domain location=24-114; Score=163.3; E_value=6.3e-46; Accession=PF02519.5; Description=Auxin responsive protein
MPEQTLGCQVGNLVATNSEGEKIMGFRIVGIVRWTSFSTTQAASKRVDVPKGYAAVYVGDKMRRFTIPVSYLNEPSFQELLSQAEEEFGYHHPMGGLTIPYKEEEFLNVTAHLNELKFMLTETDRLDEANLYRWHFLFCTEFKTCWLNTKDIL

SEQ ID NO: 133167 - protein, 222 aa, Glycine max
  Coding DNA Sequence Number=SeqID_41482
  Subcellular localization annotation: CTP_CleavageSite=22; ConfidenceScore=5.12e-01
MRSDCLVQFSILYLFRSPMNCVFVHVSSSFEFGAMRSDCLVQFSILNPFSKPMNCVFIHESSTFEFGAMCSDCLVQFSILNLFRSPLNFVFVHESSTFEFGALRSDCLVQFSILNLFRSPMNCVFVHVSSTFEFGAMRTDCLVQFSILYLFRSPMNCVFVHVTSSFEFGAMRSDCLVQFSILNPFSKPMNCVFIHESSTFEFGAMCSDCLVQFSILNLFGAP

SEQ ID NO: 133168 - protein, 130 aa, Glycine max
  Coding DNA Sequence Number=SeqID_41483
FVLYQNREPSWKIPLRLKGSSRCGVSMENNGGLWWLLVAVDDGERSWNVGNDFGRKKEKKWHFSKATRKAKAETLKCFCLRERKRSSHARRHIEDRNGQVVDICPVNLQTNFKKIQQLAKDGQHFYRDNF

SEQ ID NO: 133169 - protein, 174 aa, Glycine max
  Coding DNA Sequence Number=SeqID_41484
  Gene Ontology: Biological process=transposition, DNA-mediated
  Homolog annotation: Hit_ID=Q1J7G7; Match level="QueryCoverage=18%, HitCoverage=47%, E-value=2e-11, Identity=96%"; Hit description =Transposase
MCRNCRKSSWYHSRAMKTFQFAHGKRCNKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 133170 - protein, 74 aa, Glycine max
  Coding DNA Sequence Number=SeqID_41485
MAYGSPYLQMRCFKWSQDVYSTHGEGPRGAQTMKVVRRSVWHVYKLLTSASSGKVKGVWLECWPVVASSQRFGG

SEQ ID NO: 133171 - protein, 168 aa, Glycine max
  Coding DNA Sequence Number=SeqID_41486
MRTLKGRRGERFHVNGTCTWPAHPGNGSAGGRVQRLEEHRTSRGVRCAPRRPLKIRRTECLPRPVVLITASGLQGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 133172 - protein, 190 aa, Glycine max
  Coding DNA Sequence Number=SeqID_41487
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPDFNQLSIMLSSCMQAWHWPSFYNVVTGKTLALPNLIALQHIPLSPAGVIAKRPAPIALPNSCAA

SEQ ID NO: 133173 - protein, 176 aa, Glycine max
  Coding DNA Sequence Number=SeqID_41488
  Subcellular localization annotation: CTP_CleavageSite=69; ConfidenceScore=5.86e-01
MGSPLASTTPPPPPPSPSPPRPSLTSDASASMSAVKRKRKASRLRSLSTRPPGVERPVVHVDPATGKADGSHRKKLRTYLGIVARDKVDITYENWKEAEFDIPEASDNRTKRKLLQTVGERWRQFKSGLTRKWALAANQDGVEDTVCDKYGINKEKWAQFCQTHRDPSWEVRSFAI

SEQ ID NO: 133174 - protein, 437 aa, Glycine max
  Coding DNA Sequence Number=SeqID_41489
  Gene Ontology: Mol. function=aminoacyl-tRNA ligase activity; Cellular component=cytoplasm; Biological process=arginyl-tRNA aminoacylation
  Homolog annotation: Hit_ID=A7MKS3; Match level="QueryCoverage=93%, HitCoverage=58%, E-value=0.0, Identity=85%"; Hit description=Glycyl -tRNA synthetase beta subunit
  Pfam annotation: Domain name=tRNA_synt_2f; Domain location=1-333; Score=400.9; E_value=2e-117; Accession=PF02092.8; Description=Glycyl- tRNA synthetase beta subunit
PKIKADAEAAAQQLGGKADLSDSLLEEVASLVEWPVVLTAKFEEKFLAVPAEALVYTMKGDQKYFPVYAEDGQLLPNFIFVTNIESRDPQQIIAGNEKVVRPRLADAEFFFNTDRKKRLEDNLPRLETVLFQKELGTLRDKTDRIQALAGWIAAQIGADVNHATRAGLLSKCDLMTNMVFEFTDTQGVMGMHYARHDGEAEDVAVALNEQYQPRFAGDDLPSSPVACAVAIADKMDTLAGIFGIGQHPKGDKDPFALRRAALGVLRIIVEKNLPLDLQTLTEEAVRLYGSKLSNASVVDDVIDFMLGRFRAWYQEEGHSVDTIQAVLARRPTRPADFDARMKAVSHFRTLEAASALAAANKRVSNILAKATETLNDSVQASLLKENAEIPGDLCHRAGRQAAAVRLRKQPLSGSPWWSWHSCAKRWITSSTRHGECR

SEQ ID NO: 133175 - protein, 123 aa, Glycine max
  Coding DNA Sequence Number=SeqID_41490
RQAQGDAPQAADAPPPHQTGPVGSFDTEQYLQHLVRQQAANHRAHVQTHDCLYQLSLSLQSQGFTSFPCPTPDQFRAEVAWPGDWPEARAGGAPAEAPDEADKAREDEEMTDLLDFLRGSGAT

SEQ ID NO: 133176 - protein, 28 aa, Glycine max
  Coding DNA Sequence Number=SeqID_41491
LFFNSGNWSDSDDLDRTGLSCRTIMRNR

SEQ ID NO: 133177 - protein, 116 aa, Glycine max
  Coding DNA Sequence Number=SeqID_41492
CDDWRCHFKNKEIHDKLSVAKPSVASYLRQEIQPEQEADRVHGLPAQPPVKFNNMVVISLSMKLKEEHCSIGFLRPLTNQNKNPLTYGSMENHKPEGQEVSTAGVNIDNHMNEGSG

SEQ ID NO: 133178 - protein, 107 aa, Glycine max
  Coding DNA Sequence Number=SeqID_41493
MTGPLDESISCFLIKVDPWVLVPITFRGLYVLTIRGLHILACRGLHALAFRRLRVLVFRASSFLLSVPGPPPDIRGRPTVRAHPEREAIMHLLCIPGQDFTRAAAKR

SEQ ID NO: 133179 - protein, 110 aa, Glycine max
  Coding DNA Sequence Number=SeqID_41494
MACRPRLTKGAEDDVSLCVLSGFSSYRQQKRMIYTDNHSGISARQRDSNVSDDRSYSKKNVYTDNHSGISARQRDSDVSMTDLVSAKDDVNLRVSTGLSATIDEECRRRR

SEQ ID NO: 133180 - protein, 307 aa, Glycine max
  Coding DNA Sequence Number=SeqID_41495
  Gene Ontology: Mol. function=aminopeptidase activity
  Homolog annotation: Hit_ID=A8GE73; Match level="QueryCoverage=100%, HitCoverage=96%, E-value=1e-153, Identity=79%"; Hit description =Putative uncharacterized protein
MAVNQSQLGQMFEQVLRLSKVDASQSVAILKSHYSDARTVQAATDAALRLGAKVYCIELPAFNHPTAMGNDMTAYCGDTALTGNIAAQRALEPADLIVDTMMLLHSPEQEQILKTGTRILLAVEPPEVLARIDFRAPLGQYPTVTEYGYADEPGRWDHWPSGFLFTWPNEDQAEGVLVLDVGDILLPFKSYARERITLEIEKGFVTRIHGGFEAEYLRDYMRYFNDPEVYGISHIGWGLQPRAQWTAMGLHDKNDGMCMDARAFYGNFLFSTGPNTEVGGKRKTPCHMDIALRRCDIKVDDLLVVAE

SEQ ID NO: 133181 - protein, 189 aa, Glycine max
  Coding DNA Sequence Number=SeqID_41496
  Homolog annotation: Hit_ID=A5AZG1; Match level="QueryCoverage=50%, HitCoverage=30%, E-value=6e-08, Identity=34%"; Hit description =Putative uncharacterized protein
  Pfam annotation: Domain name=zf-CCHC; Domain location=116-133; Score =14.6; E_value=0.0095; Accession=PF00098.14; Description=Zinc knuckle
MSHHSSSVNGEGGICHILELTPIGEKRERNPQEANINLLYFHGKDNVEANLDWEIKVEQQLKRKSTSKSYGSHSYPMKDQGQGILVVTPSKPKDDKGKTIEKQPLKASMQEKTSSMKCFKCLGRAHITSQCPTKKTMIMRGQDIYSSQDEATTSPSSSESEEAKWEESSEEIYPQEEGQPLMVKEECKE

SEQ ID NO: 133182 - protein, 121 aa, Glycine max
  Coding DNA Sequence Number=SeqID_41497
  Subcellular localization annotation: CTP_CleavageSite=22; ConfidenceScore=5.28e-01
MAQLLCTPGQDFAQTATGRRVRIMRTSMTTLTRTWRTLLVSNVLPSDHNSDLPLPKCMPPTKHPLDLDKSNRALGFPTLITGLCQSFGVLVTPSKVQGNAPQVADTPPPPHQADPAGSLGM

SEQ ID NO: 133183 - protein, 184 aa, Glycine max
  Coding DNA Sequence Number=SeqID_41498
PILEEVPQMLYLECDPIPKAVENEDDLDYVPVADHEEGNVGTGEHVGAGEQRHAGEQRDADVGEQKDGGEHRDADAGEQRDGGEQRDADADGGGEERAVGDSEEEKEVDSDEWFTNFSCMMNEVKAEVETDGYHSEELNIPISSDDEDEDVEGVQVGRKNDNRGLEAKCKKGILVIGKIYCGKE

SEQ ID NO: 133184 - protein, 200 aa, Glycine max
  Coding DNA Sequence Number=SeqID_41499
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPVKLQTLRRQYELLQMSDQGYRARIRNHGHSCFLRETCRASCINESANARGEAVCVLGALPLPRSLTRCARSFGCGERYQLTQRRSFAPSWAVCTNPPFSPTAAPYP

SEQ ID NO: 133185 - protein, 23 aa, Glycine max
  Coding DNA Sequence Number=SeqID_41500
VNRFKEPYLKDVETQHSDRMWHW

SEQ ID NO: 133186 - protein, 283 aa, Glycine max
  Coding DNA Sequence Number=SeqID_41501
MTLNQFYGRATRTSSSSSATVMQQQWVDFIGNIKEQVRNEYEEQHKRSLEEFKKELSSQIFIQLSQMGSQYSPLIEEDLQALAARLSTKGSNVETADVDPSGDKNKVTPKCPSRHQRFNMSSRDLQTFIAWPTNLAKKVSHEESDTSPKKLPETDERGTNDFDHDPLRQLIKSLYFMYDTLVELKWDGSKFGLSNVDASFFLTFSDVNEIVAGYKCLNISILQLWMLFLDEWSSTLGHASVYGFLEPQSIHNAKDRRAECEHYLQAWLKESQREVYLGAYLNQ

SEQ ID NO: 133187 - protein, 128 aa, Glycine max
  Coding DNA Sequence Number=SeqID_41502
  Homolog annotation: Hit_ID=Q2A9E0; Match level="QueryCoverage=50%, HitCoverage=4%, E-value=2e-09, Identity=47%"; Hit description =Putative uncharacterized protein
  Pfam annotation: Domain name=DUF889; Domain location=2-127; Score= -133.8; E_value=0.021; Accession=PF05970.5; Description=Eukaryotic protein of unknown function (DUF889)
TATFAKWILDIGDGIIGHENDGYATIEIPAHLLITEYDDPISAIVKSTFPDLDQHHNNPQFFISRARLTGALSKGGKMRGVATNVYLWKTTEKLKETGQNENSKFGSCILGELEVMFVIGSAVDRLCG

SEQ ID NO: 133188 - protein, 21 aa, Glycine max
  Coding DNA Sequence Number=SeqID_41503
MANIFPSKQMKTCRYQPKHNF

SEQ ID NO: 133189 - protein, 85 aa, Glycine max
  Coding DNA Sequence Number=SeqID_41504
  Subcellular localization annotation: CTP_CleavageSite=50; ConfidenceScore=5.14e-01
TYQGNPCGIYPDLSSFIGSGVYPDLSSFTGSGVYPDLSSFTGSGVYPDLSSFTGSGVYPDLSSFTGSGLYPDLSSFTGSGVIQPP

SEQ ID NO: 133190 - protein, 122 aa, Glycine max
  Coding DNA Sequence Number=SeqID_41505
  Homolog annotation: Hit_ID=A5B939; Match level="QueryCoverage=48%, HitCoverage=37%, E-value=9e-09, Identity=54%"; Hit description =Putative uncharacterized protein
KGSRQNGSVTSGKGWALRAGHGGPSPEPVGCRWTARDASAARAGRREPVGGRIGNGPFGASSPGVEQSTQNWYGQGESDCLIHSIAMVPADVDAIETTAKGTGLAESAGKEDPVELDSSPTL

SEQ ID NO: 133191 - protein, 257 aa, Glycine max
  Coding DNA Sequence Number=SeqID_41506
  Gene Ontology: Mol. function=N-acetyltransferase activity; Biological process=metabolic process
  Homolog annotation: Hit_ID=A6T5S4; Match level="QueryCoverage=98%, HitCoverage=88%, E-value=1e-115, Identity=75%"; Hit description =Putative acetyltransferase, GNAT family
  Pfam annotation: Domain name=Acetyltransf_1; Domain location=50-132; Score=28.7; E_value=2.1e-05; Accession=PF00583.15; Description =Acetyltransferase (GNAT) family
  Pfam annotation: Domain name=FR47; Domain location=49-140; Score= -6.1; E_value=0.051; Accession=PF08445.1; Description=FR47-like protein
  Pfam module annotation: Pfam domain module=Acetyltransf_1::FR47; Domain location=50-132::49-140
MTAMHYKLVKQLKDDNTLRKSFIDLAIKTFDLSFDAWYQQGYWSESYIPYAFVDKNKVIANASANIIDLVWQGQPRRYIQIGTVMTNIDYRNKGLAGQLIQHILDDWRDKADAFFLFANSTTVDFYPKFGFTRTDEYQYVAPVSPTPGDFRKLDMDSAQDIALLKHYYQKSNPFSQLRVENNFGLLMFYCSAFMKHFVYYSEKNQAVAIAMQSAHELICFDIFCDAGQSMATIINELAQPQSQQAVLGFTPKEARLG

SEQ ID NO: 133192 - protein, 281 aa, Glycine max
  Coding DNA Sequence Number=SeqID_41507
  Gene Ontology: Mol. function=cytochrome-c peroxidase activity; Cellular component=periplasmic space; Biological process=electron transport
  Homolog annotation: Hit_ID=A6END5; Match level="QueryCoverage=100%, HitCoverage=45%, E-value=2e-89, Identity=56%"; Hit description =Possible cytochrome C peroxidase
  Pfam annotation: Domain name=CCP_MauG; Domain location=1-131; Score =10.8; E_value=4.5e-11; Accession=PF03150.5; Description=Di-haem cytochrome c peroxidase
MSCATCHLPENAFTDLKAKSPSNVEGKTVLRNSPSLYNAVFAKRFFYDMRAFYIEQQAEHVIYNEQEFNTSYESIIKKLKEKPEYKRAFRTAFKDGKISKENFSKALSSYVASLYSFESDFDRFMRNEKEISDDAKKGFNLFMGKANCATCHFAPHFSGLVPPFYNENESEVLGVTKAPISKLPLELDSDLGRVKSPVKKENSWIYENSFKTMTVRNIALTKPYFHNGAFNTLEEVLDFYNEGGGEGLGLKINNQTLPADKLNLTETEMKQIIAFLNALTD

SEQ ID NO: 133193 - protein, 146 aa, Glycine max
  Coding DNA Sequence Number=SeqID_41508
MGHPSKKLLLFYFLRASVQNFEHLDILRDTIGYPKLLFLNFKHLDILRDTIEHPSKKLLSIDFYLRASVLNFERLDILRDTMGHPSKKLLSFYFLKASVQNFEHLDILRDTIGHPSKKLLSFDFAQRFYSEFQASRYTTGHNRTIR

SEQ ID NO: 133194 - protein, 154 aa, Glycine max
  Coding DNA Sequence Number=SeqID_41509
MSHHSSSVNDEDTSHKDPLSRILNELSSLKLWKEKLERKEKVKKREEINQDEREQIREEKRRKIIKELRKEKHASCSSHDSCKSLSEELHDYYEGRHRSRLRPHFHMREKERKPQEAKINLPYFHGKYNVEAYLDWEMKVEQLFACHHISEERK

SEQ ID NO: 133195 - protein, 15 aa, Glycine max
  Coding DNA Sequence Number=SeqID_41510
MQFSEDEDLPWVATR

SEQ ID NO: 133196 - protein, 42 aa, Glycine max
  Coding DNA Sequence Number=SeqID_41511
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=76%, HitCoverage=2%, E-value=9e-09, Identity=84%"; Hit description=CjMDR1
MKECSWLDMLDISFFDKETNTGEVVGRMSGDTLLIQEALGEK

SEQ ID NO: 133197 - protein, 186 aa, Glycine max
  Coding DNA Sequence Number=SeqID_41512
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPSNQAVDMTESIGLTNLKATPLEVLLTPRMQAWHWPSFYNVVTGKTLALPNLIALQHIPLSPAGVIAKRPAPIALPNSCAA

SEQ ID NO: 133198 - protein, 181 aa, Glycine max
  Coding DNA Sequence Number=SeqID_41513
MLHLHHQMILFDLSTHLIQIVNILLIRGLSFVHINDRVIRAKFDEPTANWLKVLVDLHDRWFGEFKYRWYPTEKRAIRGVFETKGSRILKNAMNKIKNGQDKGKWIPANVRALPWTNIGGSTDFLNKSSIAKANGTVNRGALTYWVVPYLLQLTLKREISTSSRENPTTFDRGRHIYTGFP

SEQ ID NO: 133199 - protein, 67 aa, Glycine max
  Coding DNA Sequence Number=SeqID_41514
  Subcellular localization annotation: CTP_CleavageSite=37; ConfidenceScore=5.41e-01
MALKKLSAKRSRRDAADEGTSAAPSLIATVSRAPSTSSASRPSKDGRSTERGASSSGRMSTQIFRRR

SEQ ID NO: 133200 - protein, 122 aa, Glycine max
  Coding DNA Sequence Number=SeqID_41515
  Homolog annotation: Hit_ID=UPI0000ECBAF8; Match level="QueryCoverage =33%, HitCoverage=48%, E-value=1e-16, Identity=100%"; Hit description= UPI0000ECBAF8 related cluster
  Subcellular localization annotation: CTP_CleavageSite=21; ConfidenceScore=5.30e-01
RKRKSAQYANRLSPRVGRFINAAGTTGFPTGKRARKRALSEACGALSEHVSRLMHRLSALSSQGTLSEMGMQAWHWPSFYNVVTGKTLALPNLIALQHIPLSPAGVIAKRPAPIALPNSCAA

SEQ ID NO: 133201 - protein, 68 aa, Glycine max
  Coding DNA Sequence Number=SeqID_41516
MGSEIYLEVHENPRAFFSNSSPILLGVGLHHPLPFGKDLTSNPKSRVRFENPFPRHLPMREHGSSPTQ

SEQ ID NO: 133202 - protein, 54 aa, Glycine max
  Coding DNA Sequence Number=SeqID_41517
MSMHAYAFLSSYESEDKQRFGRYHTEFKAKARDQHIIIPHLAQDVKEALLGGSL

SEQ ID NO: 133203 - protein, 253 aa, Glycine max
  Coding DNA Sequence Number=SeqID_41518
CRDRFPACAGPRPGADPGGPGGGGRVARHRGARAASGYVPTFGARLRAPVPGQHLHRGQRLQPPGVAGLAGGPPGRRLPRGLARRAAAPGRAAVLGAAAAERGLAAVGHLRGPFHPYQIGLRLAAGRVAQRGRVAHGAAPHGPGAGHAHRQLRPSLWLCAAARDHRRHAQRPGHGSRRVAGAADPGRDARPGHGDPHAAASRRHRAGRATRLRQPAADAAPGRAARGAGGAYAGRAGLQEALEQAASQHRPRA

SEQ ID NO: 133204 - protein, 103 aa, Glycine max
  Coding DNA Sequence Number=SeqID_41519
MIWVPKGSVVHTNTQGPNKVWVPKSHIDLVGTIEKKSGCSKHMMGDASKFTHISPKKSGHVTYGDNNKRNGNNSSYRAPNEVIPKQGERSRLEIQFRLKNHLN

SEQ ID NO: 133205 - protein, 264 aa, Glycine max
  Coding DNA Sequence Number=SeqID_41520
MRGAPTEESLSPFLVRDFGAQSLKVIQRVHKVWRSPVRKDKEPRGIRNGVIGGYHGWLRVHTRGLDWLSKLKVINEENFEASEEDEEVQALKLELGKTRLAKEKFKSAATNIRKECTELREENAATARALEQETKRACKEEHGQDKFRGALWGSNNELKLRREERDQSRVHGMILKEELAACARSKRSLAQHLEATEQSMLAIIGQYKEELNQSVTHEQKLVEDFAQVYAKKEARGRVIDALHQEATMWMDRFAMTLNGSQDFP

SEQ ID NO: 133206 - protein, 121 aa, Glycine max
  Coding DNA Sequence Number=SeqID_41521
  Gene Ontology: Mol. function=aspartic-type endopeptidase activity; Biological process=DNA integration
  Homolog annotation: Hit_ID=A5BBA3; Match level="QueryCoverage=99%, HitCoverage=20%, E-value=2e-43, Identity=52%"; Hit description =Putative uncharacterized protein
MEMTTCMLHEKELPKELWAEAANTIVKRDKLDKKTEPEVFIGYNNTSKAYKIFQPQNWKILVSRDVKFMEDQQWSCDEPIRKQLPEIPQFLDDDVDDIPVRGTRSLSEIYQKGNVVVLEPA

SEQ ID NO: 133207 - protein, 130 aa, Glycine max
  Coding DNA Sequence Number=SeqID_41522
MEKFENKNIGEKKAKKAYITWDDNDLESSDDFEKEEITLCLMGKNYESDEEDPLFTLTLKDPIKIGYLSHNVDVVGTFEEKVALRTACLVDAILPRKGPVTRSMSKRLQEDWARATEEGPRVLMNLMVDF

SEQ ID NO: 133208 - protein, 251 aa, Glycine max
  Coding DNA Sequence Number=SeqID_41523
  Homolog annotation: Hit_ID=Q2QNX8; Match level="QueryCoverage=54%, HitCoverage=13%, E-value=7e-07, Identity=25%"; Hit description =Retrotransposon protein, putative, unclassified
TPPSIPELQQLPEATQIGEPASSSAEVRQLVDHLSEQAREVASEASMERTPRALAMWMAGLTLAFAISIALAQKVDLLCDRCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRKATREGVKPAKGGLQGDNSNRVAKR

SEQ ID NO: 133209 - protein, 260 aa, Glycine max
  Coding DNA Sequence Number=SeqID_41524
  Gene Ontology: Mol. function=metalloexopeptidase activity; Cellular component=exocyst; Biological process=proteolysis
  Homolog annotation: Hit_ID=Q8KR44; Match level="QueryCoverage=100%, HitCoverage=44%, E-value=1e-121, Identity=82%"; Hit description =Putative uncharacterized protein
  Pfam annotation: Domain name=Creatinase_N; Domain location=6-135; Score=20.1; E_value=7.4e-08; Accession=PF01321.9; Description =Creatinase
MYSTSPLSALRQWLEASHLDGMIVPRADAWQSEYCAPYDEKLAWLTGFDGSAGVALVLQDKALLFVDGRYQVQARVQVNTDEIEIHHLHNEPLAQWLAENVGAGTRIGFDPLLMTNTEFDQLSATACELVPLSESPFDTLWTDRPAAPAGLIRSMPVELSGESSADKRQRVAAVLAASHADYLAVTLPDNIAWLLNVRGADIPYSPVPLSFVLLGRDGHVEWFVNDNKLSALPDAVRNAFTIAPQDAFIERCQRIAAGKR

SEQ ID NO: 133210 - protein, 319 aa, Glycine max
  Coding DNA Sequence Number=SeqID_41525
  Gene Ontology: Mol. function=sodium:dicarboxylate symporter activity; Cellular component=1-2nm peptidoglycan-based cell wall; Biological process=regulation of cell shape
  Homolog annotation: Hit_ID=P0ABG8; Match level="QueryCoverage=94%, HitCoverage=81%, E-value=1e-145, Identity=86%"; Hit description=Rod shape-determining protein rodA
  Pfam annotation: Domain name=FTSW_RODA_SPOVE; Domain location=1-319; Score=507.0; E_value=2.2e-149; Accession=PF01098.10; Description =Cell cycle protein
MLLILLALLVYSALVIWSASGQDIGMMERKIGQIAMGLVIMVVMAQIPPRVYEGWAPYLYIFCIILLVAVDAFGAISKGAQRWLDLGVVRFQPSEIAKIAVPLMVARFINRDVCPPSLKNTAIALVLIFLPTLLVAAQPDLGTSILIALSGLFVLFLSGLSWRLIGIAVVLVAAFIPILWFFLMHDYQRQRVMMLLDPETDPLGAGYHIIQSKIAIGSGGLRGKGWLHGTQSQLEFLPERHTDFIFAVLAEELGLVGILILLALYVLLIMRGLWIAARAQTTFGRVMAGGLMLILFVYVFVNIGMVSGILPVVGVPLPL

SEQ ID NO: 133211 - protein, 197 aa, Glycine max
  Coding DNA Sequence Number=SeqID_41526
  Gene Ontology: Mol. function=endonuclease activity
  Homolog annotation: Hit_ID=Q9AY32; Match level="QueryCoverage=31%, HitCoverage=95%, E-value=1e-26, Identity=96%"; Hit description=RRNA intron-encoded homing endonuclease
  Pfam annotation: Domain name=Toxin_19; Domain location=66-99; Score =8.9; E_value=0.02; Accession=PF08088.3; Description=Conotoxin I -superfamily
PFHPGLFVGDAGGFQSPTREPLNVGGLVPPHCSLKSVVSDDACPGACFVQRDATTLIKKARSWTLGWVDRSASGVHRSARPFCGRCAPVLNWPGCASGADSDPIVLAFGIGVMINRDSRGHWYFIVRERKLGARRRSDTVLVSTINDADQGSADVAFRTPLAPYEKSKSLGSGGSMVARLKLKGIDGRAPPGVEPAA

SEQ ID NO: 133212 - protein, 240 aa, Glycine max
  Coding DNA Sequence Number=SeqID_41527
GLHVLTIRGLHALTSRGLHVLALRGLPALALGTSYPHLQRTPCPHFQRATRPRHQRTACPHLRRATQGYTPSPLEDYTSSPSEDYTSSPSEDYAPSHQRTTRPHLQRTTRPHLRGLHVLTFRGLHVLTFRGLHALAIRGLHVLTFVGLHALTFRGLHVLTNRGLHALTLRGLHVLTIRGLHALTSRGLHVLALRGLPALALGTSYPHLQRTTCPHFQRATRPRHQRTACPHLRRATCPHL

SEQ ID NO: 133213 - protein, 181 aa, Glycine max
  Coding DNA Sequence Number=SeqID_41528
  Homolog annotation: Hit_ID=UPI00006A2939; Match level="QueryCoverage =71%, HitCoverage=76%, E-value=1e-08, Identity=29%"; Hit description =UPI00006A2939 related cluster
MTDPLDESISCFLIRVNPWVLVPLSLEDYTSSPSKGYMSSPSEGYTPSPSEDYMSSSLEDYMSSPLEDYIGLHVLTFRGLHALAIRGLHVLTFVGLHALTFRGLHVLTFRGLHALAIRGLHVLTIVGLHALTFRGLHVLANRGLHALTFRGLHVEILILRTDVVQDVTTSRFRTCRLSMTV

SEQ ID NO: 133214 - protein, 60 aa, Glycine max
  Coding DNA Sequence Number=SeqID_41529
MPKDRGTCLDFKDGHHQKGGDCRQRIKLNVLMMPKFHMRLKALFKTKKLKIFKMDDQDSL

SEQ ID NO: 133215 - protein, 31 aa, Glycine max
  Coding DNA Sequence Number=SeqID_41530
MALALLSEEARKGKNTVNDIQNKIMWANEEP

SEQ ID NO: 133216 - protein, 385 aa, Glycine max
  Coding DNA Sequence Number=SeqID_41531
  Homolog annotation: Hit_ID=Q6WAY4; Match level="QueryCoverage=92%, HitCoverage=74%, E-value=4e-12, Identity=24%"; Hit description =Putative uncharacterized protein
KIAAVVGDSAKELDRMKQTRNGVVGLPRKYLEGKARDMASQEKWGPFADILALLIFGVVLFPNMDGLVDLAAIDTFLAYHHSNESPVVAILADLFDTFDRRCEKNSARIVCCLPALCVCQLGFLVGKEGKEGVLFSCEDYPNVPLIGTRGGMPTEETLSPFLVRDLGAQGLKVIQRIHKAWRSPLRKDKELRSIRNGVIGGYHGWLRIHTRGLDWLSKLKVIDEENFEAPEEDEEVRDLKLELGKARLAKEKFKSAATHIRMECTELQEENAATARALEQETKRARKEEYGREKFRGALWGSNNELKLRREERDRSRVHGMILKEELVACARSKRSLAQHLEATEQSMLGIIGQYKEELNQSMTHEQKLVEDFAQVYAEKEARGR

SEQ ID NO: 133217 - protein, 39 aa, Glycine max
  Coding DNA Sequence Number=SeqID_41532
MAPTPRTHIEILVPTPRSIPYRLNVLPKRVISLEASKVT

SEQ ID NO: 133218 - protein, 175 aa, Glycine max
  Coding DNA Sequence Number=SeqID_41533
MVGYTPSSFTDLVFASERIKVGPKRGKFDHPTRTTEKTGANKEGEDEGETHVVAAIPVRPNFPPTQQYLYSANNKLSPYPPPSYPQRPSLNLPQSLSTALPMTNTTFSTNQKHQPRTITLAKVHQPPFLREYDSNATCACHGEAPGRSIEHGRALKRKVQGLIDAGWLKFEENCV

SEQ ID NO: 133219 - protein, 79 aa, Glycine max
  Coding DNA Sequence Number=SeqID_41534
  Subcellular localization annotation: CTP_CleavageSite=20; ConfidenceScore=5.22e-01
MKLRCPKKHHFLVNHALGTVATYPSAGGRRVTRGMRVPRKEYARSRHQRLFEENVGKTGKDAIYELLSERFGSCIYARG

SEQ ID NO: 133220 - protein, 108 aa, Glycine max
  Coding DNA Sequence Number=SeqID_41535
MENNVATAAAVSSAVEADPTLPSTAHHPLLNVVGRERSTLGHINNPYLGYNRVAYPYGLPPNYTPPVMRDDAGHVPSPILEGEFPRQSNEVHEDRREHAQGDIDFYPP

SEQ ID NO: 133221 - protein, 100 aa, Glycine max
  Coding DNA Sequence Number=SeqID_41536
MTVKPLTHAAPGDGHSLSVSGCREQTSPSGRVSGCWRVSGLAELCGIRADCTESAPYAAAQLLGRAIGAGLFAITPAGERGMCCKAIKLGNARVFPVTTL

SEQ ID NO: 133222 - protein, 151 aa, Glycine max
  Coding DNA Sequence Number=SeqID_41537
  Subcellular localization annotation: CTP_CleavageSite=41; ConfidenceScore=5.13e-01
MALLLSNISSGDHNANLSLQKDRAHKTPSGPGEVQQGLGVSSSSYGPPSVLQGARSPQEGIAPARHPVDPKKSNKVLEFPTLITGLCQFYGVPVAPSKVIRPPTNRAFIKKYCTPKQAQGETPQQPGDGRQWATDAPPPPLEFTSAHPQKG

SEQ ID NO: 133223 - protein, 177 aa, Glycine max
  Coding DNA Sequence Number=SeqID_41538
  Homolog annotation: Hit_ID=Q5QJQ3; Match level="QueryCoverage=17%, HitCoverage=24%, E-value=3e-11, Identity=100%"; Hit description =Putative uncharacterized protein
DAGSRQARQGASAGVGGCRGWLNYAASEQIVLRVHHMRAIGAGLFAITPAGERGMCCKAIKLGNARVFPVNSSEEMKKKGAGYRARIRNHGHSCFLRETCRASCINESANARGEAVCVLGALPLPRSLTRCARSFGCGERYQLTQRRSFAPSWAVCTNPPFSPTAAPYPVTIVLSPT

SEQ ID NO: 133224 - protein, 99 aa, Glycine max
  Coding DNA Sequence Number=SeqID_41539
  Subcellular localization annotation: CTP_CleavageSite=48; ConfidenceScore=5.37e-01
MLSFGTNVRGANTFLKRKYNSRIWNILHDRFPSVFLTFSTNKHWWRLRAFSSFGRRTREPRLARPQKGRLRHMTLQRYAWQYQGKQHVACLLRAPISET

SEQ ID NO: 133225 - protein, 137 aa, Glycine max
  Coding DNA Sequence Number=SeqID_41540
  Homolog annotation: Hit_ID=Q1RSH0; Match level="QueryCoverage=58%, HitCoverage=39%, E-value=3e-08, Identity=39%"; Hit description=H+ -transporting two-sector ATPase, alpha/beta subunit, central region, related
MDKFPTLYQVSNQQQQTIRHMGSHKEEGWEWNFNWRRNLFDSEASMAAEFIEETRLISVQQQGADSWIWKQHSSGIYSTNTAYKFLMEETRGDPVDGSFVFLWKLKIPPKAKIFNLETHQRPLTSYVQNIYVLTVPL

SEQ ID NO: 133226 - protein, 83 aa, Glycine max
  Coding DNA Sequence Number=SeqID_41541
MTQGCMSHDLKSPPEDAYISGKGADDHIGLHLSNHTRGADNRKVSPRATSSWVMVTESSVVDKSEAFAPTYPPMRNSDLRSSG

SEQ ID NO: 133227 - protein, 152 aa, Glycine max
  Coding DNA Sequence Number=SeqID_41542
  Gene Ontology: Mol. function=transporter activity; Cellular component= integral to membrane; Biological process=transport
  Homolog annotation: Hit_ID=Q57R82; Match level="QueryCoverage=92%, HitCoverage=88%, E-value=8e-23, Identity=67%"; Hit description=ABC superfamily (Membrane), putrescine transporter
MDLGARPLKVFYHPADDYAGGDLRLAAGVYPQSLDDLVIASFVSGGGETLIPDWSSPAYAWWVNPEINALASIILARASELSDLYRTGMNNLPVVRSPWRIAILTIGFTFLYAPMLMLVIYSFNSSKLVTVWAGWSTRWYNRTVPRLGDDQR

SEQ ID NO: 133228 - protein, 200 aa, Glycine max
  Coding DNA Sequence Number=SeqID_41543
  Homolog annotation: Hit_ID=A5AZ88; Match level="QueryCoverage=56%, HitCoverage=15%, E-value=1e-10, Identity=31%"; Hit description =Putative uncharacterized protein
MGRNVSALIGKFVPQIPKKCKDPDLGASVSVIPLSIFNSLSLGPLQSTDVGFSKGIVPIILGRPFMKTARTKIDVYAGTLSMEFGDITVHFNILDAMKHPSEDLSVFRAEIIDHVVDEYMTDLHSNLHVCHSSCIESEFVLDHMSEFDIDYMFGDVLPLEIDFIEPDRANHVSGSTHTSDFLYEVQAENHLFLPLSSRPH

SEQ ID NO: 133229 - protein, 98 aa, Glycine max
  Coding DNA Sequence Number=SeqID_41544
  Homolog annotation: Hit_ID=A6FJQ2; Match level="QueryCoverage=38%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLVVGHTKPSVVGGFVDTGL

SEQ ID NO: 133230 - protein, 36 aa, Glycine max
  Coding DNA Sequence Number=SeqID_41545
MGEMLATQLGQASSARPSEEGDFLQKQPPSGGPKWA

SEQ ID NO: 133231 - protein, 84 aa, Glycine max
  Coding DNA Sequence Number=SeqID_41546
VSRICPLDLMMKYVQFQLRLAHQWAKRTSTAKCNFGMLNALEESGKASISRSCAKHEISALSAVVVFSQAQCMIGAKLKSTYSC

SEQ ID NO: 133232 - protein, 104 aa, Glycine max
  Coding DNA Sequence Number=SeqID_41547
MDEFDAQVAWTRAQPSSSRGGGASVAQEPIPEEPAAATSEGEDELTPPEPFYFDSGIPEPSLAPIPDDVIPSAPASELEQPIPQDSPAAQVLDLNEHAQEQPQE

SEQ ID NO: 133233 - protein, 74 aa, Glycine max
  Coding DNA Sequence Number=SeqID_41548
  Gene Ontology: Cellular component=photosystem II reaction center; Biological process=photosynthesis
  Homolog annotation: Hit_ID=Q7J1A0; Match level="QueryCoverage=45%, HitCoverage=97%, E-value=6e-11, Identity=97%"; Hit description =Photosystem II reaction center protein T
  Pfam annotation: Domain name=PsbT; Domain location=4-32; Score=65.6; E_value=1.7e-16; Accession=PF01405.8; Description=Photosystem II reaction centre T protein
MKSMEALVYTFLLVSTLGIIFFAIFFREPPKVPTKKVMSPQYGGLITSTSPHVLQMDLLVVARVAQRQYIRHTQ

SEQ ID NO: 133234 - protein, 93 aa, Glycine max
  Coding DNA Sequence Number=SeqID_41549
MVMGSYLLGANYVIGFLDVTIIHQLVTIVRNVFSLEWGHADKHYVIMVEDVATCYNITTVCGKRVKYTHLSQHLPRGAGKVHGRAEEVSKGTT

SEQ ID NO: 133235 - protein, 62 aa, Glycine max
  Coding DNA Sequence Number=SeqID_41550
MEKFEKKNINEKKLKKACITWDENDMESSEDSENEEINLCLMEKSYESDEEENKDMSPIRLD

SEQ ID NO: 133236 - protein, 70 aa, Glycine max
  Coding DNA Sequence Number=SeqID_41551
MGVQIAPRPIWALQKIPPEGGCFWRKQPCSLMVHIAFRAFLLSFCLLFIPPVDVLKPFYLSHFSLNLKIK

SEQ ID NO: 133237 - protein, 222 aa, Glycine max
  Coding DNA Sequence Number=SeqID_41552
  Gene Ontology: Biological process=transposition, DNA-mediated
  Homolog annotation: Hit_ID=Q6UUU1; Match level="QueryCoverage=27%, HitCoverage=40%, E-value=2e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLKFWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133238 - protein, 294 aa, Glycine max
  Coding DNA Sequence Number=SeqID_41553
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPPSSASQSVRITGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133239 - protein, 140 aa, Glycine max
  Coding DNA Sequence Number=SeqID_41554
  Gene Ontology: Mol. function=structural constituent of ribosome; Cellular component=ribonucleoprotein complex; Biological process =translation
  Homolog annotation: Hit_ID=P02358; Match level="QueryCoverage=68%, HitCoverage=71%, E-value=5e-41, Identity=87%"; Hit description=30S ribosomal protein S6 [Contains: 30S ribosomal protein S6, fully modified isoform; 30S ...
  Homolog annotation: Hit description=ribosomal protein S6, non -modified isoform]
  Pfam annotation: Domain name=Ribosomal_S6; Domain location=25-101; Score=86.4; E_value=9e-23; Accession=PF01250.8; Description =Ribosomal protein S6
MFLACRLSILMAAIAFALSKSAAIMANAIFFMICAPRLRAQRATIHRLEDWGRRQLAYPINKLHKAHYVLMNVEAPQEVIDELETTFRFNDAVIRSMVMRTKNAVTEASPMVKAKDERRERRDDFANETADDSDAGDSEE

SEQ ID NO: 133240 - protein, 252 aa, Glycine max
  Coding DNA Sequence Number=SeqID_41555
  Gene Ontology: Mol. function=motor activity; Cellular component=cell projection
  Homolog annotation: Hit_ID=UPI00016621D1; Match level="QueryCoverage =82%, HitCoverage=44%, E-value=8e-11, Identity=32%"; Hit description =UPI00016621D1 related cluster
MPSPSENYTSSPLEDYTTSPSQSYTPSPSEDYTSSPPEGYRPSPSEDYTSSPSEGYTSLPSEGYTPSPSEDYTSSPSEGSHTLAFRGVHALAFRGLHVLTFRGLQVLTFRAQHALTLKGLHALAFRGLPVPAFKGLHVLSFRGLHFLALRGLHVLAFRGLHVLSYRGLHVLPSRGLHVLTSRGLHVLTSRGLHVLTSRGLHVLTSRGLHVLTSRGLHNLTSRGLHALPFRGLHALAFRGLHVLPLQKGRGIL

SEQ ID NO: 133241 - protein, 131 aa, Glycine max
  Coding DNA Sequence Number=SeqID_41556
MERSMIDAASGGALGDMTPAEARNLIEKMASNYHQFSAKNDAIVIGGVHEVATDSFASSETKKLEGKLDALVNLVTQLAMNQKSVPIARLCGLCTFADHHTDLCPSVQQSGAIEQPEAYAANIYNRPPQPQ

SEQ ID NO: 133242 - protein, 267 aa, Glycine max
  Coding DNA Sequence Number=SeqID_41557
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSKLSAWPHPLKVIKSQTSHFPPALSSYFRPSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133243 - protein, 251 aa, Glycine max
  Coding DNA Sequence Number=SeqID_41558
WIPFYADAIGQLLGYPLVLEEGQEYEYGQRRNRSDGFDEEAIAQLLCIPGQDFARTAAGRRVRIMRTNMTTLTQIWMTLLLSNILPTDHNSDLPMPKCQLVWRLPGTLWIQISPTGPWDFPSLITGLYQSFGVPVAPTKKYCTQRQAQGDAPQAAGAPPPPHQAGQAGAFDMEQYLRHLVRQQAANHRVHGFASFSCPTPDQFRAEVAWPGDWPEAQAGVAPPEAPGDGEEAHEDEEMADLLDFLGGSGDT

SEQ ID NO: 133244 - protein, 108 aa, Glycine max
  Coding DNA Sequence Number=SeqID_41559
MLIIIDQYKEKVNLDASHGQMLRDEQAKVLALQVKREAREKVIDLLHEESMKWMDRFALTLNESQELPRLLARAKMVANTYSAPDEVHNLFNYFQHMVELMTHIIRNR

SEQ ID NO: 133245 - protein, 101 aa, Glycine max
  Coding DNA Sequence Number=SeqID_41560
  Subcellular localization annotation: CTP_CleavageSite=42; ConfidenceScore=5.34e-01
MESPTVATYPSVGGRRGAHRCVFQGRKARGVATNVYSRKTLEKSNVWSTNFNCERFRSCFYARGRRETLRRWTINDLLGWSTKAGLLLLRILNCNEEIRPT

SEQ ID NO: 133246 - protein, 221 aa, Glycine max
  Coding DNA Sequence Number=SeqID_41561
MVYDLNDIFVSLPNKWTCFKKHDLQMGKLSLHAKLTLYADCMLLLYWVYCGRTLSLTTCSLLAKFDIAEATKVKTKVMSTVATRWRQFKSTLTSKFVFAKSEGQQTQDVVTKYGLDPEAWKQFEETRLTPNWEGIRKRAQSIQKHNDCPHVLSRGGYDLLKKKLLDQKRKRIQEEALLSENAASLDEPPSPIKRHVKWKVARTRAVGNMTSESAQEIADKI

SEQ ID NO: 133247 - protein, 68 aa, Glycine max
  Coding DNA Sequence Number=SeqID_41562
MLSPAPFPEMFASFGRNCEKVSFAIRKTQSPIACSGLRHHLHLPRRCQHLPAETAKESHLLSVRLKAR

SEQ ID NO: 133248 - protein, 74 aa, Glycine max
  Coding DNA Sequence Number=SeqID_41563
LGRIDGDPVLRETRMLATWEYVSSVGGGQQGMSGTGRYVAGVRRPRGLQASSWQSAVKRNKDHKARRLVVAGQL

SEQ ID NO: 133249 - protein, 146 aa, Glycine max
  Coding DNA Sequence Number=SeqID_41564
MPISPCRCISWDHAHKTPSGPEEVQQGPGVSSSGYEPLDHAHKTPSGPEEVQQGPGESHPQRHPVDPEKSNKALGFPALVTGLCSPTGCPFPPARSHHHDIGIAPARHPVDPKKSNRVLELPSSNYGPLSVLRSACRPQQGHQAPY

SEQ ID NO: 133250 - protein, 128 aa, Glycine max
  Coding DNA Sequence Number=SeqID_41565
MMGLPFKMIGVLLHLPRMELPFKMTPYFPKLDLKFKPFAENLKSELLGGIIALFVLGLTYLYYRMKTPKVVTCDRPNSKVGSVMFERDEIKCYIGKAKGKFQYSVFTLIFKIWYLTIFIGARFLVTNY

SEQ ID NO: 133251 - protein, 188 aa, Glycine max
  Coding DNA Sequence Number=SeqID_41566
  Homolog annotation: Hit_ID=UPI00016621D1; Match level="QueryCoverage =84%, HitCoverage=40%, E-value=5e-14, Identity=34%"; Hit description =UPI00016621D1 related cluster
MRGPLKESTSCFLVRLKSFGTCTYWLAFRGLHVLTFRGLHALAIRGLHVLTFRGLHALAIRGLHVLTFIGLHALTFRGSHVLTFRGLHTLAIRGLHVLTFRGLHALAIRGLHVLTFVGLHALTFGGLHVLANRGLHALTFRGLHVLAFRGLHVLAFKGSCTFTFVGLHALTFRGLHVPHFQRGTCPHL

SEQ ID NO: 133252 - protein, 54 aa, Glycine max
  Coding DNA Sequence Number=SeqID_41567
  Subcellular localization annotation: CTP_CleavageSite=14; ConfidenceScore=5.29e-01
MVKVGTSYVPINVSFSPKVGPGLPVTLKMQAYRLPSTSRVGPGPAFSFPFSSEG

SEQ ID NO: 133253 - protein, 229 aa, Glycine max
  Coding DNA Sequence Number=SeqID_41568
  Homolog annotation: Hit_ID=Q6WAY4; Match level="QueryCoverage=52%, HitCoverage=21%, E-value=5e-12, Identity=32%"; Hit description =Putative uncharacterized protein
MGSSQKPSLKKRFYQVKIKSLEVTSLRELGQLMGQLQRQAFRKAYGKIWDLARVEVSMEPIESLSQYYDQPLRCFTFEDFQLVPTVKEFEEILGCPLGGRKPYLFFGFYPSTTRVAKVVKISAQELNQESPIVAILSMYDTFDRGCEKSDARIFCCALALFVWLVSHPFLQEGRPVYPLQGHRSGVEKGKANWDHLLASMEGRLLIGSLARRKEESGFYLHAKDVQMFS

SEQ ID NO: 133254 - protein, 216 aa, Glycine max
  Coding DNA Sequence Number=SeqID_41569
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=100%, HitCoverage=51%, E-value=1e-114, Identity=86%"; Hit description =Photosystem II 44 kDa reaction center protein precursor
  Pfam annotation: Domain name=PSII; Domain location=1-216; Score=87.1; E_value=5.5e-23; Accession=PF00421.10; Description=Photosystem II protein
VDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAAIYGTREELGAAAAGFEKGIDRDFEP

SEQ ID NO: 133255 - protein, 135 aa, Glycine max
  Coding DNA Sequence Number=SeqID_41570
KDLTTLAQVWSVLSYSNLALTSHTSDLIVDRARLIYGLVSRMDMNIEALISGQITSIAQSNASILGFLALIIALCRARRVVSDSLTFERLSPVINLAYIRKNCWNPEDQTISIRGARRARPAELPSTFAAPSVPA

SEQ ID NO: 133256 - protein, 63 aa, Glycine max
  Coding DNA Sequence Number=SeqID_41571
SWHDRFPDWKAGSERNAINVTDNNFTQETAMTMITNSARYPMKLICETHNHALAKSFVGHPYA

SEQ ID NO: 133257 - protein, 133 aa, Glycine max
  Coding DNA Sequence Number=SeqID_41572
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=50%, E-value=4e-24, Identity=100%"; Hit description=LacZ protein
MTHAKWECDNGQMQERYVHYDAEEMFMRPGDPLVLERPPPRWSSNSPYSESYYNSLAVVLQRRDWENPGVTQLNRLAAHPPFASWRNSEEARTDRPSQQLRSLNGEWDAPCSGALSAAGCGGYAQRDRYTCQR

SEQ ID NO: 133258 - protein, 181 aa, Glycine max
  Coding DNA Sequence Number=SeqID_41573
  Subcellular localization annotation: CTP_CleavageSite=87; ConfidenceScore=5.25e-01
MLVRMVRTLLFAAARVKSCPSMHSSCVIASLSGCARTVGPPPISGGGPGTVWIWSPLKVRTRSPLKARACSPLKFRTCCLSKARECSPMMARTCNPLKVRTCSPTKVKAHDPLTARTCSPLKLKLHDPLKARTCSPLNGEGRVVLSRRGRVVLSTVRVTSTQGEGRVVLSRRGRVVLSTVR

SEQ ID NO: 133259 - protein, 35 aa, Glycine max
  Coding DNA Sequence Number=SeqID_41574
MASCHKSASKEDKASWRFDGSSSNIFTANSRKVTG

SEQ ID NO: 133260 - protein, 54 aa, Glycine max
  Coding DNA Sequence Number=SeqID_41575
MASEGSSLSCWNYRSGKSCSELELRELPSGRSRYEPRSSSDVARTDGYHEVFAG

SEQ ID NO: 133261 - protein, 71 aa, Glycine max
  Coding DNA Sequence Number=SeqID_41576
  Subcellular localization annotation: CTP_CleavageSite=54; ConfidenceScore=5.24e-01
MAFKLNSMSLRPQADAGRNTTAALGWPVAGNRHTATTFRVHLNSSAKRLERCLRHMADQQATKSKAKVRHT

SEQ ID NO: 133262 - protein, 139 aa, Glycine max
  Coding DNA Sequence Number=SeqID_41577
MKMLLIPHDVSSIGACRPRIFFINGFLCFLEDEWQQNEERKRERRCHFKEKMSLEEAHHHRRPWIRAWRKKEMNEGRGREEHEILIASRNVVLSEQISRLVCGLDIDALPDSSVALSELSPNGELSATTTFSTSRLSLI

SEQ ID NO: 133263 - protein, 96 aa, Glycine max
  Coding DNA Sequence Number=SeqID_41578
  Gene Ontology: Mol. function=oxidoreductase activity; Cellular component=cytoplasm
  Homolog annotation: Hit_ID=A4WA06; Match level="QueryCoverage=96%, HitCoverage=31%, E-value=1e-34, Identity=75%"; Hit description =Aldo/keto reductase
MSSIDKSGTYALGTRTVKRLGYGAMQLAGPGVFGPPKDKNAALEVLREAVAAGVNHIDTSDFYGPHVTNQLIREALHPYRDDLTIVTKIGARRNDK

SEQ ID NO: 133264 - protein, 74 aa, Glycine max
  Coding DNA Sequence Number=SeqID_41579
MGVQIATKPTWAFLNTVASGGSNLARLGELGDKLLPYFPINRGRSEGKKCLALLIFNRSSTFFVHSSSFFGLQP

SEQ ID NO: 133265 - protein, 132 aa, Glycine max
  Coding DNA Sequence Number=SeqID_41580
  Gene Ontology: Mol. function=structural constituent of ribosome; Cellular component=ribonucleoprotein complex; Biological process =translation
  Homolog annotation: Hit_ID=Q1H1P3; Match level="QueryCoverage=84%, HitCoverage=85%, E-value=2e-50, Identity=84%"; Hit description=30S ribosomal protein S6
  Pfam annotation: Domain name=Ribosomal_S6; Domain location=10-100; Score=138.8; E_value=1.5e-38; Accession=PF01250.8; Description =Ribosomal protein S6
GFQPQGNLMRHYEIVFIVHPDQSEQVPAMIERYRAQITGNGGNIHRLEDWGRRQLAYPIQKVHKAHYVLMNIECGQEVLEELEHGFKFNDAVLRHLTIATKTAVTAPSPMMKEEKSKTIVGDAPAATTEAAA

SEQ ID NO: 133266 - protein, 89 aa, Glycine max
  Coding DNA Sequence Number=SeqID_41581
MVSGNRLPGDIVMTAQLIRDRVEMECLKGAWETLEGNTRCRFRGTIRFTATSLVHPDEPARTLQRTVEWTTPWISLVYFLRVGVSRTDC

SEQ ID NO: 133267 - protein, 92 aa, Glycine max
  Coding DNA Sequence Number=SeqID_41582
MDGQWLKKDAQPPQDERAPSPPPQQDDSLALMHEVLSKLRGLRTYVGERFNSLGGRIDAIDACFAGMDTYITQLEEDISYVRQCFDLPPPSS

SEQ ID NO: 133268 - protein, 97 aa, Glycine max
  Coding DNA Sequence Number=SeqID_41583
MPLQVGLHHSLPLEKDFDASSIGACRPRIFFINGFLCFLKDEWQRNGERKRERRHHFKEKMSLEEAHHHRRPWIRAWRKKEMNEGRGREEHEFLCSK

SEQ ID NO: 133269 - protein, 190 aa, Glycine max
  Coding DNA Sequence Number=SeqID_41584
  Homolog annotation: Hit_ID=Q2HSI4; Match level="QueryCoverage=76%, HitCoverage=66%, E-value=8e-13, Identity=34%"; Hit description =Putative uncharacterized protein
  Pfam annotation: Domain name=DUF1723; Domain location=157-190; Score =17.3; E_value=0.0047; Accession=PF08330.1; Description=Protein of unknown function (DUF1723)
MVRTRGLGRALGQVTGRGVGRGDRDDSDDAPQRRRPTAFARRQRVVVTAAHDEPVIPVQDVQDDPMEAPAAVEDIVADIHADTGAEATEDEHEGFLGGPSDPSVLTLYADHVACSVWTGELSSHGRKVHSLGRSVPAIEGLVAGTGLSPLIACSVDTSDQGLLSVFVERWHRETSSFHLPVGELTITLDD

SEQ ID NO: 133270 - protein, 210 aa, Glycine max
  Coding DNA Sequence Number=SeqID_41585
  Homolog annotation: Hit_ID=Q6WAY4; Match level="QueryCoverage=88%, HitCoverage=33%, E-value=1e-18, Identity=31%"; Hit description =Putative uncharacterized protein
MGTNQNGKRFYQVKIKGLDVTSLKELGRLMGPLQRQAFRKVYRKILDLTTAEVFTEAVVSLAQYYDQPLRCFTFGDFQIVPTVEEFEEILGCPLGGRKSYLFSGFLPSLSKIAAVVGDSARGLDRMKQTRNDIVGLPRKYMEGKARDMASQEEWVLFADILALLIFGVVFFPNVDSLVDLASIDAFLAYHHSKESPVVAIWADLFDTFDR

SEQ ID NO: 133271 - protein, 173 aa, Glycine max
  Coding DNA Sequence Number=SeqID_41586
MAPRKLSTKRSRKDVAAEGTSATPEFDSHRFRSAEHQQRFEAIKGWSFHRERRVQLRDDEYADFQEEIARRCWTSLVTPMAKFDPDVVLEFFANAWPTEEGVRDMRSWVRGQWIPFDAGALSQFLGDSLVLEEGQECEYSQRRNRADGFDEEVIAQLLCIPGQDFCPDCCRET

SEQ ID NO: 133272 - protein, 78 aa, Glycine max
  Coding DNA Sequence Number=SeqID_41587
MLSFSCRPWNTPTVSWQPLETGKLSHELLVELRGDRTSAKALDRSPCRFSASVLSEPPRCLFLATPLPVGMGATACTG

SEQ ID NO: 133273 - protein, 65 aa, Glycine max
  Coding DNA Sequence Number=SeqID_41588
MRTTKGGAERNSSSLLPLFYRKMGEMLATQLAQASKVASSRRNRLLEESSGGPKWALLLFAPHFY

SEQ ID NO: 133274 - protein, 53 aa, Glycine max
  Coding DNA Sequence Number=SeqID_41589
MGVQIAPRPTWALQNIPPEAEALPKRFRNVFREEFRKSFNRSSTFFIVLRSST

SEQ ID NO: 133275 - protein, 149 aa, Glycine max
  Coding DNA Sequence Number=SeqID_41590
  Homolog annotation: Hit_ID=Q6UUU1; Match level="QueryCoverage=29%, HitCoverage=30%, E-value=3e-08, Identity=68%"; Hit description =Putative uncharacterized protein
GEAVCVLGASGVNTGLLCWHWMRDIPLPRSLTRYARSFDCGERKWLKRGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYL

SEQ ID NO: 133276 - protein, 151 aa, Glycine max
  Coding DNA Sequence Number=SeqID_41591
MRGALTEESLSPFLVRDFGTQSFKIVQRVHKEWESPLRKDKELRGIRNGIIDGYHEWLKVHTRGLDWLSKLKIINEENFEAPEEDEKMSGKSVLSYEKKMQLPQEPLNKKPRGLARKSMAETNSVELCGAATRNSSFEGNRETNHEYIAWS

SEQ ID NO: 133277 - protein, 166 aa, Glycine max
  Coding DNA Sequence Number=SeqID_41592
MTLTILKLFLRPYQVTWDATVFGVFNPDFPLYIKHEDFSEIAHGGQCLSISVLELWILHLTETSMRAGNSNIYGFLEPQSIQRFWQLQFETESYIKSWMHSSKCDVYLGAYLNGRHWQMVVIMPKEHLIVWFCSLHNRPDNYLKGILNSLNQRLMLVDCRQGSSFT

SEQ ID NO: 133278 - protein, 106 aa, Glycine max
  Coding DNA Sequence Number=SeqID_41593
MGLGNDCLGNADVVDIKGNPYKYGLGYEPGMPGRRNVSSRFRADRVWPGRISQCFTSAGMVSEKEVAAIEEEFPQDPPSFVQPCHPVSQVGNWRVISQSEVYTADS

SEQ ID NO: 133279 - protein, 113 aa, Glycine max
  Coding DNA Sequence Number=SeqID_41594
  Homolog annotation: Hit_ID=A5C143; Match level="QueryCoverage=65%, HitCoverage=77%, E-value=2e-11, Identity=46%"; Hit description =Putative uncharacterized protein
MGTRLDYFLSNGTTLHFRFESGEFVPYLNNIVKPLHDWLKKNPPSWSDLHTQTVKDIKLKVQSIKCLYLLIPQAFKIVEMDASVIGYGDILNKESIAKSMSLHTHQSIGIQHN

SEQ ID NO: 133280 - protein, 322 aa, Glycine max
  Coding DNA Sequence Number=SeqID_41595
  Homolog annotation: Hit_ID=Q6WAY6; Match level="QueryCoverage=85%, HitCoverage=47%, E-value=2e-16, Identity=26%"; Hit description =Putative uncharacterized protein
MWMGWWTWQRSTLFSPIITTRKARLSLCQPTYITPSTEDVKRATQGLFCCTPTLYVWLVSHLFRQEVRHACSLESHCSCTKKGGANWDQLLASKEGASVNWFPRWKEGRIGVLISCGGFPNVPLMETRGCISYIPVLAIRQVGYPMRGAPLEEEIVPVISRGFNKTNMETLQKVRKAWEVLQRKDKELRGSNNGPIGGYRKWLKAHVQGLDWLPSLRTAKREEVEASEEDEEVQALRAELEQAQTVKERFKSAALKIRKENAELRDINIATTKALEQETKRARKEKHGHEKFRGALWGSNCELKLRREERDQSRALSMVLKE

SEQ ID NO: 133281 - protein, 102 aa, Glycine max
  Coding DNA Sequence Number=SeqID_41596
MSHGPALERQFAAQEFHILQSSVETQGIGRRREAVEAEEYSQQMVERGHGMHYMPPTFSQYPSQMYQYPFEGHHTDTSTSEHSFGGVAETHPHFSWPSMTPS

SEQ ID NO: 133282 - protein, 312 aa, Glycine max
  Coding DNA Sequence Number=SeqID_41597
  Homolog annotation: Hit_ID=A8GIN3; Match level="QueryCoverage=99%, HitCoverage=34%, E-value=1e-61, Identity=40%"; Hit description=Lytic transglycosylase catalytic
YQQYALLNQLRPIYSDINTKSAGEGLASVQSIRPTGSEDDFAFRQQRYQQAIQKYQQVIGAREKDPGGWLAQNSPEVKAAYQAYQQDPSQGALLAQAILVDKSRLGIKSKDVLPDALADGILQQIDTSKEQSVAAIQNIAGQFGPYADQVMQQVQKKSGPVLQVVMATDNPRSANTLWQNRNVKTGDIKDAINTDNKGASDNADSEWASQSKDFATTMVNQPGGVGVWNNFNEQGRRLTYLNIQKGMSPSDAAKQAYQDVLGSQYQTQGSWRLPVKYGLDLSDVRDGANHYLENLKAEQIMPLQGDPRLGDE

SEQ ID NO: 133283 - protein, 121 aa, Glycine max
  Coding DNA Sequence Number=SeqID_41598
MTRGNPSDLQPFDPEIDRTFHRLVRHHFIPFDHSEHSITSESVHSVIGDFEHPDLEHYNFEHSDYEHSDFAHSENMAQPPPRERTLREMVAPDFTYESLCIQYPDEDVPYVLKTGLIHLLP

SEQ ID NO: 133284 - protein, 140 aa, Glycine max
  Coding DNA Sequence Number=SeqID_41599
  Subcellular localization annotation: CTP_CleavageSite=57; ConfidenceScore=5.36e-01
MVKVGTSYVPINVSFRQKLAQGFPVSTGTPGFIYSKCEGSCRSQLSFLFSTETGWLSASQFAHKHTEPEHQRGKCSRGAQAELTITPLIACAHCRFPVRTCQAAQLLNESANARAIEAGLCVLRQALRAECAYWLTMLGN

SEQ ID NO: 133285 - protein, 153 aa, Glycine max
  Coding DNA Sequence Number=SeqID_41600
MPRRRNVPSRLRADRVWPGRISQCFTSAGMVSEEEVAAIKRSSLKTHQISCNHATPIPKWGTGAYEGRFFEDPNDEGLTINFNRDVSQMMNEEEEEDVLSPELERLIAQEEREMKPHQEKTELVNLGTTEEKKEVKVGTGMTAPIRQGLINPS

SEQ ID NO: 133286 - protein, 144 aa, Glycine max
  Coding DNA Sequence Number=SeqID_41601
MGSYGGHSSTGEGATTIWLHSEHPYVAYDRWMHFADHVLAVGELCLVPGQAGDQPRDAPAADPEEYMQPPSPQVPVAFDPPPHAVDDYDGYEAIALRLERVLNLRMVTAGTKLYDIMQDYLTIARRGASADRSVRARQRRRTEH

SEQ ID NO: 133287 - protein, 93 aa, Glycine max
  Coding DNA Sequence Number=SeqID_41602
GVVLAEVLLADSRFTRPDMGFHPTKLNFVPSDADEAPLDVFHLPACLWYCGVLTIGSCVAYLPNGIRVASQTHSIQASLLGTLEDFKVPHVNH

SEQ ID NO: 133288 - protein, 249 aa, Glycine max
  Coding DNA Sequence Number=SeqID_41603
  Homolog annotation: Hit_ID=Q2HW90; Match level="QueryCoverage=71%, HitCoverage=39%, E-value=1e-14, Identity=28%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSVFYPSTTRVAKVVKISAQELDRKGQRPWQIKANGLSFIDILALLIFGVVLFPNMEGLVDLAAIDAFLAFHHGKESPVVAILAMILSSCEGCPMRGVPSDESITPFIARGFSDHNARDRELRGSSNGIIDGYHKWLRVRTQGLDWLPNLKTVRDDEVKASEESDEVQALKAELERA

SEQ ID NO: 133289 - protein, 164 aa, Glycine max
  Coding DNA Sequence Number=SeqID_41604
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=75%, E-value=4e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVPAVLLPLRTTPSVAEQEGQLIETEATGAPQKHHHTLNQ

SEQ ID NO: 133290 - protein, 141 aa, Glycine max
  Coding DNA Sequence Number=SeqID_41605
MVKVGTSYVPINVSFRQKVGPGLPGINRDTRIYLFCEHRRTSALASVAVTLRVTTTPAALNAPLQGASHSPFRLRNCWEGRSVRASSLLRQLAKGGCAARRLSWVLALAVVSAGVAVATVTIKLIDTVDLEGGPGTSFCSL

SEQ ID NO: 133291 - protein, 125 aa, Glycine max
  Coding DNA Sequence Number=SeqID_41606
  Gene Ontology: Biological process=cell division
  Homolog annotation: Hit_ID=Q8U4X1; Match level="QueryCoverage=100%, HitCoverage=100%, E-value=2e-61, Identity=95%"; Hit description =Putative uncharacterized protein
  Pfam annotation: Domain name=ZapA; Domain location=4-115; Score=93.0; E_value=9.3e-25; Accession=PF05164.4; Description=Cell division protein ZapA
MAQVTVMIDGKAYRMACEAGQEDHLTDLATRFDRYVGHLKSQFGEIGDLRLTVMAGIMVMDELSELNRKIEKLEGEVASLSRNRDGMAEHKAKSDEMVALAIGDLADRLNGITEKLLDRPKPAAH

SEQ ID NO: 133292 - protein, 391 aa, Glycine max
  Coding DNA Sequence Number=SeqID_41607
  Gene Ontology: Mol. function=protein dimerization activity; Biological process=proteolysis
  Homolog annotation: Hit_ID=P76052; Match level="QueryCoverage=100%, HitCoverage=81%, E-value=1e-173, Identity=76%"; Hit description =Aminobenzoyl-glutamate utilization protein B
  Pfam annotation: Domain name=M20_dimer; Domain location=181-286; Score=19.4; E_value=0.0038; Accession=PF07687.5; Description =Peptidase dimerisation domain
  Pfam annotation: Domain name=Peptidase_M20; Domain location=77-290; Score=-10.0; E_value=0.0067; Accession=PF01546.19; Description =Peptidase family M20M25M40
  Pfam module annotation: Pfam domain module=M20_dimer::Peptidase_M20; Domain location=181-286::77-290
MQDNYAFIADAIDTRCRTLTDIADAIWDHPETRFEEFWSAERLASALEAEGFTLTREAGGIPNAFIASFGSGKPVIALLGEYDALAGLSQQAHCATPQSPTPGANGHGCGHNLLGTAALAGAVAVKSWLEQHGGGGTVRFYGCPGEEGGSGKTFMVREGLFDDVDAAVTWHPEAFAGMFNVSTLANIQAAWRFKGVAAHAANSPHLGRSALDAVTLMTTGTNFLNEHIIEKARVHYAITDTGGISPNVVQAQAEVLYLIRAPEMADAQHIYARIEKIAQGAALMTETSVECRFDKACSSYLPNRTLEAAMYRALQHYGTPAWTEKERAFAREIRTTLTPNDLQNSLKNIAATGGDEGKAFARRHQETLLVDEVAPYAITANVLAGSTDVGD

SEQ ID NO: 133293 - protein, 131 aa, Glycine max
  Coding DNA Sequence Number=SeqID_41608
MVELLRTNSTDISRRSPTGIPTIQQALQQQGIKNSDRLKILFQYGKTENSKQYPPLQRHTFVKWWSQFDTSKAAPEQVKNWFQSNPEFLKPADPETSLFLNQKSQLVAFLASSKSKESLTQNLKEVLQLLQ

SEQ ID NO: 133294 - protein, 295 aa, Glycine max
  Coding DNA Sequence Number=SeqID_41609
  Homolog annotation: Hit_ID=Q2HW90; Match level="QueryCoverage=49%, HitCoverage=31%, E-value=1e-14, Identity=35%"; Hit description =Putative uncharacterized protein
MGTNQTGKRFYQVKIKGLDITSIKELGRLMGPLQMQAFRKACFTFGDFQLVSTVEEFEEILGCPLGGRKPYLFSGFLPSLSKIAVVVRDSARGSDRVKQTRNDIVGLPRKYLEEEWIPFVDVLALLIFGVVLFPNVDGLVDLAAIDAFLAYHHSKESPVVAILADLFDTFDRRCEKSSAQIICCLPALCSRLGPTLGWDRRQNNQLVSSMEGRKGGSSLLMWGLPKHPIDRDEGGAPTEESLSPFLVRDFGAQSFKVIQRVHKAWESPLRKDKELRGIRNGIFGGYHEWLKVHTR

SEQ ID NO: 133295 - protein, 71 aa, Glycine max
  Coding DNA Sequence Number=SeqID_41610
  Homolog annotation: Hit_ID=A7QFF8; Match level="QueryCoverage=39%, HitCoverage=31%, E-value=6e-08, Identity=96%"; Hit description =Chromosome chr8 scaffold_88, whole genome shotgun sequence
MGAGHARSRYLNRKEGDAEGRASDWSEVVTRKERDGVSLAFGIAGPGGRLARRAISSVVERASDNCVVVPG

SEQ ID NO: 133296 - protein, 97 aa, Glycine max
  Coding DNA Sequence Number=SeqID_41611
MTETSMRAGNSDVYGFLEPQTIHRSGQSQFESKSYMKSWIHWQMVVILPKENVVVWFFSLHNRPNNYLKGIINSALKGLDDTPQPKSKAGARWIVIK

SEQ ID NO: 133297 - protein, 134 aa, Glycine max
  Coding DNA Sequence Number=SeqID_41612
MVTRDSRQPRGAKLVSYTDFRGPLLDDMRPFFGPCEGQLSYPNFVRGPLLDDVRPFFGPREKAVASGGSNPARLGELGGNLLPYFAINRGGRQEGRAEALPKRFRNVFREESRKGFNRSSTFFIRSSSFFDLQR

SEQ ID NO: 133298 - protein, 191 aa, Glycine max
  Coding DNA Sequence Number=SeqID_41613
  Homolog annotation: Hit_ID=Q84VI1; Match level="QueryCoverage=100%, HitCoverage=28%, E-value=3e-60, Identity=67%"; Hit description =Envelope-like protein
MATSPKETSASGSPAVPSSPHQEQPEFNIQPIQIIPGQASVPEKLVPRRQQGVKIAENPSLATSPREVDTEMDKKIRGIVSSILKDASVPDAEKDVPTSSTPDVSVPDVNKDVPTSSAPNAEALPSPSEEESTEEEDQASEETPAPRAPEPAPGDLIDLEEVESDEEPIANRLAPGIAERLQSRKAKTPIK

SEQ ID NO: 133299 - protein, 319 aa, Glycine max
  Coding DNA Sequence Number=SeqID_41614
  Homolog annotation: Hit_ID=Q6WAY6; Match level="QueryCoverage=68%, HitCoverage=38%, E-value=2e-10, Identity=25%"; Hit description =Putative uncharacterized protein
MARVAKVVKILVQELEREALGGEGKSFGRSREWTSFVDVLAVLVFGIVLFSNVDGLLDWEELWAGFPNVPLMGTRGGVNYNPMLAIRQLGYPMRGVPSEEIIAPFITWGFNEGNIQRVQKAWNVVERRDRELRGSSNGIIGGYHKWLKARTQEITWLPKLKSPSGEEAEVPKESEEVQALKAELERVKECDELRHANMTTAEAAKRDESRVEGMILEDKLKACQRSKRSLTEQLSRTEENMLTIIDQYKEKLNLAASHEQRLEDKHAKVSALHVEKEARERVIESLHGKAMKWLDRFAHTLNGSQELSSLLAKAKAMAD

SEQ ID NO: 133300 - protein, 331 aa, Glycine max
  Coding DNA Sequence Number=SeqID_41615
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-38, Identity=30%"; Hit description= UPI00006A17C9 related cluster
MLVHTIRTCLFAVARVKSCPGMHSSYVIASLSGCIHKVGALQYQGMWSPLKARTRSPLKARVCSTLMLETYRSLKVRACMPLKARACSPLMVRACSPLKARTCIPMKARACNPMKARACSPLMVKACSPLKARTCSPLKARTHSPLKVRACSPLKARTCSPLKVRTCSPLMARTCSPLKVRACSPQQERMCSPLKARMRSPLKVKVCSPLMARTCNPMKARACNPMKARACSSLMVRACSPQKPRTCSPLKARTHSPLKVRACSPMKARTCSPMKVRACNPMKARTCSPLMVRACSPLKTRTCSPPKARTRSPLKARACSPLKARTCSPRK

SEQ ID NO: 133301 - protein, 151 aa, Glycine max
  Coding DNA Sequence Number=SeqID_41616
  Homolog annotation: Hit_ID=A5AF01; Match level="QueryCoverage=70%, HitCoverage=9%, E-value=4e-07, Identity=35%"; Hit description =Putative uncharacterized protein
MESQIPTDLKYFSSFALSWIFSWQYRYSKTEKTNQYPSLQRHAFVKWWSQFDSSKADPEQVKLSFQSHPEFLKAVDPETSVFLNQKSHLAVFLARSKSKEIQTKNLKEVLQMLQQEEEGSSSKKEETSSAEEEEEDPFYQNKDDCFGICLD

SEQ ID NO: 133302 - protein, 198 aa, Glycine max
  Coding DNA Sequence Number=SeqID_41617
GLRCPTARYLDPTKGVGRLRQQDGGHGSRNPLRRRGGRCKTQGASPGGAVVGADLGGSSKYSNENFEGRRGERFHGIGLKFLNRDVAADGNVRESGDVGGGPGKSYLFCLTTCPPWKRLSRRVTLVTRIILMRSPEGQFPESGGGKGLARSTEIQASSPGFVPPLQITNKPCPPQKTNQSGVCPGGRTTKPLLPLVPA

SEQ ID NO: 133303 - protein, 286 aa, Glycine max
  Coding DNA Sequence Number=SeqID_41618
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPRRQNPSSLNFFFKSTEIWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133304 - protein, 72 aa, Glycine max
  Coding DNA Sequence Number=SeqID_41619
MGNAFQCLQSQGFTSFPCPTPDQFRAEFAWLEDWPEARAGEAPAEAPDEADEAREDEEMTDLLDFLGGSGAT

SEQ ID NO: 133305 - protein, 142 aa, Glycine max
  Coding DNA Sequence Number=SeqID_41620
  Pfam annotation: Domain name=G-patch; Domain location=1-42; Score =28.1; E_value=3.2e-05; Accession=PF01585.14; Description=G-patch domain
MVARVMLKHGFEPGMGLGKDGLGNADVVDIKGNPYKYGLGYEPGMPGRRNVPSRLRADRVWPDRIGQCFANAGLMSKEEVAAVGEEFPQDPPNFVQPCHPDSQVGNWRVISQSEVYTTDSIYEGRFFEDPNNEGLTIDFDRD

SEQ ID NO: 133306 - protein, 146 aa, Glycine max
  Coding DNA Sequence Number=SeqID_41621
  Homolog annotation: Hit_ID=A0PAV3; Match level="QueryCoverage=26%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIRPTRPTSSRSRAAARDLELADAWVESSLSIPSTSRGGPVPAFVPFSEG

SEQ ID NO: 133307 - protein, 71 aa, Glycine max
  Coding DNA Sequence Number=SeqID_41622
MTPVNRKAGTGERTREPPGGNAGIFIVLSGFATTDLSVRFRDACQGGGAYGKTALPRPSHFPVEVCDSSRL

SEQ ID NO: 133308 - protein, 64 aa, Glycine max
  Coding DNA Sequence Number=SeqID_41623
MTLFCTRLPIESKIKRGVGYRQSRTTLNGNLKGRDTKNGFSFAGSHLPCRKFIWSEDLPFSLFH

SEQ ID NO: 133309 - protein, 216 aa, Glycine max
  Coding DNA Sequence Number=SeqID_41624
  Homolog annotation: Hit_ID=Q84VI1; Match level="QueryCoverage=93%, HitCoverage=29%, E-value=2e-72, Identity=74%"; Hit description =Envelope-like protein
MATSPKETADSGSPAVPSSPHQEQLEFNIQPIQIIPGQASVPEKLVPRRQQGVKISENPSLATSPREVDTEMDKKIRSIVSSILKDASVPEADEDVPTSSTPNVSVPDVNKDVPTSSAPNAEALPSPSEEESTEEEDQASEETPAPRAPEPAPGNLIDLEEVESDEEPIANRLAPGIAERLQGRKGKTPIKRSGRIKTMAQKKSTPVTPTTSRRSK

SEQ ID NO: 133310 - protein, 108 aa, Glycine max
  Coding DNA Sequence Number=SeqID_41625
  Subcellular localization annotation: CTP_CleavageSite=82; ConfidenceScore=5.34e-01
MGVQIATRPTWALQKIPPEGFCFWRKQPCSPGQAGKSKPRRFRNVSVSDFAKVFDRSSMFFIRSSSFFSLQREQKPRFCRPPQEIVNGPNALTFLSFQKQEIVNGPTP

SEQ ID NO: 133311 - protein, 113 aa, Glycine max
  Coding DNA Sequence Number=SeqID_41626
MHCMLVSSFVTEKPEGPYHLLNCTHGALRPQMCNIGDQNCHSLDYRVEPSSSFYKKVHQVKLKYGSNRLAKLGQKMNRVTSLLRPLPNIFRIIDVLVTSSFTLTKMSWTMLKI

SEQ ID NO: 133312 - protein, 122 aa, Glycine max
  Coding DNA Sequence Number=SeqID_41627
MVLSAVPSCSVLTGWCVIGKSIPTGHSGQVRVPFAIQAAQLFGKGDRCGPLRYYAPAGERGMCCKFAIKLGNARVSVTTLYKRRHSELYDSLMRVRIGAPPRWQASEKVPGLQEFDYYVNRI

SEQ ID NO: 133313 - protein, 251 aa, Glycine max
  Coding DNA Sequence Number=SeqID_41628
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSMEFSKMFVREEVHQRGREIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133314 - protein, 101 aa, Glycine max
  Coding DNA Sequence Number=SeqID_41629
MEKSDKMNFKEKKEKKGYITWEDNAINYSSDSEKKIISLGIMMKDYENGEEQSRYIDSNFSKHMACIKVYSHFSPRKVNLKKSEYMIYGDNKGHLINKPNK

SEQ ID NO: 133315 - protein, 264 aa, Glycine max
  Coding DNA Sequence Number=SeqID_41630
MAKSSYARNFEAPEEDEEVQALKLELGKARLAKEKFKSAATNIRKECTKLREENAATARALEQETKRARKEEHDRDKFRGALWGSNNELKLRREERDQSRVHGMILKEELAACARSKRSLAQHLEATEQSMLAIIGQYKEELNQSVTHEQKLVEDFAQVYAEKEARGRVIDALHQEATMWMDREFTITKKAQRHPYNTRSRKMDNEEGVQEQMKADLSALKDQMASITEAMLKLQKTIEDNATATASNAVREAEPVLQPVINLG

SEQ ID NO: 133316 - protein, 139 aa, Glycine max
  Coding DNA Sequence Number=SeqID_41631
  Subcellular localization annotation: CTP_CleavageSite=53; ConfidenceScore=5.39e-01
MTSADNCKVSPHATGLSGHWIAKGVCGLPSGVSTCPSDSWVTVTKSGVVDKSRAFAPTYPQFVMRNSDLRSSCESGVFACYRTLGSLDSKGCLRVIIGCFRMPPDSWVTVTKGGVVDKSRAFAPTYPQFVMRNSDLRSS

SEQ ID NO: 133317 - protein, 121 aa, Glycine max
  Coding DNA Sequence Number=SeqID_41632
DPLYQTELDDFEAELERHNFHKHLTNLADGSIDLALGETLPAYSRYCRLPTNFREIKAALCIPSRGFILNSKGQPGKILRKDLTTLAQPNTSRLGFPALITALCRARGVVSDSLTFECLSP

SEQ ID NO: 133318 - protein, 70 aa, Glycine max
  Coding DNA Sequence Number=SeqID_41633
MPADPYSIVADPSSPKLEVAPPSSPIIIISEDSIESASGEVVALSNSPVFHLIDEEDAQTRDTQDQSQDF

SEQ ID NO: 133319 - protein, 225 aa, Glycine max
  Coding DNA Sequence Number=SeqID_41634
MGEVEEVQEQMKADMEAMKEKMATKMEAMMSMKKIMEVKAVQLPLQHCSMVGKIWEARAAPHYAQSQNRQAFPPYGLPPNYTPPNVAYTPSENVNNSTPILIESGQPQTDHAHVSQPMGETHEMPHHNLVDFEPCLEYATEGQAIGGIPLQNPLEGPQYHPQLHLLHYTTSKNPHAMAEMGKLDHLEERLRAIEGGEDYAFANLGELFLVPNIITPPKFKVLDFD

SEQ ID NO: 133320 - protein, 58 aa, Glycine max
  Coding DNA Sequence Number=SeqID_41635
GRIILGNGQRSRQGQRQKPIKVLRDGRKERLGSRPMGRRPLPSSGQMESAAARQPSIL

SEQ ID NO: 133321 - protein, 52 aa, Glycine max
  Coding DNA Sequence Number=SeqID_41636
MYGLPNLIEGITDAIHPRKGPITRTMSKRLQEDWARVAEEGPRVLMNLRVDF

SEQ ID NO: 133322 - protein, 139 aa, Glycine max
  Coding DNA Sequence Number=SeqID_41637
MLRNFTDCVTTLPFDFRHVTELHVLCNNGCKNTSKWSYESRTPPNNGPRTKLGYDTLDKESTRRLQHLSFSKDKVQDLLNQALLKQKEETQALINQSIAQQMKETRKELQAYVEQKRLENKQYKKSIQSAIATQFTGLS

SEQ ID NO: 133323 - protein, 266 aa, Glycine max
  Coding DNA Sequence Number=SeqID_41638
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A7MG54; Match level="QueryCoverage=99%, HitCoverage=77%, E-value=1e-123, Identity=81%"; Hit description =Putative uncharacterized protein
  Pfam annotation: Domain name=ADH_N; Domain location=1-65; Score=0.6; E_value=0.0011; Accession=PF08240.3; Description=Alcohol dehydrogenase GroES-like domai
  Pfam annotation: Domain name=ADH_zinc_N; Domain location=95-229; Score=122.3; E_value=1.4e-33; Accession=PF00107.17; Description=Zinc- binding dehydrogenase
  Pfam annotation: Domain name=AlaDh_PNT_C; Domain location=68-211; Score=-51.8; E_value=0.016; Accession=PF01262.12; Description =Alanine dehydrogenasePNT, C-terminal domain
  Pfam annotation: Domain name=NAD_binding_2; Domain location=96-212; Score=-87.8; E_value=0.064; Accession=PF03446.6; Description=NAD binding domain of 6-phosphogluconate dehydrogenase
  Pfam annotation: Domain name=ThiF; Domain location=95-224; Score= -35.8; E_value=0.002; Accession=PF00899.12; Description=ThiF family
  Pfam annotation: Domain name=TrkA_N; Domain location=99-211; Score= -12.3; E_value=0.076; Accession=PF02254.9; Description=TrkA-N domain
  Pfam module annotation: Pfam domain module=ADH_N::ADH_zinc_N::AlaDh _PNT_C::NAD_binding_2::ThiF::TrkA_N; Domain location=1-65::95-229::68- 211::96-212::95-224::99-211
MRAQDKGLKVGQRVGIGWTAKSCQHCDACINGEQVNCENGSVPTIMNKGGFASHLRADWQWVIPLPESMDITSAGPLLCGGITVFKPLLMHHVTATSRVGVIGIGGLGHMAIKLLRAMGAEVTAFSSNASKTESIKAMGADRVVNSRDPQALNALAGQFDLIISTVAVDLDWQPYFQALAPHGKFHTVGAVMKPFEVPAFSLILGDRAVTGSSTGSPGQLRKLMRLASRADVAPQVEEFPMSKINEALDHVRAGKANYRVVLKADF

SEQ ID NO: 133324 - protein, 89 aa, Glycine max
  Coding DNA Sequence Number=SeqID_41639
MRLPGKESLLMGSPITINEILDVSISFLNDHLEETLGSTKIEENHSKCINLAQCGAKKKSLAHGILVGNQREKTILGRGFLSSLFLFIW

SEQ ID NO: 133325 - protein, 35 aa, Glycine max
  Coding DNA Sequence Number=SeqID_41640
AAVSPAKPSDKPNPEVDDPLYLMTLIIPQLFLKPL

SEQ ID NO: 133326 - protein, 91 aa, Glycine max
  Coding DNA Sequence Number=SeqID_41641
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKVGPGLPGIKQGHQDLFILRSDLPSQVLQWLLFLSAVPPVQLLTGWCVTAKAPPDISAGKCSGHAARNHHTRRA

SEQ ID NO: 133327 - protein, 81 aa, Glycine max
  Coding DNA Sequence Number=SeqID_41642
  Homolog annotation: Hit_ID=A5AZ88; Match level="QueryCoverage=77%, HitCoverage=6%, E-value=1e-07, Identity=34%"; Hit description =Putative uncharacterized protein
IEEDADIPLILGRPFMSTASCMVDIGKKMLQMGIEDQKIKFDLFDEDKDPPSQNVCLKVHVMEERRLEKKVLEVGTLLDPG

SEQ ID NO: 133328 - protein, 103 aa, Glycine max
  Coding DNA Sequence Number=SeqID_41643
FHEQFQHINITNIITKTLKQNGKLTKLPIISPKTPYPRKSKEKEVHPNLKFRSPTRSHALHDSKNALLSRFGAEMSTKGWSFVGVSMENGGEGKSNVRKRESF

SEQ ID NO: 133329 - protein, 72 aa, Glycine max
  Coding DNA Sequence Number=SeqID_41644
VRWDATVFGVVNPYFPLYIKHEDLSKIAHGGQCLSISMLQLWILPDNYLKGIINSAIKGLDDAPQPKSKALA

SEQ ID NO: 133330 - protein, 109 aa, Glycine max
  Coding DNA Sequence Number=SeqID_41645
QLQYSRAGCQDIVSDIVDPAASLLHLTFILHCTTTPVFSGRIPISFLDITLDIMCSNSSFPSLSKASVFNYERLDILWDSIGHPSKRASVFNYESLDILRDSIGHPSKK

SEQ ID NO: 133331 - protein, 56 aa, Glycine max
  Coding DNA Sequence Number=SeqID_41646
MGRLFHKNLTALHTICLITTTCKLVIDYQRLPKFPDFFFKPGNRLHPLVIDYQRPS

SEQ ID NO: 133332 - protein, 71 aa, Glycine max
  Coding DNA Sequence Number=SeqID_41647
MAYKTKPNMVQSNTDQSKETDSEKLNFEVETEDKHAATQAVNWPLDEEKFEEEEQEEADYLPVKFGGRGIL

SEQ ID NO: 133333 - protein, 36 aa, Glycine max
  Coding DNA Sequence Number=SeqID_41648
SIEPVSRAEALIPDDVILTRSGLLDTENKDLDDATS

SEQ ID NO: 133334 - protein, 130 aa, Glycine max
  Coding DNA Sequence Number=SeqID_41649
  Subcellular localization annotation: CTP_CleavageSite=57; ConfidenceScore=5.30e-01
MSAFTFSCTSSALPITLALAQIFNMVHDIFIKVKLEVTGTSTALNVFGSRRSSDVTRAFRKMVTSILQLDSMNLFVKARAWFNPITQGMAILIVNTSSTFHWDERLENTHAMHGKCNYEIEMSKETSFLS

SEQ ID NO: 133335 - protein, 24 aa, Glycine max
  Coding DNA Sequence Number=SeqID_41650
EFREGFDRSSTFFIRSSSFFDLQW

SEQ ID NO: 133336 - protein, 80 aa, Glycine max
  Coding DNA Sequence Number=SeqID_41651
  Gene Ontology: Mol. function=catalytic activity; Biological process =metabolic process
  Homolog annotation: Hit_ID=Q9MB42; Match level="QueryCoverage=62%, HitCoverage=6%, E-value=4e-10, Identity=68%"; Hit description=Beta -amyrin synthase
MALGLHFVVLAAASKTYTNCAAIRKTVKFLLSTLKEDGNIVVEHDYAECTGSAIQALVLFKKLYPRHRETEIKNSINAVM

SEQ ID NO: 133337 - protein, 528 aa, Glycine max
  Coding DNA Sequence Number=SeqID_41652
  Gene Ontology: Mol. function=protein serine/threonine kinase activity
  Homolog annotation: Hit_ID=A5FD53; Match level="QueryCoverage=81%, HitCoverage=99%, E-value=1e-102, Identity=50%"; Hit description =Putative uncharacterized protein precursor
MRKLTLIAVTALSLTACRENDSLSDSSKFEMQSASAEYLTASALPVTTVSGAITTNTTWSGVVEIDGIVTVKGGATLTIQPGTFIKAKPNTTNTPTGVLVIAKTGKINATGTASQPIIFTSYRLLDGDEDTTATPGDFGGVIMLGDAPTNKPTTTVIEGLTGADYQYGGTNAAHNGGTIKYARIEFGGFDLFAPNSGNEINGLTLGGVGNGTTLDHIQVSYGKDDSFEFFGGTVNASNLVSFAPDDDNFDFDFGYTGTITCALALADYNSTHSQSGGVSDTNGIELDNDGTGSTASPFTRPTIKNLTIVGAKSPLKGGLYENAIHVRRNGYPIGILLETQSSAPVNLADLSFTGVQAHGFTFATASKIGTTTAALTIPGVTTSTSNPANLWGMSQPFFNEATAWNVSPRNCGDFQVSAQYPVWTNSFNSTSDMQGWSFHDLNGNGNGWVQGPNIYHNGTSLAYGGAGSLRYSISNVPSGNVAGFTTENDWAISPEIDLTSSSGTITLAAYIGRQRTTHQVVKRYLYIY

SEQ ID NO: 133338 - protein, 107 aa, Glycine max
  Coding DNA Sequence Number=SeqID_41653
TGEARLIALCARTPKGNRPAHPGNGSAGVPNPSAVGGLLELLPRRERVVACRSGDGFGNGPFGASSPGVEQSTQNCALNVKVKKFNQARVNGGSNYDSLKVAKCLVI

SEQ ID NO: 133339 - protein, 107 aa, Glycine max
  Coding DNA Sequence Number=SeqID_41654
MSLSAEHQQRFEAIKGWSFHRERRAQLRKDEYTDFQEEIARRRWTSLVTPMAKFDLEIVLEFYANAWPTEEGVRDMHSWVRGQWIPFDADALSQFLGDPLVLEEGQQ

SEQ ID NO: 133340 - protein, 27 aa, Glycine max
  Coding DNA Sequence Number=SeqID_41655
MEYETPPRVVSSTRHENSSQKSPTNRI

SEQ ID NO: 133341 - protein, 443 aa, Glycine max
  Coding DNA Sequence Number=SeqID_41656
  Gene Ontology: Mol. function=triacylglycerol lipase activity; Biological process=lipid metabolic process
  Homolog annotation: Hit_ID=A5AYQ6; Match level="QueryCoverage=92%, HitCoverage=31%, E-value=1e-119, Identity=54%"; Hit description =Putative uncharacterized protein
MGNAGVDLKWLCDGDVHEILIELEGMGGGGKVQLEVKYKSYDEIDEEKRWWKIPFVLDFLKIKGFDSAFRNVIGSDTVQAGQFVEYAFGQLKSFNNSYLLKGQQSDINNDKYDPEGTRELNESVSIFNMPSEEAGSSEASSEDFIEQRNSNEFHKQDNDTENGHASESLSKVSEEGLSNQIFWRNFANVINSSIAQKLGLSVPEKFKWDGLEFLNKIGSQSQNIAESIYVQSGLAIPGGTDDTNDKISGQPAIAAFQSSVPEVKKATQKLMRQTESILGGLMLLTATVSKIKDEGCSSEERIIKENSTKAGSNDIQYSTSPKFPSSQNGLVLDDKKTEEMKELFSTAESAMEAWAMLATSLGQPSFIKSEFEKICFLDNASTDTQTQWKDLRTDLMLVPAGLNPERIGGDFKQEIQVHSGFLSAYDSVRTRIISLIRLAIGYV

SEQ ID NO: 133342 - protein, 127 aa, Glycine max
  Coding DNA Sequence Number=SeqID_41657
MARLNHPSKEPHTELNLITPLQSKKKHEARPSLYHQPFCHHIIKHLKGISKHPIINTHPEQHVIWSLNKMGFKFTFINQRNYAPKWGVQCEEAIEEDEVGVEVEFVGARKRVGAKRTRELEMLEGTR

SEQ ID NO: 133343 - protein, 224 aa, Glycine max
  Coding DNA Sequence Number=SeqID_41658
RKNAIMRPPLIMQFIAAFNNDKNTIQLPAFYHTQWAPNYPEMVHLRYNGAIYEVRVRQHRDKVYLADGLQSFRKDLKIYKSTSTNFFACDHHSVFDIHFIPPLERQTCGRQRHSSRKHIWTLQLTQEMLDHPEPLKLPHCTKVPFRACGNHMTVLRRHGPSLQWKVETLNPAIGGKGVVQPWYDFLEEMDFDDGDEISIYYRYYEKIWDIIIRRQEDWEDDDSD

SEQ ID NO: 133344 - protein, 827 aa, Glycine max
  Coding DNA Sequence Number=SeqID_41659
  Gene Ontology: Mol. function=solute:hydrogen antiporter activity; Cellular component=integral to membrane; Biological process =regulation of pH
  Homolog annotation: Hit_ID=A7R3F8; Match level="QueryCoverage=94%, HitCoverage=65%, E-value=1e-135, Identity=33%"; Hit description =Chromosome chr4 scaffold_519, whole genome shotgun sequence
  Pfam annotation: Domain name=Na_H_Exchanger; Domain location=55-443; Score=127.8; E_value=3.2e-35; Accession=PF00999.12; Description =Sodiumhydrogen exchanger family
MATLANFRPPYSIPNPPPDAIPELACYNSTMDLSNNIWRGGNVIGERVPLLSIQIAYSVLLSSIFHRIFKSFHLPLMVSQILSGAILSSSLMGRVPGIFNTLYRPEGILAVETFANLGVMYYVFLNGLEMNCDTIIRSSKKAITIALVCILIPMLGGAGFLALEHRVSGGSAKPTVSTKGYFFCCAILAVTGFPVVARLLSGLKILYTRLGKDALTAAMLIDAYGWIVFTILIPYSHDRGGKPLLSAICTFLFIVFCFYVVRPILTRIINRKIRLETWDSSGLLDVMVGLFICSSITDFLGAHHVVGAFVYGLILPSGKFADLMMEILDDVVTALIVPIYFASFGFRLHLEALWAVHNSVLFPVLMVLLLTIPKVLGSMLATFYFGMSARDGLGLGLLLNTKGIMAVIMLSVAWDKNLLDPYAFTIMMLAILFMTVLVSPLINVIYKPKLRFMQTQQRTVQKLRNDAELRVAVCVHNAHQATGMIHVLEATNATRISPLQVSVLHLVELTRHGTGLLVAQMDNPSSVQGESHYGSQEEFESISKAFEEFSEEYNAVRFETSSIVSTYESIHEDIYTVTQEKRANLVLLPFHKQLSSEGVLDTTNNAFSGINQNVMQQPPCSVGIFVNRGLDSLLKTKMSIIMIFIGGPDDREALSIAWRMAGHSCTMLHVVRLLLSGTEVAEEEKAFHSDSNGLLSTVMDSVMQKELDDEQILHFRHKGVHNNDSISYSEKEVKIETGEEIPLILNEIDKPGYDLYILGQGSGKNYTALQKLLEWCDNPELGAMGDIVASTSFGTSSSLLVVQQYSMERKPKGYRKKCSKRNDPAIL

SEQ ID NO: 133345 - protein, 290 aa, Glycine max
  Coding DNA Sequence Number=SeqID_41660
MIKTGAGCLFKAIKSLLKLANMVGELRVSHARRQIQVVVLREEAQAQGLTQGSHVQAIRVLLVDQKMQLEVVRQETAFKDLSMVEWKQNYEINSEYDGLGGFSMVVANVSYLCPRLVRRWKTFSLSGTGFPIAARHVPEFPKDMYHLNKKAVSIRKHLERNKKDKDSKFSSDSLSPRTLNPFSNETNKPSHRLFLLIVTSITALTSLNLAGTDAAIATLRHRFRQRRGKLGASQLGRLGLGSPLVSLIFSRRFCELVDGRGVRMATGRKERWSEMVDKDGEGNGWTVPLW

SEQ ID NO: 133346 - protein, 121 aa, Glycine max
  Coding DNA Sequence Number=SeqID_41661
ELQLLIRDEEVHTGLAVEIIFENGVWAKEGQNEDLIDWTVVGNVEFDGGYDDDRATYPFGVCGTSSFMCGLEGEIGGGEGGGFGEGRAEVREASLLTASSRRLSDVWCMVCSDMVSPSIEQ

SEQ ID NO: 133347 - protein, 97 aa, Glycine max
  Coding DNA Sequence Number=SeqID_41662
MVQHVCLLILWLAGTCYKVDELNPESSHLWLQFSRFPSPRSGPRPCGKRMGTTDEVAKPSKKGTIFVEDLPEEEQVVVAVVLLDPLKIYAILQYVFA

SEQ ID NO: 133348 - protein, 120 aa, Glycine max
  Coding DNA Sequence Number=SeqID_41663
MEREMITIIVDTLPGFYYEKLVGYTPSSFVDLVFIGERIEVGLKRGKFDYPALMDGKPGENEENKKEGGTHDVTIVPTQTNFPPSQQSVGFFAQVTCAPELISKSVQSDTTRSIRLVWVP

SEQ ID NO: 133349 - protein, 130 aa, Glycine max
  Coding DNA Sequence Number=SeqID_41664
MAPKKILSKRARKGAAEEGSSATPQADIEFDEHRFRKRWVQLREREYMKFQEEVARRQWTQLTGPMAEYDSKIVMEFYANAWPTEEGVRDKNSWVWGQWVPYDEDAINQFLGHPLVLEEGQRCEFSERRS

SEQ ID NO: 133350 - protein, 62 aa, Glycine max
  Coding DNA Sequence Number=SeqID_41665
  Gene Ontology: Mol. function=aspartic-type endopeptidase activity; Biological process=DNA integration
  Homolog annotation: Hit_ID=A5BPC1; Match level="QueryCoverage=72%, HitCoverage=3%, E-value=5e-10, Identity=68%"; Hit description =Putative uncharacterized protein
MDTRIYQRITWESFGLWKSLVGFVFTAFGTAFSWKASLQKVVALSTIETEYMALTKAMKESL

SEQ ID NO: 133351 - protein, 96 aa, Glycine max
  Coding DNA Sequence Number=SeqID_41666
MVDVAAHSLPEEVLFKMSKGFGNAHVPPQGCRVELFQEQRDERVVEWQPYLTLVEYQDYAYHDARSVCFREKRNGEVRGVSIRVEVIACFNLSRVR

SEQ ID NO: 133352 - protein, 304 aa, Glycine max
  Coding DNA Sequence Number=SeqID_41667
  Subcellular localization annotation: CTP_CleavageSite=85; ConfidenceScore=5.45e-01
MSLDGADPPRPPSHDSCGKGTTAKKGRYVVRPLPPQDSLSSSTPSPSPVSVPVRPPDIAPTSSPPPTEVKPSSSHVNACGPSPVPASTPSPSSVDARGPSLVPTSSPSPSPTVANMPTDEESTNLAMEDPPLMIVLWFHPSKVAAKAITLSIRKQFGQPWLHRKRFQKIIMNFFSNILRTKTWSRCWVAAAGPKRKRRLYGTGDLAHTYKCGNDSFMQHTQGSSSRDEDASEINQLRVEVRQSKEEMCVFQPIILQFLPLEAKNIIHQQQQPHQQHDHVDDQQADDQHEHDDQQRHSPDDYFDY

SEQ ID NO: 133353 - protein, 247 aa, Glycine max
  Coding DNA Sequence Number=SeqID_41668
MVTYWWSVVLHGKTIGVNVEDDDSYMDTYVSPLSTQMTSNSVGEEEADDVHANRPWLLHLPRLLLLFPPPPADASASPSTLKRTRKATQLRSLATRPPGAERPVVNVDPTTDKTDDPHKKKLRTYLGIVARDKAEFEIPEASDSRTKKKIFQIVGKRLRQFKSDLTRKWALAANKNSANDIVCEKYGISKDKWTQFCQTRRDPSWEMCEEAAQKQNTAPHVLSCGGYEYLKKKLMAEKTKKRLEEAA

SEQ ID NO: 133354 - protein, 135 aa, Glycine max
  Coding DNA Sequence Number=SeqID_41669
MIESFQQQQQMSVLELYVEKDVVGGSMFHPANSVTSCGHNVSHHESELPRNISNLHDDEDDDDDYLASNSYVEESFDEDDRVDEISDTDDEVTDIVEPVSIVHPTEGVPGIQNPFWNDALHYNNINWSHSDEEDI

SEQ ID NO: 133355 - protein, 131 aa, Glycine max
  Coding DNA Sequence Number=SeqID_41670
EGDVDLNVSPQALDKLLGYVLAFKVKVQPKFNNVVVLRYSNDSDLINVVVDMLPDAEACSKVHAPILDSDDPSQLEFQYVFVTADHDPLLGLPLTPTKRITSDDCDDEPKSSQISPAQLSSNKLARHDQIE

SEQ ID NO: 133356 - protein, 87 aa, Glycine max
  Coding DNA Sequence Number=SeqID_41671
MHIERRPNQHSKSATWQKTKATQQAKWQKTKPKAEGRKKSKALFGERKIDSNKTNEEVKNSKRNKSKNGQQKRQTTTIKNEETKQTW

SEQ ID NO: 133357 - protein, 205 aa, Glycine max
  Coding DNA Sequence Number=SeqID_41672
MNLSDFIQNINLEVQTIEKTFLSQKLLKAVEKWEEDKKCQGQSFVNNETDSDDTDKGDEYIFRQKLFSTIDKENSDTDSTEDLLEKIDLQEFYEKEINFNNALEINSKIDETKSLVSFPKSYKGLMADAFGTSSNFTPQFDYSMEDYQMRFAPREKIIAPEDLALGDNIKSKGKRLPIEPTFNMSSLLLNIGSVNPQLLPNYIEQ

SEQ ID NO: 133358 - protein, 258 aa, Glycine max
  Coding DNA Sequence Number=SeqID_41673
  Gene Ontology: Mol. function=protein dimerization activity
  Homolog annotation: Hit_ID=Q53M48; Match level="QueryCoverage=30%, HitCoverage=7%, E-value=4e-09, Identity=43%"; Hit description=HAT family dimerisation domain, putative
MEVLKRKTDETTTKNNKLLRSAAEAASDAINKAQELVEGLKKTKDPSGTDLTSALEGLDVTLPHFPLQRLILEKLFKRKKEKGNEKFPSLRIQQWAVPPTPSSSPLCLLFPPSPTPSISSSPRRRRRLLFHNPIAAADMRRFLVDRENIENVNVVQPEAELEPPLNNVVNEFNPNEIVRDPGRRKQINEYAPDIQDQVRRAYILKGPMQPDLSNFPRTQFGSVKRAFSKSCNPGGPSTLVLKSSLKADIEIGSMHLKA

SEQ ID NO: 133359 - protein, 134 aa, Glycine max
  Coding DNA Sequence Number=SeqID_41674
  Gene Ontology: Mol. function=ubiquitin-protein ligase activity; Cellular component=ubiquitin ligase complex; Biological process =response to DNA damage stimulus
  Homolog annotation: Hit_ID=O22785; Match level="QueryCoverage=91%, HitCoverage=21%, E-value=3e-51, Identity=80%"; Hit description=Pre -mRNA-processing factor 19 homolog 2
  Pfam annotation: Domain name=Prp19; Domain location=36-105; Score =165.0; E_value=2e-46; Accession=PF08606.2; Description=Prp19Pso4-like
MGIAEDYGKCPITGEPLTMDDIVPIKTGKIVKPRPVQAASIPGMLGMFQNEWDGLMLSNFALEQQLHTARQELSHALYQHDAACRVIARLKKERDEARSVLAQAERQFPASAPNAITANDPVLSNGKRGFHVII

SEQ ID NO: 133360 - protein, 216 aa, Glycine max
  Coding DNA Sequence Number=SeqID_41675
  Homolog annotation: Hit_ID=A5C5S1; Match level="QueryCoverage=86%, HitCoverage=14%, E-value=7e-09, Identity=26%"; Hit description =Putative uncharacterized protein
MIAHIGKARAVVEELKRFLVADSLEEVNGKLDKLYMVLILRGLHSDFDHVRDQVLAGDQVPSMDSLVTKLLPVPHVLKDENLAEVVETSAMVAPRRRGGSRNNRGGRGGRSGCPQCTYCKRMEKSESKFSNEEYLEYLKLKSEKSNNQAQSSSVPCVSTTCISQSMEGSSSWILDSSASDHISGNKSSFSSISFPKTPYFVTVASGSKVASQGIGQ

SEQ ID NO: 133361 - protein, 128 aa, Glycine max
  Coding DNA Sequence Number=SeqID_41676
  Homolog annotation: Hit_ID=A5BVZ9; Match level="QueryCoverage=49%, HitCoverage=14%, E-value=3e-08, Identity=50%"; Hit description =Putative uncharacterized protein
MELDIFFVREKVLNKSLVVSYIPAQLQVADILTKSLSKHLFYNFRSKLRVLSTAELVGGVLERSLKFSYETRTLQPLAVSGVRHDTDVRVRVEFDVFDRCSHVRVRCPCQYWCFIGFRPFRELGGVKN

SEQ ID NO: 133362 - protein, 171 aa, Glycine max
  Coding DNA Sequence Number=SeqID_41677
  Gene Ontology: Mol. function=ubiquitin-protein ligase activity; Cellular component=ubiquitin ligase complex; Biological process =protein ubiquitination
  Homolog annotation: Hit_ID=A7NXH9; Match level="QueryCoverage=85%, HitCoverage=32%, E-value=1e-62, Identity=80%"; Hit description =Chromosome chr5 scaffold_2, whole genome shotgun sequence
  Pfam annotation: Domain name=WD40; Domain location=113-150; Score =32.9; E_value=1.2e-06; Accession=PF00400.23; Description=WD domain, G-beta repeat
  Pfam annotation: Domain name=WD40; Domain location=27-64; Score=8.5; E_value=2.8; Accession=PF00400.23; Description=WD domain, G-beta repeat
  Pfam annotation: Domain name=WD40; Domain location=71-109; Score =19.0; E_value=0.018; Accession=PF00400.23; Description=WD domain, G -beta repeat
  Pfam module annotation: Pfam domain module=WD40::WD40::WD40; Domain location=113-150::27-64::71-109
MASEHAVSTLRIVSPLCCVKLVELNYRQNHYALCLFQPVQAVTVHATNNYFVTASLDGSWCFYELSSGTCLTQVYDTSGSSEGYTSAAFHPDGLILGTGTTESLVKIWDVKSQANVARFDGHAGPVTAISFSENGYFLATAAHDGVKLWDLRKLKNFRNFAPYDSETPTSS

SEQ ID NO: 133363 - protein, 91 aa, Glycine max
  Coding DNA Sequence Number=SeqID_41678
MVEWRHGILEKCHQIVVALRVAYGGAMAAAIAMAPTIPEFLLRRDQQQSLARRTVARARATPTTTADDVLEHDGSRSADQQTTHGDDKLAS

SEQ ID NO: 133364 - protein, 284 aa, Glycine max
  Coding DNA Sequence Number=SeqID_41679
  Homolog annotation: Hit_ID=A2Q4P8; Match level="QueryCoverage=17%, HitCoverage=21%, E-value=1e-07, Identity=53%"; Hit description=IMP dehydrogenase/GMP reductase, related
  Pfam annotation: Domain name=DUF1723; Domain location=66-115; Score =28.1; E_value=3.2e-05; Accession=PF08330.1; Description=Protein of unknown function (DUF1723)
MVRIRRFGWTLDSIIGRALGREPEEIAVDDVVPDVEGFLGGSYDTLVLIDYVHHVAERPELKLSSHGRKGLISTFAERWHKKTSIFHLTVQEVTITFNDVASLLHLPMTSAFYSFEALHMDKVVLLLVELLEVSVDETFIVANVMSHSGLEQLECICCICGSYAWGVASLVHMYNNLNDASKSSARQLAGYITLLQSIAAKDYDERKPRACCWNSGKALSVSTYRKRIDRLTSDVTIPPHPIVSTLCIEDIDDRWIQFSEYLAPHPLAASVMDEAPVDAPTHVE

SEQ ID NO: 133365 - protein, 119 aa, Glycine max
  Coding DNA Sequence Number=SeqID_41680
MKALKIKIKCWSRETFGGLDAKIEELVSEMDVLDTNMIEGQIQCSDKRRLLYEESGDELDRKKACYFRNPGSDGLNWETLISEFVYGSGQLQPISVSPGLAYDDADYGYIYFLCHDGYK

SEQ ID NO: 133366 - protein, 69 aa, Glycine max
  Coding DNA Sequence Number=SeqID_41681
MREGNPNYAGIAPKRLTTKMNKNNLGGLDQNPREKLTKLGGRKRNSIPKEACPSKKRNKIPLGKRSRKQ

SEQ ID NO: 133367 - protein, 126 aa, Glycine max
  Coding DNA Sequence Number=SeqID_41682
MRKKNKNESLPRTKDTRSKKLMLLRPCREIRREIRKFQVLQIQIPQPFLVSLLVYWGTPSFLLMKVLKDLVTKKTIGKIFFLQGLYQISRNFLNTKRSAIATFYSSLTSHTLWHQRLAYPSKNILI

SEQ ID NO: 133368 - protein, 326 aa, Glycine max
  Coding DNA Sequence Number=SeqID_41683
  Gene Ontology: Mol. function=2 iron, 2 sulfur cluster binding; Cellular component=mitochondrial inner membrane; Biological process =electron transport
  Homolog annotation: Hit_ID=Q198M7; Match level="QueryCoverage=41%, HitCoverage=79%, E-value=2e-39, Identity=63%"; Hit description =Succinate dehydrogenase
  Pfam annotation: Domain name=Fer2; Domain location=38-114; Score=9.3; E_value=0.047; Accession=PF00111.18; Description=2Fe-2S iron-sulfur cluster binding domain
MSEVQAQQVEPKARESPTRKIPTLKTFQIYRWNPKNPSKHKVKDYQINLKEGGPMVLDALNNIQNKIDPSLTFRRSCREGICGSCAMNIDDYNNIACLTKIPLEKNSAAMTITPLPHMFVIKDLVLHKINHSNIIKLKEVVRENNELFFIFEYMLSLIDHTLLCSLNTTTLHYFIPYVVGAFASTRVSNELGAGNPKRAKGVVRVVVILKVAEAVIVKQNYTTNCSALYWIMNLLQVPITIGTTFYEVVLLYKGQSVIASKGDQQTRWHVQQLILYCMCGIISGIIGGLLGLGGGFILGPLFIGLGIHPQVCLFLFYLPTLFVLAQ

SEQ ID NO: 133369 - protein, 72 aa, Glycine max
  Coding DNA Sequence Number=SeqID_41684
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARSTLKREIECANVQWCPKDDLGG

SEQ ID NO: 133370 - protein, 231 aa, Glycine max
  Coding DNA Sequence Number=SeqID_41685
  Homolog annotation: Hit_ID=A7NXH6; Match level="QueryCoverage=54%, HitCoverage=22%, E-value=4e-16, Identity=37%"; Hit description =Chromosome chr5 scaffold_2, whole genome shotgun sequence
MFVNIIQSQNSNVFPEHLFFLLVHGHYKIPKLMASADEMYLRCCLESVHNSALKASQHNKPVSLNTVKFVGEAECDSGQLVLGHSVAVSNNASDNWTLGTVMGTKSMINILNSPLLQHFGASEGNDNLNSMNFTDAKNMTCYDFKDSPSSSYKLEMETPMVQSHEYDDQKEVYVAKLSKVDTTHDEDLDYVYLFHLNKGCEIPDRDLQLVGKMNLSTYYRYTLSPPLTITE

SEQ ID NO: 133371 - protein, 34 aa, Glycine max
  Coding DNA Sequence Number=SeqID_41686
MTMFTAVGLDMSEEQCPGKPVCMTLPLLSEKRRI

SEQ ID NO: 133372 - protein, 85 aa, Glycine max
  Coding DNA Sequence Number=SeqID_41687
MSIMQALMVSRRNHMFVIIKKGENVNVCIHDFDDAKEESNKVASKDKHGFKINTRFLQQTKPCLKINSRSSLALKQSAVKTFKAL

SEQ ID NO: 133373 - protein, 604 aa, Glycine max
  Coding DNA Sequence Number=SeqID_41688
  Pfam annotation: Domain name=RRM_1; Domain location=92-157; Score =27.8; E_value=4e-05; Accession=PF00076.13; Description=RNA recognition motif. (a.k.a. RRM, RB
MEGRWSDTEKTRGSDRTLTEVRKHYKEVGGNSLRKDEGEWSTVVRRKVVKENKKASVEERQTPIREAWDNSTHHHFDWRNKGDITSYYFTHFPEEANEELLWKHFKRWGDVREVFIAKRCNKEGRRYGFVRFKGVSDARELEVKLDNIFINDYKLFVNLPRFARTTRTQQLKQKGSLRGKPNEELYKPRVETTTPPRRTYAEATAKGAAPGVNMRGWRLKKVMAVESIEDRVAWDLGYNICTKFLGDDMILFMGLSEEKAHHIIQTEKNNGSSLFYSLERWRPGCRPHNRVVWLQVWGFPIEVWCADHFRKVASFIGDVIELDDDTEDRRRLDRARLLVRTPLPPSILKEITVRAGELDYQVWFVEETWSGEAVNQKTNSLSDVWSDEVTSEDGGIAREDDDDIDGASSYSLELPPPNPESPRNHQVEGESNGHCDEHRLMGKTHFDEDHRDETVIRKEGTQGPFTANVDPGIREAETKVGIALPKESIEHRSQADSRKKGNHSKGKNFEWWSKGVWRSAPLRGIRARYNANETPHTLAPPADPISNKEGHTFVAQTPIDKPEKYSKVYRRHRVSHPKAPQLEPVAEESQVLEGVKDMPITTDT

SEQ ID NO: 133374 - protein, 202 aa, Glycine max
  Coding DNA Sequence Number=SeqID_41689
NVLGRNILPERKVEIYHTEFDDFKTELERHNLHKRLTNLADGTFILLCSEGPSPKQARVKGHLVKIDADSLNTFLETLVVLKEGETLPTYFRYCRLPTDYREIEAALCIPGRGFILNAEGHPGRILRKDLTTLAQVWSVPSYSNLAPTSHTSDLTVDRARLIFGLVSRMDMNIGALISGQMTSIAQSNSSRLGFPALITALC

SEQ ID NO: 133375 - protein, 159 aa, Glycine max
  Coding DNA Sequence Number=SeqID_41690
MGGLCSMYVKGDKVFAKSDGHSDNHKSNGKNHNSTNMPSDLTSARDHGLDKKKQEAAATTGNGSDDFYDGHGCCHVWVTVALSGLSGLSVYPSLSAFSMLSVKKASCKAYESRQRAKRVFCLWPGSAQDWHQAQLHLLVLSAIMALSATSRFQSLLKPE

SEQ ID NO: 133376 - protein, 406 aa, Glycine max
  Coding DNA Sequence Number=SeqID_41691
  Pfam annotation: Domain name=Transposase_23; Domain location=186-256; Score=5.6; E_value=0.00029; Accession=PF03017.5; Description =TNP1ENSPM transposase
  Subcellular localization annotation: CTP_CleavageSite=36; ConfidenceScore=5.18e-01
SDLTSKWALAANKDSVNDTVYENTTLARKNRPSFVRVAETPHGRMCGKRHRSSRSKTLPHVLSHGGYEYLEQKLMAENTKKKLKEAAQSKSTEVVMDPPSPIRRHVKWKMARAKKTGQMTFEAAKEIAEKIDVLTAAIGRPEHPGRVRTAGASGLALPPEPKVGPSAARVSTKESCVDPLGNDPNTGDSNKCGLYIEENPPRPVALGRVYKGSTNVHNIPLLHDQVKVGVEEVKDADAPVPVPTDEVNLVGQTLNTFLAWPTHLVKHLSEKVMSDATMFGVFNPDFPLYIKHEDLSEIAHGGLDDTPKPKSRAGARWIVVKCNRQKGSTECGYYMMHWMSTIILGTFRNNWETYFNNVRPLEAERLKALHIQCGSNAFQDYFDDAKESRVKQVPKNQESNKFQESR

SEQ ID NO: 133377 - protein, 59 aa, Glycine max
  Coding DNA Sequence Number=SeqID_41692
MYYPGHHQHQSYAEPNVPPMHIDMMSVLLEAIGYIRFLQSQIELAVGIPNRNRAPTLLR

SEQ ID NO: 133378 - protein, 239 aa, Glycine max
  Coding DNA Sequence Number=SeqID_41693
TEVVIDPLSPIKRHVKWKMARTKKTGKMTFEVAKEIVEKVVKHLGHVRIAGVGVTIKQYFGPAPRTSRTSSSTAPEELEQLTQQIRDQLEESITEKSQMQSQGLALPPEPEVGPSAACVSTKESCVDPSGNDPDTVKVNVEKVRDADALIPIPTKEVMWDATVFGVFNEDFPLYIKHEDLSKIAHGGQCLSISVIQLWILHLTETSMRVGNSDVYGLLEPHALKGLDNTPEPKSKAGAR

SEQ ID NO: 133379 - protein, 66 aa, Glycine max
  Coding DNA Sequence Number=SeqID_41694
MEKSEKKNFSEKKMKKAYITWDDNDMESSEDSENEEINLCLMAKSYESNEEMHLLICIKSQSNLQS

SEQ ID NO: 133380 - protein, 125 aa, Glycine max
  Coding DNA Sequence Number=SeqID_41695
MTGRLLAGILLPRSSNLAQASEEDLILMWAFLTGRQIDWAHLVQYRMHKALRANAPLPYPQLVTLFLCHFQIPLDDEPYVQVKRSFAIGAGAVTSFGYRKDRNGQWLKKNAFPPQDEHTPSPPPQ

SEQ ID NO: 133381 - protein, 155 aa, Glycine max
  Coding DNA Sequence Number=SeqID_41696
  Homolog annotation: Hit_ID=A7NY23; Match level="QueryCoverage=36%, HitCoverage=42%, E-value=1e-22, Identity=80%"; Hit description =Chromosome chr6 scaffold_3, whole genome shotgun sequence
  Subcellular localization annotation: CTP_CleavageSite=40; ConfidenceScore=5.21e-01
MYPPLEPIHKRCTLSCSQSTTQVDVPSTCTTKDVSSNVLRQSSQVGEGRHKRIQVVSPSFFWKREKRDTKRIQVELKEKNGQGLVFGGKMEVSSMGWHKRLLGGPGSLPPWCTSKCGKCTPCRPVHVPVLLGTLVTAEYYPEAWRCKCGNKLYMP

SEQ ID NO: 133382 - protein, 87 aa, Glycine max
  Coding DNA Sequence Number=SeqID_41697
MTNANCPQESLHSVSNGNLSSFEPFLEEVVVESGNSMVFSLVGVVVSGRHREGAGVGRKMKLWKWKLKWWSEELKLVSVSEAFRDGD

SEQ ID NO: 133383 - protein, 234 aa, Glycine max
  Coding DNA Sequence Number=SeqID_41698
MGKDWGSGATDAGYTDKSSHSIAPGPYDWPPIGQPNVACRVPSSACEQRWTLEMVAAVEVAVVHLWLAAAGPALAARPTLGKIRIMIAGKDVAEEQCHPDLCQGGHASEHDLHLPSLHASCEVLSRNAQQLAYGLLIKSRSLTLPFTELATLPFFQDQWMPQELIDGIFNKGDPLALHPGALIPDSFLGGPCIHVEFHDYFQVKFSHGPYELSPLPPVNFLLELNVFPFSQLDR

SEQ ID NO: 133384 - protein, 141 aa, Glycine max
  Coding DNA Sequence Number=SeqID_41699
MATMMKAMMSMKKIMEVNTVAVAATSIVAEVDLTPTFGLNQINHAISDMVGQRGRELGSTGGPHFVQVQNKHSFPQYGLALNHTPPNVAHTPNEDVDNSAPIPIKSPQPQADHAHVPQPMGETREISHRNLTDFEPRLGYA

SEQ ID NO: 133385 - protein, 113 aa, Glycine max
  Coding DNA Sequence Number=SeqID_41700
MRSWVRGQWIPFDGDALSLFPGHPLILGEGQQCEYSQRRIQAFGFDEEAIAQLLCILGQDFTQTAAVCKDCTYETPYGPGEVQQGPKVSRFDYRPLSVLQSARRPQQGHPTAY

SEQ ID NO: 133386 - protein, 269 aa, Glycine max [sequence omitted]

SEQ ID NO: 133387 - protein, 71 aa, Glycine max
  Coding DNA Sequence Number=SeqID_41702
  Subcellular localization annotation: CTP_CleavageSite=62; ConfidenceScore=5.20e-01
MGVQIATRPAWAFQDVPPEGGCFWRNQPSSPGRAGKSEPRCFRNVFVTFPWVILRIFLTVLRRSSFFGLQP

SEQ ID NO: 133388 - protein, 74 aa, Glycine max
  Coding DNA Sequence Number=SeqID_41703
MLTSPERVQMNTLLSACQSDLGSPNDEVRITVRCLRMLTDSRVAVTKGGVVDKSRAFAPTYPQFVTKNSDLRSS

SEQ ID NO: 133389 - protein, 58 aa, Glycine max
  Coding DNA Sequence Number=SeqID_41704
MSRNSIDCLTMGVKYLKVVKRGSHAIKQWSPDEIRDILYLTMLMCSMVSPEMLNPDSL

SEQ ID NO: 133390 - protein, 60 aa, Glycine max
  Coding DNA Sequence Number=SeqID_41705
MASERTWTPYVLLEQAHYVVSSLLYMIQLSCQIPDHNCNLAQGGKKPGEKIQFSSPKKTS

SEQ ID NO: 133391 - protein, 100 aa, Glycine max
  Coding DNA Sequence Number=SeqID_41706
MAASDIAILRDRAHIPTKRSLLELTSQDALLAQNKLLSKQLEALTETLRCAIYGGAHNSGCCIPNEEPAHEVNYMGNQPRNNFNASGFFGFQHGQQYNQQ

SEQ ID NO: 133392 - protein, 206 aa, Glycine max
  Coding DNA Sequence Number=SeqID_41707
  Homolog annotation: Hit_ID=A5B939; Match level="QueryCoverage=31%, HitCoverage=47%, E-value=9e-19, Identity=67%"; Hit description =Putative uncharacterized protein
MSRRARRSLQTQGASPGGAVVGADLGGSSKYSNENFEGEEGKGFHVNGTCTWVSRFLRDRGKPVLIALCARTPKGNRPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 133393 - protein, 65 aa, Glycine max
  Coding DNA Sequence Number=SeqID_41708
  Subcellular localization annotation: CTP_CleavageSite=29; ConfidenceScore=5.19e-01
MWRKSKRGVFAQSQPGPHGPSRRFLQKAVASGGSNLARLGELGGKLLPYFAINRGRSEEEKGSAP

SEQ ID NO: 133394 - protein, 123 aa, Glycine max
  Coding DNA Sequence Number=SeqID_41709
MKGIRHKYGFNNNKCEKAEKIMGSPPASPLPPPPLPSPPPPLPPPPPPSDASASLRSGHAKPHVYDRCPLDHLVDVTYENWKEVPTAQKDLIWEDIQAEFDIPEASDNRTKKKLLQTVGERWR

SEQ ID NO: 133395 - protein, 143 aa, Glycine max
  Coding DNA Sequence Number=SeqID_41710
  Homolog annotation: Hit_ID=UPI00016621D1; Match level="QueryCoverage =99%, HitCoverage=37%, E-value=8e-08, Identity=28%"; Hit description =UPI00016621D1 related cluster
GLQVLPFRELHVVAFRRLHVLTIRGLHALAFRGLHVLPFREIHALAFRGLHVLPFRGLHVLLLSGLHVFTFKGLHVLPFRVLHALAFRGLNVLTFGGLHVLTFRELHVLPLRRLHVLLFSGLHNLAFRGQHILPFRGLHNLTF

SEQ ID NO: 133396 - protein, 199 aa, Glycine max
  Coding DNA Sequence Number=SeqID_41711
MGDPISRLSFPENNETFSSLTSYPELRRSEFLIGGYVGARASLLSTIPPFVAMTQELTKFGHSAPMIRGDTLWLFAPFCHPEAAGPMTSRDQTKFGHSAPMIRGDTLWLFAPFCHPEAAGPMTSRDQVWSFCTHDTRRYLMVIRTLLSSKGGGPDDKQRPSLVILHPCIIPEAAGPMIRGNTRVVIRINILLLSVRQNA

SEQ ID NO: 133397 - protein, 190 aa, Glycine max
  Coding DNA Sequence Number=SeqID_41712
  Homolog annotation: Hit_ID=Q3JI94; Match level="QueryCoverage=81%, HitCoverage=26%, E-value=1e-21, Identity=41%"; Hit description =Putative uncharacterized protein
MASGAPVCQLARSPLAATCMKAAHDADVQVAAAHHGEGIGVVEIGAAFEQRHRLLAGVDQVQVDVVLGRRRAHAENAVFTVQHDFAAGGQMGGHQHRHADAQVDVAAVGNVLGQASRHGFAGKGSGHGNPSAGERGVGHLGDALDEDARRHHGLGRQLAQRHLGAHLHDGGLRGHAHDGAEVAGALAIGQ

SEQ ID NO: 133398 - protein, 92 aa, Glycine max
  Coding DNA Sequence Number=SeqID_41713
MHIVVVKQGQDHLELPSGVGTKHEQQKPVKVRQQRGQDWPNLVVYYMQVSSPGRATPAPKYKSDERGDIFAFKNFFSPLSKAIPTGFTSLQP

SEQ ID NO: 133399 - protein, 96 aa, Glycine max
  Coding DNA Sequence Number=SeqID_41714
MSYPNFVRGPLLDDMRPFFGPCEKAIASGGSNPTRLGELGGNHLPYFAINRGGNEEGRAEALPKRFRNVFREEFRKGFNRSSTFFIRSSSFFDLQR

SEQ ID NO: 133400 - protein, 67 aa, Glycine max
  Coding DNA Sequence Number=SeqID_41715
MGEVEGGTRVDGGRHGGHERANGRNDETMMSVKKIMEANAVAIAATSVVAKVNPTSPFGINQMNHPT

SEQ ID NO: 133401 - protein, 99 aa, Glycine max
  Coding DNA Sequence Number=SeqID_41716
  Subcellular localization annotation: CTP_CleavageSite=13; ConfidenceScore=5.08e-01
MLLNSNVIHIHVRVVMLVCMIRTRLFAATRVKSCPDMHSRCVTASLSGCARTVGRPLISGVAQEPLKGNYWPLNRSASLGEASKGKGPYILLRCGYGAH

SEQ ID NO: 133402 - protein, 154 aa, Glycine max
  Coding DNA Sequence Number=SeqID_41717
MSASDHAILRDRTHQPTKKSLIELSSHDALLAQNKLLSKQLEILTETLGCTICGEAHETGQCIPIEENTQEFHYMGNQQRQGYTQGGFSGFQQGPYNQQGQWRTHPDNQFNKDQSGPANRPIQQGPNIFQRNTNLEETLTQFMKNRIPRRNAKL

SEQ ID NO: 133403 - protein, 44 aa, Glycine max
  Coding DNA Sequence Number=SeqID_41718
MPVSAVYTTSLELACDTNYKTSFGVKKYYRPAFVKKTCTMSAEK

SEQ ID NO: 133404 - protein, 254 aa, Glycine max
  Coding DNA Sequence Number=SeqID_41719
  Gene Ontology: Mol. function=motor activity; Cellular component=cell projection
  Homolog annotation: Hit_ID=UPI00006A2D9E; Match level="QueryCoverage =71%, HitCoverage=97%, E-value=6e-17, Identity=16%"; Hit description =UPI00006A2D9E related cluster
EDPRLRGLHVLAFRGLHALAFRGLHVLAFKGLHALAIRGLHILAFRGLHVLAFRGLNILAFKGLHILTFRGLHALAFKGLHILALRRLHTLAFRGLHVLALKGLHVLAFRGLHALTLRELHALAFVGLHALTFRGLHVLAFRGLHAFAFRGLHVLAFKGRHTLAFIGLHICAFRELKEGQLCEHNQREAIVQPLCILGQDFSRAATKRRVRIMRTNMTTLTQIWMTLLLSNILPSDHNADLPLRKFQLVYAVMT

SEQ ID NO: 133405 - protein, 180 aa, Glycine max
  Coding DNA Sequence Number=SeqID_41720
  Subcellular localization annotation: CTP_CleavageSite=80; ConfidenceScore=5.87e-01
MLPTATSSFGRGGRSSKGTVLAPPEPNTKKASSTSSGSSTQAGSSTQKSKLEESSTQLTTTKPESSTQDSLKPITTKQTVEDYAWSIQTLQALEEMCLTKVPRLAKKTWEEMASESNDDYETELQKQIQIAKQTKTISNPKGKQTMMESEYWDKNPFKATAKAFPQEFHYKPTTLNKTKI

SEQ ID NO: 133406 - protein, 40 aa, Glycine max
  Coding DNA Sequence Number=SeqID_41721
ISFSPGCPGEEFMRDLQQFTTFLCCMIKLKGAVRPAKPAD

SEQ ID NO: 133407 - protein, 74 aa, Glycine max
  Coding DNA Sequence Number=SeqID_41722
PPNQSQKNDDLEPVHRWIVVKFEYHVRNTIPSILTVGNFDIITSGGFNPFYVSLTFGNSIGAVGGETGGILGNR

SEQ ID NO: 133408 - protein, 68 aa, Glycine max
  Coding DNA Sequence Number=SeqID_41723
MILHEIRRPSSLKIVPSGVANCRNLPFGGRATWGLTGASSKKGKCTESPPTFIREKCRKNRKGVVYEL

SEQ ID NO: 133409 - protein, 86 aa, Glycine max
  Coding DNA Sequence Number=SeqID_41724
MWRHFRRSARHGRCCKKKDKEFRGSNNGPIGGYREWLKAHVQGLDWLPSLRATKREEDEAPEEDEGVQDRTQASSNSQRKIQICSS

SEQ ID NO: 133410 - protein, 100 aa, Glycine max
  Coding DNA Sequence Number=SeqID_41725
MALARDFCRETTHGAIWFRIGSKIPLAICTLGMNRKILECIRNAKMCTCAIFGAPKCLSMHVCEFSQGDVCDVSNKYTLEEWPRGSLPQEVQEGQGGRRN

SEQ ID NO: 133411 - protein, 190 aa, Glycine max
  Coding DNA Sequence Number=SeqID_41726
MDNEEGVKEQMKADLSALKDQMASISEGSDAGAATRLESELDRNTVVFGRRYSPQAYPYGLPPDFTPRTTPEDLSQAPTFEGQLPPYEDYPGQDDGEGDTHLGPLLHLKDPSPHELPQPNIVRHIPASPTPVKESVPFAEDKGKIEALEERLRAVEGLGNYPFSDLADLCLVPNIVIPPKFKVPDFDKYK

SEQ ID NO: 133412 - protein, 174 aa, Glycine max
  Coding DNA Sequence Number=SeqID_41727
  Subcellular localization annotation: CTP_CleavageSite=43; ConfidenceScore=5.49e-01
MTLGLQQQLIVLIVSLPLGLHPSPLRPSSFSTRGLYPSPLGPSPFSTWAFSLYLANFRILIIPSFLENICPQMSRIITRFKYHYLMILRLGHWFVALGELCWFVFSLLTFPGPLKTPCPQGVRSQWLSKVVPGSQIKVGVGMSECRLLWQRQSHWQCREWCRGWGGRGGRAPCS

SEQ ID NO: 133413 - protein, 65 aa, Glycine max
  Coding DNA Sequence Number=SeqID_41728
MEGEKKGVSSKKENWSLTLRNVQFQEDDDSSFLLYHFVVVYEDMWTDVKYLLKIKKMIDHERNTL

SEQ ID NO: 133414 - protein, 98 aa, Glycine max
  Coding DNA Sequence Number=SeqID_41729
MASRDQVWSFCAHDTRRYLTVIRTPLPFRHSCVRWQAETKFGHSAPMIRGDTLWLFAPILLLSTSKEGQLSYPNFVRGPLLDDVRPFFGPREVLGTHH

SEQ ID NO: 133415 - protein, 111 aa, Glycine max
  Coding DNA Sequence Number=SeqID_41730
  Subcellular localization annotation: CTP_CleavageSite=73; ConfidenceScore=5.75e-01
VLQWLLFLSAVPPCSATDGVVRNGKSTARTSALASVAVPLRVTTTPAALNAPLQGASHSPFRLRNCWEGRSVRASSLLRQLAKGGCAARRLSWVTPVFSQSRRCKTTASEL

SEQ ID NO: 133416 - protein, 83 aa, Glycine max
  Coding DNA Sequence Number=SeqID_41731
MGAKHLTRTKEWSHVIEQRSPDEIREQKVQKTVSAPACYQAFCLTDSKRMGANNHKGADNRKGADNRKGADNRKVSPRIMGAE

SEQ ID NO: 133417 - protein, 15 aa, Glycine max
  Coding DNA Sequence Number=SeqID_41732
VNAMKISPDAQNGLG

SEQ ID NO: 133418 - protein, 78 aa, Glycine max
  Coding DNA Sequence Number=SeqID_41733
MVYNNGFTRDSPQIIASPHQLDLAPYASEPYNAQWNAPGLLRDKHTLRSNRILEKMEVDEPWLGLWLPLNYQVDMGAS

SEQ ID NO: 133419 - protein, 72 aa, Glycine max
  Coding DNA Sequence Number=SeqID_41734
GLVGACALSATLARLACISEFRLSACLFAQRMDSSGALSVISPHSVNMHNSSFFHILPRAQPKECCAQRMAR

SEQ ID NO: 133420 - protein, 92 aa, Glycine max
  Coding DNA Sequence Number=SeqID_41735
MSGLICDSPQISASPHQLDFAPYASRSYSAQWNAPGLLHDMHMLRSSRILRKWRWRKPSRGMAFVDNWVVGKKKGCYWLSNDIVGLMGNLVV

SEQ ID NO: 133421 - protein, 127 aa, Glycine max
  Coding DNA Sequence Number=SeqID_41736
MIRGDTLRLFAPFCHPEAAGPMTSRDQVWSFCTLVSSRGGGPDDTRRYLTVIRTLLSSRGGGPDDKQRPSLVILHPCIIQRRRAMIRGDTLRLFAPFCHPEAAGPMTSRDQVWSFCTFQDDTRRYLM

SEQ ID NO: 133422 - protein, 85 aa, Glycine max
  Coding DNA Sequence Number=SeqID_41737
MTREVVIIKRGEIVEAKLHGESKNNSRVQDKNQEEFKTQEESLESRIKIQGSRSQESRSRFKTQDSRIKRRLNQDKYEMFFSKIE

SEQ ID NO: 133423 - protein, 86 aa, Glycine max
  Coding DNA Sequence Number=SeqID_41738
  Homolog annotation: Hit_ID=A5AZ66; Match level="QueryCoverage=59%, HitCoverage=6%, E-value=6e-10, Identity=50%"; Hit description =Putative uncharacterized protein
MATPMSTACYLDKDETGYSDSDFAGSKTDGKSTSETCHFIDSALVSWHSKKIEHCCFIYCKSRIHFCWQLLCSNSLDEATNFLIME

SEQ ID NO: 133424 - protein, 83 aa, Glycine max
  Coding DNA Sequence Number=SeqID_41739
MANFKAAGVIPKDLNWQQRLKLYHGEEFTRAHSIVHMISPIMHKPRAKLIFGHALSRESLALRAQPLHLMLIWSAKLAKAELS

SEQ ID NO: 133425 - protein, 165 aa, Glycine max
  Coding DNA Sequence Number=SeqID_41740
  Gene Ontology: Biological process=transposition, DNA-mediated
  Homolog annotation: Hit_ID=Q1J7G7; Match level="QueryCoverage=20%, HitCoverage=47%, E-value=8e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPLPRSLTRYARSFDCGERKWLTNGAEISWKMPGRYLTGK

SEQ ID NO: 133426 - protein, 205 aa, Glycine max
  Coding DNA Sequence Number=SeqID_41741
MVSRGGDKSNEFLFHLGELHDMETCPAVEELLQRLMDWRQLEVSERGREKPQICMQLAERKAPPTPKALVICFTRNMTSPRSKYPPTVPKPTPFSYQSNKAVPWKYTPPAFGEGAATEVDSLSAKVTNIIGLSGVTRGGRVFAPPHSAELPSKGKAPMTQVSTGTTTPSKEVDPPIVKGAEKKEGLQGKAETLEEAHEFLRLIQQ

SEQ ID NO: 133427 - protein, 54 aa, Glycine max
  Coding DNA Sequence Number=SeqID_41742
MRVHCYQASRRPSMTTDSPPLLMFPWTQGVFLAPTYPQLCWTIYDLLFLKGEKR

SEQ ID NO: 133428 - protein, 43 aa, Glycine max
  Coding DNA Sequence Number=SeqID_41743
MMRIMNLAKYRLKAQVEKDEGVSGEGQSPRVEKDEGSILAQPI

SEQ ID NO: 133429 - protein, 211 aa, Glycine max
  Coding DNA Sequence Number=SeqID_41744
  Homolog annotation: Hit_ID=Q2HSV3; Match level="QueryCoverage=80%, HitCoverage=26%, E-value=9e-12, Identity=30%"; Hit description=IMP dehydrogenase/GMP reductase, putative
AHMKGITGAPYRAHCDGLTITDVSWLPYTEHRGFRAFKEISSFQGQLRWGHMVVTVRPKRVVRQFGYIQSIPPPPVSARLSHDQIDDRWMQFADHLLPAGQLCLVPGQVSADYMEWFFRISHPFMTPTQAGDQRRDAPAVDPEDYIQPPAPRFQLHLTPPPHVDDYEGYEAIAQRLERVLNLRIVTTGTKLYDIMQDCLTIARGGPSADGT

SEQ ID NO: 133430 - protein, 252 aa, Glycine max
  Coding DNA Sequence Number=SeqID_41745
  Gene Ontology: Mol. function=chloramphenicol O-acetyltransferase activity; Biological process=response to antibiotic
  Homolog annotation: Hit_ID=P62577; Match level="QueryCoverage=86%, HitCoverage=99%, E-value=1e-122, Identity=95%"; Hit description =Chloramphenicol acetyltransferase
  Pfam annotation: Domain name=CAT; Domain location=6-209; Score=479.8; E_value=3.3e-141; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMSKILYASRQGVMPLAIQVHHAVCDGFHVGRMLNELQQYCDEWQGRGVIFLRQLLVPRNILSDYKMIFLRSFWSARNLLL

SEQ ID NO: 133431 - protein, 120 aa, Glycine max
  Coding DNA Sequence Number=SeqID_41746
  Homolog annotation: Hit_ID=A8ARU6; Match level="QueryCoverage=26%, HitCoverage=41%, E-value=1e-09, Identity=84%"; Hit description =Putative uncharacterized protein
MAYERGGDFLEDARKILNREAFPPGGSLVRSPVPAFRFTGVIPLLWPRLSHSTPDTQFRVGSSLQAGLYARTPPFSPTAAPYPVTIVLSPTRKDMQKHHWQQPLSKRLRADQNDLKKIIL

SEQ ID NO: 133432 - protein, 170 aa, Glycine max
  Coding DNA Sequence Number=SeqID_41747
  Pfam annotation: Domain name=Transposase_23; Domain location=85-155; Score=-12.8; E_value=0.03; Accession=PF03017.5; Description =TNP1ENSPM transposase
ASQDSFVPHGRHDVLTVAIGRPEHPGCVHAAGAGAPSSNTLALLHKAPMQSQGLALPLEPEVGPSAARVSTNGSCVDPSPTDPETGDSDKYGLYIEENPSRLVALGRVYEGSAAVHNIPLLHGQVEVGVEEVKHVEAPVPVPTNEVQLVGQTLNTFLAWPTHLVKRVSEQ

SEQ ID NO: 133433 - protein, 167 aa, Glycine max
  Coding DNA Sequence Number=SeqID_41748
  Homolog annotation: Hit_ID=A5AH79; Match level="QueryCoverage=69%, HitCoverage=7%, E-value=1e-08, Identity=36%"; Hit description =Putative uncharacterized protein
  Subcellular localization annotation: CTP_CleavageSite=31; ConfidenceScore=5.13e-01
MGQLATQLNQQQSQNYDRLPSQSVQNPKNVSAITLRSGKQCDSKEKQHIPLPFPPRAISTKKMEDTEKEILETFRKVEELCTNKWKLKGSERISMGRNVSALIGKSVPQIPEKCKDPGPLQSTNVVIHLANRRVAYPAGFIEDVLVRVGELIFLVDFYIFEYGGGIF

SEQ ID NO: 133434 - protein, 223 aa, Glycine max
  Coding DNA Sequence Number=SeqID_41749
  Homolog annotation: Hit_ID=A5C8T0; Match level="QueryCoverage=95%, HitCoverage=28%, E-value=6e-19, Identity=27%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTSHNMIAHIGKARAVVEELKRFLVADSLEEVNRKLDKFYMVLILRSLQSNFDHVHDQVLAGDQVPSMDSLITRFLRVPHVLKDENLADVMETSAMVAPRGRGGGRNNRGGRSERGGRPHCTYCKRMGHTQENCYSLHGFPDKVALVSKSEKSESWFSDEEYQEYLKLKSEKPNNQKQSSFVPCFLTACISQSIEGPSPWILDSGTWHGSTDWRRT

SEQ ID NO: 133435 - protein, 135 aa, Glycine max
  Coding DNA Sequence Number=SeqID_41750
MKREKHVSYNSHDSCNNLSEELSDYYRGHHSSYTKHHSQRREKDRRPQEVNISLSYFHGKDNVETYLDWEIKSALRKRHIPSCHTLISSGDNCLMACNLCLTASRYLAPIFAQYVKFRNMPEIKRKHCYTIREVM

SEQ ID NO: 133436 - protein, 133 aa, Glycine max
  Coding DNA Sequence Number=SeqID_41751
  Homolog annotation: Hit_ID=A0ST23; Match level="QueryCoverage=30%, HitCoverage=81%, E-value=6e-15, Identity=92%"; Hit description =Putative reverse transcriptase
FRLNPLSWANQRRVRVSFLDTTSWGSTMPDAQHGDVHSTTIFANIKLIDTVDLEGGPGTSFWVPLKRVNFERGVFMLTHINCVALTARFPIGKPVVPTALMNRTTRGERRFAYWALAECILAYYVGTDDGVRE

SEQ ID NO: 133437 - protein, 140 aa, Glycine max
  Coding DNA Sequence Number=SeqID_41752
  Subcellular localization annotation: CTP_CleavageSite=14; ConfidenceScore=5.04e-01
MVKVGTSYVPINVSFSPKVGPGLPGINRDTRMLFLQLLFPPVQLLRGGGRMLHVEKLHRGGAALELVDTPGLQEYSMLPLFTDSRTARSFDCGERKWLTNGAEISWKMPGRYLTGKTIKIPAFPPGGSLVRSPVPAFRFT

SEQ ID NO: 133438 - protein, 145 aa, Glycine max
  Coding DNA Sequence Number=SeqID_41753
MPLRGRIASAILIIDSIAASDYQSHHDRALTQRKGIMELDTQSVILAQNKLLTQKIEALTKQICQLPRHYHQGGPQKTHQAHQIQQILRCDFCGGNHQNGHCSSPGDGQQEEEAHYLQNQARPQQNFQGSYQGYRGGSGSNQPYG

SEQ ID NO: 133439 - protein, 61 aa, Glycine max
  Coding DNA Sequence Number=SeqID_41754
TYPLKIEGNDEERMKNVEERLKPFAKFLHGKREMLAAQLAQASRVASSRSNNLLEESSGGP

SEQ ID NO: 133440 - protein, 79 aa, Glycine max
  Coding DNA Sequence Number=SeqID_41755
MVAIIPPKVPQPSFSQGYNSNATCAYHGGILGHSIEHYTSEPYTGAMRGTMHEPQANLGADKKFSPVRLKIQKGSLSKN

SEQ ID NO: 133441 - protein, 40 aa, Glycine max
  Coding DNA Sequence Number=SeqID_41756
MASYGDDDKGDDKKLKGQSKNEFKMFKIESRTLQDSRGKL

SEQ ID NO: 133442 - protein, 276 aa, Glycine max
  Coding DNA Sequence Number=SeqID_41757
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMMMATSLAWLKAMAVARASWIATPPRLALAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133443 - protein, 42 aa, Glycine max
  Coding DNA Sequence Number=SeqID_41758
MAATSHFECDVPILVTTAVLAEFPKRSVPIVVINVLGLILIE

SEQ ID NO: 133444 - protein, 60 aa, Glycine max
  Coding DNA Sequence Number=SeqID_41759
MATTSTISIAQVDVMDEFIQFEDEDMSQVGKSQLDTYLEKANLSNKYHPNLDVLQYWKDN

SEQ ID NO: 133445 - protein, 101 aa, Glycine max
  Coding DNA Sequence Number=SeqID_41760
MDPERIKVIPEWPTPPTPLIELMRNYILSWEDGQERGFPSIPYSNIPNITNTYGEGMMQSYPPRALDRRLQEDWAKDAREGPRVLMSLRVDFGFMGYGSIM

SEQ ID NO: 133446 - protein, 214 aa, Glycine max
  Coding DNA Sequence Number=SeqID_41761
EEQGRRVRRGDHCLAVMHPGQDFARTAAGRRVRIMHTNMTTLTQTWMTLLLINVLPIDHNSDLPLPKCQLVYAIQTRLSVHVAQVIADAIYLFAGMAPARHPLDLDKSNKALGFPALITGLCRSFGVPVTLSKVIRPPITRVFIEKYCTPRHGALSTAFGSPAGGQPPWVVAWPGDWPDAQAGEEPVGSLGEAEETRMDEDMTNLLSFLGGSGA

SEQ ID NO: 133447 - protein, 72 aa, Glycine max
  Coding DNA Sequence Number=SeqID_41762
  Subcellular localization annotation: CTP_CleavageSite=45; ConfidenceScore=5.03e-01
GLVGACTLSATLARLARISEFRLSARLLAQRMDSSSALNGISPRSANMHSSSFFQILPHAQPQEWCAQRVAR

SEQ ID NO: 133448 - protein, 125 aa, Glycine max
  Coding DNA Sequence Number=SeqID_41763
GSHPQRHPVDLKKSNKGPGVSSSGIAPTETPSGPEEVQQGPGVSSSGYGPLDCAHKTPSGPEEGQQGLGVASSKYGSLSVLGSACRPQQGHQAPVPIELSSRSTVPPGRRRAKHHSSIGMAGSGQ

SEQ ID NO: 133449 - protein, 42 aa, Glycine max
  Coding DNA Sequence Number=SeqID_41764
MTKYADQAYRYRRPRGGARYQLLFPLVRVNFELGVIMVIAVS

SEQ ID NO: 133450 - protein, 359 aa, Glycine max
  Coding DNA Sequence Number=SeqID_41765
  Gene Ontology: Mol. function=motor activity; Cellular component=cell projection
  Homolog annotation: Hit_ID=UPI00006A2D9E; Match level="QueryCoverage =71%, HitCoverage=85%, E-value=1e-11, Identity=14%"; Hit description =UPI00006A2D9E related cluster
MPSEDSTSSPSEDCMSTTLEGYTPSPSKHYMPSPSEDYSSSPLEDYRSSPIEGYTPSLSEGYTSSPSEDLHALAFRRLHVLAFRGLHHVLIFRGLHSLTFIGLHVLGFAGLHVLAFKGQHILAFRGLHVLVFRGLHALAFRGLQVLAFRGLHVLSIRGLQVLAFRGLHALALRGLHVHVFIGLHAHAFRGLHALPFRGLHILTFRGLQVLAIRGLHAYAFRGLHAFAFRGLHALAFRGLHAIAFTGLHGLTFRRLHALAFRRLHVLAIGGLYVLAIRGLHGLTIRGLHVLAFRGLHALAFRGLHVLAFIVLHVLAFSGKHALAFIGLHVLIFRELRALAFRGLRVLALRGLHGLALRRL

SEQ ID NO: 133451 - protein, 309 aa, Glycine max
  Coding DNA Sequence Number=SeqID_41766
MEGRKRRSPFLMWKIPKHSAGISAHKIPPTIQRIHKAWETPLKKDQELRGIRNGIIGGYHEWLKVHIRGLDWLAKLKVVSKESFEAPEEDEEVQALKSELGKAKLAKEKFKLAARHVRKEYAGLREENAITARALEQETKRARKEEYGRNKFRGALWGSNSELKLRKEERDQSRAHSMVLKEELVACSRSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 133452 - protein, 27 aa, Glycine max
  Coding DNA Sequence Number=SeqID_41767
MAKINQGKTMTTHDRSHIVRLLLAGTA

SEQ ID NO: 133453 - protein, 181 aa, Glycine max
  Coding DNA Sequence Number=SeqID_41768
MATSKALEQETKRARRKEHGRNKFRGALWGSNSELKLRKEERDQSRVDGLILKDELKACSRSKRSLSQRLCETETNMLAIITKYQEELSLATAHEHRVADEYAQVYAEKEARGRVIDSLHQEATMWMDRFALTLNGSQELPRLLAKAKAMADIYSAPEEIHGLLSYCHHMIDLMAHIIRNR

SEQ ID NO: 133454 - protein, 83 aa, Glycine max
  Coding DNA Sequence Number=SeqID_41769
MECPGTPPWYLQVALGSYHFGKGGWRTFPGVTTAKWLAMRDGKRSSYVIGSGRRSRYEPRSSGDVARTDGYHEVSAGFHPSGR

SEQ ID NO: 133455 - protein, 79 aa, Glycine max
  Coding DNA Sequence Number=SeqID_41770
MVKNLLENLMPKPMRLFFLVTHCKVKHIEYNSLKDEDAGFQDKDSAPKNETKVEELEQSKEISTTPPKDLPREWRTQKV

SEQ ID NO: 133456 - protein, 121 aa, Glycine max
  Coding DNA Sequence Number=SeqID_41771
MIMRGQDIYSSQDEVTTSPSSSESEEAKGEESSEEIYPQEEGQPLMVKEECKEVLLGTESPMIGGMMNVLSGATLFCKITHASNIFMIRIHRDSLGSDQEVPTDPKRIKVLREESQSFKNL

SEQ ID NO: 133457 - protein, 159 aa, Glycine max
  Coding DNA Sequence Number=SeqID_41772
  Homolog annotation: Hit_ID=Q6WAY4; Match level="QueryCoverage=52%, HitCoverage=15%, E-value=2e-07, Identity=32%"; Hit description =Putative uncharacterized protein
MEPIASLAQYYDQPLRCFIFGDFQLSPMVEEFEEILGCPLRGRKPYLFSGFYPSLARISKKVQISAQELDRQRQVENGVVGIPRKYFGALYGGLVSHLFLQEGRPVYPLQGYRSCVEKGKANWDQLLASMGGRLLIGSLARRKEESRFYLHAKDVQMFP

SEQ ID NO: 133458 - protein, 235 aa, Glycine max
  Coding DNA Sequence Number=SeqID_41773
  Gene Ontology: Mol. function=endonuclease activity
  Homolog annotation: Hit_ID=Q2HUP4; Match level="QueryCoverage=54%, HitCoverage=43%, E-value=9e-51, Identity=75%"; Hit description =Endonuclease/exonuclease/phosphatase
  Pfam annotation: Domain name=Exo_endo_phos; Domain location=63-235; Score=2.8; E_value=0.002; Accession=PF03372.14; Description =EndonucleaseExonucleasephosphatase family
MDQLRNNVNARSLPGSNALYGSSTVSKEQGPLHRRPDVLKSQQGFPHFRERVWVKKLVRDRRIRFGTWNIGILTGKSMEIVDVMVRRKINFMCLQETKWTGEKAKELDNSGFKLWYTGKIRSRNGVGIIVDKEWKKDVVDDIPQGEKVFLGGDLNGHVGSVDRGFEGVHGGFGLGEMNGEGKSILEFSEALDLSIANTWFKKREEHLITYKSGGTCSQIDFFLIRKSDRKVLLEL

SEQ ID NO: 133459 - protein, 53 aa, Glycine max
  Coding DNA Sequence Number=SeqID_41774
MEQFLASRLREIMKANSCDFFMPKGFGGEEGRMGVEEECGVEGGGGTGKKMKR

SEQ ID NO: 133460 - protein, 155 aa, Glycine max
  Coding DNA Sequence Number=SeqID_41775
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=74%, HitCoverage=96%, E-value=6e-26, Identity=54%"; Hit description =Putative uncharacterized protein
MTMITPSSKLTLTKGNKSCFWAALLPNLDAQTKGQVARAMWYPDCYNTGTVANPKPIESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133461 - protein, 150 aa, Glycine max
  Coding DNA Sequence Number=SeqID_41776
MALKKLSTKRSRRDATGEGSSAASEFDSHRFRSAEHQERRVQLREDEYSDFQEEIARRHWTPLVTPMAKGQWIPFDADALSQFLGDPLILEEDQEAGADHAHQNSDLPLPMCQLVYVILTRMSIHVGPGPGVFGSITGFCQSYGVPITPS

SEQ ID NO: 133462 - protein, 126 aa, Glycine max
  Coding DNA Sequence Number=SeqID_41777
  Homolog annotation: Hit_ID=A1G2F8; Match level="QueryCoverage=58%, HitCoverage=15%, E-value=4e-20, Identity=64%"; Hit description =Putative uncharacterized protein
MAMTSAMAVTIQQNQYVHTAEEAGPGPEQIGGKIDEGLVLQVGQQQFAHRAHHEEQHRADDQVDEDDGRAGQADGLARPHEQAGADGTANGDQLQVAVGQAAAQVLWGRCGLGHGRGQKGGRSVRR

SEQ ID NO: 133463 - protein, 77 aa, Glycine max
  Coding DNA Sequence Number=SeqID_41778
MDTLLVFYYEKMMEYMPASFVDLVFTGERIEVGLKKEKFDYAASTNSGSRRPRMNGVKKKEAEAHVVDVVPTWPNFA

SEQ ID NO: 133464 - protein, 252 aa, Glycine max
  Coding DNA Sequence Number=SeqID_41779
MSLHSSSSVNGEGSTPKDPLYKILDELRSLKLWKEKQERKDKGKKRVEEISQDEREKIREEERRKIMKEMKREKHVSYSSHNSCKSLSEELRDYYEGRHRSHLRPHSHRREKERKPQEANINFPYFHGKDNVEANLDWEIKVEQQLKRKSTSKCYGSHSYPKRDQGQGILGVTPSKPKDDKGKTIEKGHITSQCPTKKTMIMRGQEIYNSQDEATTSPCSSKSEEAKGEESSEEIYPQEEGQPLMVKEECKE

SEQ ID NO: 133465 - protein, 164 aa, Glycine max
  Coding DNA Sequence Number=SeqID_41780
TAKALEQETKRAHKEEHDRDKFRGALWGSNSELKLRREERDRSRAHSMVLKEELATCSRSKRNLTQRLSETETNMLAIITKYQEELSLATAHVHRVADEYAQVYAEKEARGRVIDSLHQEATMWMDRFALTLNGSQELPRLLAKAKAMADTYSAPEEIHELLDY

SEQ ID NO: 133466 - protein, 214 aa, Glycine max
  Coding DNA Sequence Number=SeqID_41781
MGEVEEVQEQMKADMEAMKEQMATMMEAMMSMKKIMEANAVAVVATSAVAKVNSMPLSGLNQMNHPTSAMVGKDLGSTSGPYYVKIQNKHAFPPYGLPPNYTHPMWHTLPTREMPHHNLANFEPCLRYATKGQAVGGIPLQNTLEGPQYHPQPHSSHSTAVKNPHAMAEMGKLDHLEERLRAIGGGEDYAFVNLEELFLVPNIITPPKFKGVGL

SEQ ID NO: 133467 - protein, 116 aa, Glycine max
  Coding DNA Sequence Number=SeqID_41782
MVGYAPSSFADLVFAGKRIEAGLKRGKFDHPALMNEKTGANQDDENEEGTHVEVAIPTWPNFPSAQQCHYSANISSSHYPPPSHPQRSSLNQPQSLPATHPMPKHQPKRNLVAKSL

SEQ ID NO: 133468 - protein, 140 aa, Glycine max
  Coding DNA Sequence Number=SeqID_41783
  Subcellular localization annotation: CTP_CleavageSite=84; ConfidenceScore=5.54e-01
MAKPSSPANLASAIICFFASKKFPHRLKASPGRFARKTLHHTLPSWSMFMDFSKYALPLVVLLADSRFTRPDMGFHPTKLNFVPSDADEAPLDVSICLHAFGIVGCGSFSGVKSCEREDPFHPGLFVGDAGGFQSPTREP

SEQ ID NO: 133469 - protein, 59 aa, Glycine max
  Coding DNA Sequence Number=SeqID_41784
MHMTQMQLRNAGARGIVSFLDTTSRGSKVPQRIILFEEHIAAVGTTGNNKFSKRKALDE

SEQ ID NO: 133470 - protein, 83 aa, Glycine max
  Coding DNA Sequence Number=SeqID_41785
MIFPGVITTIWLAIRDGKRSSYVIGSGVNSGIGFGGKFLIVLELPAGRVVVGAGTWGASLWMGALGCTGAELEEFPARAEKLG

SEQ ID NO: 133471 - protein, 141 aa, Glycine max
  Coding DNA Sequence Number=SeqID_41786
  Pfam annotation: Domain name=Transposase_23; Domain location=45-115; Score=3.9; E_value=0.00045; Accession=PF03017.5; Description =TNP1ENSPM transposase
MQSQLQSQMQSQGLAMPPEPKVGPSAAHVSTNGSCVDPSLTDPETGDLDKCGLYIEQNPSRLVALGRVYEGSIVVHNIPLLHGQVKVGVEEVKDAEVPVPVPNDEVQLIGQALNTFLAWLTHLVKHAAVSPAKPPDRPNPE

SEQ ID NO: 133472 - protein, 145 aa, Glycine max
  Coding DNA Sequence Number=SeqID_41787
  Homolog annotation: Hit_ID=P15305; Match level="QueryCoverage=83%, HitCoverage=24%, E-value=3e-08, Identity=24%"; Hit description =Dynein heavy chain
MTGPLDESIYCFLIRVDPWVLVPIAYRRLHILNFRGLHVLSFKGLHVLAFKGLQVLAFRGLKILDFRGLFILAFRGLHTLAIRGLHVLAFRGLHILAVRGLHVLAFRGLHVLAFRGLHILPFRGLHVLVFRGLHVLDFRGLHILA

SEQ ID NO: 133473 - protein, 83 aa, Glycine max
  Coding DNA Sequence Number=SeqID_41788
PLGPSRIFLQKAVASGGSNLARLGELGGNHLPYFAINRGGSEEEKAEALPKRFRNVFREEFRKGFNCSSTFFIRSSSFFDLQR

SEQ ID NO: 133474 - protein, 15 aa, Glycine max
  Coding DNA Sequence Number=SeqID_41789
MYSKARLRRADCNAK

SEQ ID NO: 133475 - protein, 129 aa, Glycine max
  Coding DNA Sequence Number=SeqID_41790
MNENAIHGASKKIENGELHQAITAHGSKLEGGGHMNENAIHGAPKKGLRMGNCTKQSLSMAPNSKVSSLSIPSTSRGGPVPAFFRKKDWEWRIALSNHYAWLQTRGWRTHERKRNSGGSEKRLRMGELH

SEQ ID NO: 133476 - protein, 116 aa, Glycine max
  Coding DNA Sequence Number=SeqID_41791
MRLRTASGDVVPINLEIEATCRRNNAARRRRKQDTEGSSYISPPLSPNHTEMDAKPARRVTLEDFSKTATPQFFTTNPREPLPWSSKRRSICSSSLIHRNMQHRQNRRSPRRCDMP

SEQ ID NO: 133477 - protein, 88 aa, Glycine max
  Coding DNA Sequence Number=SeqID_41792
EPARTLQHTVEWILPTPTPYRLVEPVQVIEDPEELPPEPAVDALDFLEGDEDPLIEVDSPKDVMSASEADSTEDSGPGEMAISGGSSS

SEQ ID NO: 133478 - protein, 103 aa, Glycine max
  Coding DNA Sequence Number=SeqID_41793
ILGTLCCTICEVPRRAENQKEAGLRDPSTIRNVTEIERRFFLQKVVASGGSNLARLGELSSPGRAGSEEGRGSAFLALLILSKLLRKIVFVKKIQAEALPLQL

SEQ ID NO: 133479 - protein, 805 aa, Glycine max
  Coding DNA Sequence Number=SeqID_41794
  Gene Ontology: Mol. function=quinoprotein glucose dehydrogenase activity; Cellular component=outer membrane-bounded periplasmic space; Biological process=electron transport
  Homolog annotation: Hit_ID=A8GGG0; Match level="QueryCoverage=20%, HitCoverage=20%, E-value=3e-82, Identity=85%"; Hit description =Quinoprotein glucose dehydrogenase precursor
  Pfam annotation: Domain name=PQQ; Domain location=110-148; Score =41.9; E_value=2.3e-09; Accession=PF01011.12; Description=PQQ enzyme repeat
  Pfam annotation: Domain name=PQQ; Domain location=53-91; Score=27.0; E_value=6.8e-05; Accession=PF01011.12; Description=PQQ enzyme repeat
  Pfam module annotation: Pfam domain module=PQQ::PQQ; Domain location =110-148::53-91
MALPFVSKLIPRGPGNPIEPPQGAEGGSGTETGIQPQYGVPFGVELNPFLSPFGLPCKQPAWGYVSAIDLKTNETVWKKHIGTVRDSAPVPLPFKMGMPMLGGPITTAGNVFFIGATADNYLRAFDTNTGEMLWQARLPAGGQATPMTYEVNGKQYVVIAAGGHGGEKHRAHTKRAADKATEQRATHLADILSRGRIAQHFPDLPLRHIMTNQRRHAGHQAAQRHPHQETQQHQLPRRANKCLRNQQQRADQQAINQHARMSDAIGQPAKARRGENAAQRSGRHHQSGRYRHRVIPREQTCAIYSVIIGSIDILAKISSMPDSHISRTTGRLIDASGSSPSPAAAFFAARGASFSRKVVARNARKITAPVSQKVWRIPISGGSTPPSSGPTTFPAMMPEDSTPSAQPAQRYQLPRRGGHTNQRHGDGHSEAGADQHQLAAIAIRQFAPQRCRQRRAKKGGTKGQQQGHGDDSAERAQHANPQIAPPAISGSTQKTGRSGYLPASALLLPENNNHGAPSVVISASQSKVTGRQIRHAGSGQGRIEQRHAVIRAKAAVHIQRQALLITAKRQRRRVCRAVKQQQIVAHQTFGMIDGRMRSQIRWRRIQSPVNAAQLAVVRHLRRTRADHNRHVRTGLRIVAGGQFEIDVDVNMTADKGVQRRHHALTAEGDRRLQSHVAGRLLMHLLHKRVGAMHLFQHAGAERIVSLAQLGQRHFARGALQQFDTQPHLQPGDFAADRTGRFAEALPLNDACKQHHGGEIIAVVHVLWLIRKSENRSLKVNTRMRTRFPVTQRPREIGRGMSHRHR

SEQ ID NO: 133480 - protein, 114 aa, Glycine max
  Coding DNA Sequence Number=SeqID_41795
  Gene Ontology: Mol. function=protein binding
  Homolog annotation: Hit_ID=A2YL84; Match level="QueryCoverage=97%, HitCoverage=34%, E-value=2e-53, Identity=86%"; Hit description =Putative uncharacterized protein
MTFGDMPEQGEQVGDQSAPPLPPEKIMHAHLRIGQGELMLSDGNTAQPPASEHAGYAVSLATPDEAEGKAWFDKLSAGGKVTTEWQKTFWSNGFGMFIDKFGIPWRINVVKPQA

SEQ ID NO: 133481 - protein, 471 aa, Glycine max
  Coding DNA Sequence Number=SeqID_41796
  Gene Ontology: Mol. function=glycerone kinase activity; Cellular component=cytoplasm; Biological process=glycerol metabolic process
  Homolog annotation: Hit_ID=A7MIW4; Match level="QueryCoverage=73%, HitCoverage=71%, E-value=5e-68, Identity=58%"; Hit description =Putative uncharacterized protein
  Pfam annotation: Domain name=Dak1; Domain location=21-305; Score =122.5; E_value=1.2e-33; Accession=PF02733.8; Description=Dak1 domain
MSQFFMHEKNDLVNEAIEGVLLSTPWHNLTRLDLGDEIRVVVRSDWDKSKVALISGGGSGHEPAHAGFVGKGMLTAAVCGDIFASPSVDAVLNAIVNVTAEKAKNLGYKVELVMVQDDIALPENPATPRGIAGTVLVHKIAGFAAEQGHSLDEVKTLAQRTIDATSSIGLAFATCHIPGEKRDDRVAAGHSELGMGIHGAARRQTGAVDDQQSRRLFPAGAGAAHARGTAVAAGGTHHPFNWPGNPGQRAGYERVFADAAGAGRGVFRGAACAGAGAGLDADHAERIGSVLDFDPSDNAEVAQVVERVTHTLIDLESELNALDAKVGDGDTGSTFAAGAKKIQRGLREQQLPLDELPTLLALRRADVDSVYFGRTAAGGGQHAAAGADARAGTDEALRRRAAGTSHPGGCATAGTGGVSGRRVAGCGGGRCATGCRRDGADAECEGGAVRLISIIRVCMACSDPGAYAIDE

SEQ ID NO: 133482 - protein, 562 aa, Glycine max
  Coding DNA Sequence Number=SeqID_41797
  Subcellular localization annotation: CTP_CleavageSite=44; ConfidenceScore=5.38e-01
MPHVGSPFTATASCTSRNMPILVVAVHGAASFAHTVRDAADSSRCSAGTSHRRYPPGASARDAVRRDACAAVAVLAHVVVCQPVIPVIVAAAAQQALSRIATARREAVQPVLPRSGTEIAIPERKAVLAGVAAHLRQRNAFVALNAAVAVAIGERRAACRIEPDVEQRGAAGVTADVDVVGELVAQRAAVIQARHQIRLTAQRRQRAVDVQRIARRTAAIGEIQRAAVIHLQRIRCAARQRGMHVVTGIQRRTPINVDGAVRQLQIVSQRPAAIREVNDAPAAAEVNAFAQVIRAEAAAARRNLVKGQAVTGAVAAGEMVSGAEIDAADLGNIVVVCAHGQAAVERAAGPAERVAAAARIDVAQHVTLRQQNHIVSVTARHRHALRRGRHDSTEVLEYRFAAAQIDHRCRQAAGAQRAAVDDGAGGAGDQRRTACRISDIDAGGGEDISRGVGANPGAAGAGDIENVTRTQRQIAAGGRSIGVGDSQAVTAAGYIGGHGGGGIERDGSADAVAIADVKRQVAQANVVQLRAVFDAVAAAQYVDGGVARAERRRAGVEQYAMR

SEQ ID NO: 133483 - protein, 29 aa, Glycine max
  Coding DNA Sequence Number=SeqID_41798
MAALEREGSDELGSTDAQLSQPALRREGD

SEQ ID NO: 133484 - protein, 120 aa, Glycine max
  Coding DNA Sequence Number=SeqID_41799
MHLHKILDTPRYLNLFLSHTKTATQSRGAVTCLHPPDLLTQPTNVKGKAKVVEEQNDKMTLTPNEDIPVKGLSEKRDGCGKKEVSLEEASEFLRIIQQSEFKVIEQLNKTPARVSLLDYS

SEQ ID NO: 133485 - protein, 98 aa, Glycine max
  Coding DNA Sequence Number=SeqID_41800
MEEFDAQVAWPGDQPSSSGRGGASVAQEPVTEEPPAPAEEETILLRRPSHLHQLRSQSSLYRIHQQLQHWILMKTSHRRSRTLKFLHSEHFSLFLVIL

SEQ ID NO: 133486 - protein, 169 aa, Glycine max
  Coding DNA Sequence Number=SeqID_41801
MGDQEETQEQMKADMSALKEQMASMMEAMLGMRQLMEKNTATAAAVSSAAEADPTLLATAHHPPSNVFVGGGEGRGRDTLGHDGSPHLGYNRAAYPLWIAAQLLTTRLCKKMRAILLSPVLEREPPQQPDEGTKDPQDYARRDVEFYPPDPRRSGHPVRCLSPTSRHNQ

SEQ ID NO: 133487 - protein, 124 aa, Glycine max
  Coding DNA Sequence Number=SeqID_41802
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=79%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASA

SEQ ID NO: 133488 - protein, 46 aa, Glycine max
  Coding DNA Sequence Number=SeqID_41803
MGCNKWARNGEGRERGDATFKEKMSLEEAHHHSEAMDKSLEEEGDE

SEQ ID NO: 133489 - protein, 149 aa, Glycine max
  Coding DNA Sequence Number=SeqID_41804
  Gene Ontology: Mol. function=chloramphenicol O-acetyltransferase activity; Biological process=response to antibiotic
  Homolog annotation: Hit_ID=UPI0000ECD75A; Match level="QueryCoverage =59%, HitCoverage=47%, E-value=6e-45, Identity=95%"; Hit description =UPI0000ECD75A related cluster
  Pfam annotation: Domain name=CAT; Domain location=31-148; Score=69.4; E_value=2.5e-18; Accession=PF00302.9; Description=Chloramphenicol acetyltransferase
MPKSSPNMHVKQEVSTRVKPRLLFNQSMGQNTPNKIDDDGSNSHQGKLKRFHRSGVNTTTDFRQFLHIYSQDVACYGENLAYFPKGFIEDMFFVSANPWVSFTTFDLNVANMYNFFAPVFPMGKYYTQGDKVLMPLAIQVHHAVCDGFP

SEQ ID NO: 133490 - protein, 163 aa, Glycine max
  Coding DNA Sequence Number=SeqID_41805
MGIAPTKTPIGPEEVQQGPGVSSSGYGASVGTTGRPFPPASSCRRGIGIVPAKHSVDPEKSNRVLGFSSSDYGPFSVLRSACRPQQGVGRNTTAALGGPAAGNRRTATTSRVHLCSSTKRFERCLRHMADQQATKSKAKGKQSTRSMTDKSLGVQLKTLKKRY

SEQ ID NO: 133491 - protein, 213 aa, Glycine max
  Coding DNA Sequence Number=SeqID_41806
  Gene Ontology: Mol. function=nucleic acid binding; Cellular component= ribosome
  Homolog annotation: Hit_ID=A2Q6B4; Match level="QueryCoverage=96%, HitCoverage=86%, E-value=5e-28, Identity=31%"; Hit description =Ribosomal protein L33; Nucleic acid-binding, OB-fold
  Pfam annotation: Domain name=DUF223; Domain location=40-135; Score= -3.5; E_value=0.0063; Accession=PF02721.5; Description=Domain of unknown function DUF223
MARIPNKIRSSDGSKEALKLAVRITDLWFVGTPDKSEQAEMVFVDSEGDQIHAICKSDHLKSWKADLKENCTYVMHNFKVVKNDGQFRVCEHEYKLFFIGVTVVREADLHELPFKEFRFVEFANVVAGNFVSGLLVDIIGVVDQVVFRHVSSKNTRVVFRMKDLSGEILSCTLWENYCAQFLSYLNERGDDGPMVIILTHARIKDAQGSYPAS

SEQ ID NO: 133492 - protein, 138 aa, Glycine max
  Coding DNA Sequence Number=SeqID_41807
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q5U6B7; Match level="QueryCoverage=84%, HitCoverage=23%, E-value=3e-41, Identity=65%"; Hit description=DNA polymerase
MRIHLFGVDITVGIPTHTYHTEFSMPGGTPVWHSDLEYMTLDNMFGFIEAYVECPKSINKPFLPYGDNKDGTLIFPTGTFVGVYYSEELKYARDIGYTIIPICGYLFEEMESPFKDYINSLFESRSNAKKKGNNALSF

SEQ ID NO: 133493 - protein, 128 aa, Glycine max
  Coding DNA Sequence Number=SeqID_41808
MGDHLEEMIRDLGQESFKQAHAPMYDTLESDSKKPLYLRGKHDAKKLLSSEEDTMFDGCAVSQYKVKDDDECSSDESSKTLHGMQMGEIAMECFAIRPIPPRERRLMVYIRILVKRQEILGLDLPLME

SEQ ID NO: 133494 - protein, 81 aa, Glycine max
  Coding DNA Sequence Number=SeqID_41809
MEEFDAQVAWPGDQPSSSGGGGASTAQEPVAKEPPAPPPAPSPIATEEETTPAQTPQPSPPSAPAPEETHPSALDLNEDQP

SEQ ID NO: 133495 - protein, 203 aa, Glycine max
  Coding DNA Sequence Number=SeqID_41810
MASMMDAMLGMRQLMEKNMATAVVVSSAAEADPTLPAIAHPIPDVVGQERSTLGHISNPHLGYNRVAYPYGFPPNYTPPVIRDDAGRVPPPILEGEPPRQSDEVHEDLRGHAQGDIDSHSPFPAEGPTPNALPQPNLMGEPRNPSAQPIFFSADGPPLVAEERRKLDLIEERLRVVEGFGDYPFADMTDLCLVPDVIIPPKFK

SEQ ID NO: 133496 - protein, 16 aa, Glycine max
  Coding DNA Sequence Number=SeqID_41811
RDSNVSMTDLVSAEDD

SEQ ID NO: 133497 - protein, 87 aa, Glycine max
  Coding DNA Sequence Number=SeqID_41812
DRNGQWLKKDALPPQDERTPSPPPQRDDSALINEVLSELWGLRTYVGERFDSLDNCFVGMDIHLTQLEKDVGYICQSFDLPPPPPPS

SEQ ID NO: 133498 - protein, 200 aa, Glycine max
  Coding DNA Sequence Number=SeqID_41813
  Homolog annotation: Hit_ID=UPI00005F8A74; Match level="QueryCoverage =57%, HitCoverage=21%, E-value=7e-13, Identity=38%"; Hit description =COG2831: Hemolysin activation/secretion protein
  Pfam annotation: Domain name=POTRA_2; Domain location=132-200; Score =32.2; E_value=1.9e-06; Accession=PF08479.2; Description=POTRA domain, ShlB-type
  Subcellular localization annotation: CTP_CleavageSite=45; ConfidenceScore=5.47e-01
MAISAIAASLSTTQARCAPRPARSPTTAATSTSPRIAGVGDTVVSAGLTVGLIGCDKRFPHPRVGEWMREHEKGICCSRAEATPAPAKQRVSQESLIGDTQRKLLPSTPPVLSPQPEQNAQADIFISESPCWMIDKVETATAPLRLTAFKQLAHTARGRCMGDKGLARLRKKLQNALIAQGYITSRVQLDVQEVPTGILK

SEQ ID NO: 133499 - protein, 152 aa, Glycine max
  Coding DNA Sequence Number=SeqID_41814
MAGTFFLLKQQISLEIMSGKKEMTPNRVVNWPFRTLYHYFGDATITEATEALEAIFQKRGGACRPVASSLSNPTFKMFWKGLDSKCYLHSVATYPSVGGRRVTRGKRVPRKEYARSRHQRLFEENVGKTGKDAIYELFSERFGSCIYARGRY

SEQ ID NO: 133500 - protein, 100 aa, Glycine max
  Coding DNA Sequence Number=SeqID_41815
DGPSGTSTLVFRGLHVLTIRGLHALTSRGLHVLALRGLHALTLEGCTPSPWVLVTLTVERTTRPRLEGTTRPHHQRAARPHLQRTTCPRLERATRPHLGY

SEQ ID NO: 133501 - protein, 136 aa, Glycine max
  Coding DNA Sequence Number=SeqID_41816
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=71%, E-value=3e-24, Identity=68%"; Hit description=LacZ protein
MALARDCCRETTHGAICPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133502 - protein, 41 aa, Glycine max
  Coding DNA Sequence Number=SeqID_41817
MKGLGVVFTHGGDRWRRRKGDRRCHFKEKMSEEQAHHHRKP

SEQ ID NO: 133503 - protein, 181 aa, Glycine max
  Coding DNA Sequence Number=SeqID_41818
MTDLLDESISCFLIRVNPWVLVPSPSEEYMSSPLEGHVPSPSEDFTSSPPEDYMSSPSEDYTSSPSEGYTSSPSKGHVPSPSEDYTSLPSKGHGYTPSPSEDYMSSPLEDYTSSPSEDYMSPIFKGRHALTFRGLHVLAIIGLHCLAFKRRHVQNFRGLHTLAFRGLCVLTFNGLHIHTLR

SEQ ID NO: 133504 - protein, 89 aa, Glycine max
  Coding DNA Sequence Number=SeqID_41819
  Homolog annotation: Hit_ID=Q6UUU1; Match level="QueryCoverage=58%, HitCoverage=35%, E-value=5e-09, Identity=57%"; Hit description =Putative uncharacterized protein
GKPVVPAALMNRPTRGERRFAYWALAECILAYYVGTDEGYIPLPRSLTRYARAFDCGEREWLTNGGGDFLEDAQGRYFNREVRGPRAKP

SEQ ID NO: 133505 - protein, 117 aa, Glycine max
  Coding DNA Sequence Number=SeqID_41820
  Homolog annotation: Hit_ID=A5AT67; Match level="QueryCoverage=58%, HitCoverage=6%, E-value=1e-09, Identity=46%"; Hit description =Putative uncharacterized protein
MLEVWETWSFKEGLPSVQRIAPPLGLVDLMILKSNKDDDVAWWFDSGAISHVCKDRRWFKEFRPIDDGSIVKMGNVATEPILGLGCVNLVFTSGKSCIWIMSYLYLVFVRTYCLVWF

SEQ ID NO: 133506 - protein, 84 aa, Glycine max
  Coding DNA Sequence Number=SeqID_41821
MGKRMTIIYLRMSSGSPPLDDKRAQNDHNLSLRAIRHDRAWMERCRMTTICHYAPSDTIASGWRKGVRNDHNLSPHVIGLAASG

SEQ ID NO: 133507 - protein, 95 aa, Glycine max
  Coding DNA Sequence Number=SeqID_41822
MIRRGQDIYSSQEETTSSPSSSGSEDEVRGEESSEEVYPHEEGDFLMEDHLKWPNNGITLTHLGTKFVLHPQTPSQVDKDLLTMKDKRDEEEKEG

SEQ ID NO: 133508 - protein, 88 aa, Glycine max
  Coding DNA Sequence Number=SeqID_41823
  Subcellular localization annotation: CTP_CleavageSite=65; ConfidenceScore=5.12e-01
MSCTSSLSALLHLIKRTASAHLLSKNRSLSENSLIRLPGYGKLNPLLDLPSRSFNSGNWSDSKVLDSTELSCLNAVLVEFSPTRGIYG

SEQ ID NO: 133509 - protein, 59 aa, Glycine max
  Coding DNA Sequence Number=SeqID_41824
MNVGGDSTHISPLESAPVSLARKKARCDSWRLHWGPFSPTGLSKKGALYPGSWEFKEWR

SEQ ID NO: 133510 - protein, 114 aa, Glycine max
  Coding DNA Sequence Number=SeqID_41825
  Homolog annotation: Hit_ID=A7Q8B9; Match level="QueryCoverage=23%, HitCoverage=6%, E-value=7e-09, Identity=96%"; Hit description =Chromosome chr14 scaffold_63, whole genome shotgun sequence
MVGAGLKKDLRVSRVVPGGAMIYFTGEVSAQLVELRSCNWVVAITGWMSNCPGGNDSILRAVKNVEEGFLIWDPGEEDQAGPCEQLDALSPFNPLSEMWQNEKESMDRPHRLHP

SEQ ID NO: 133511 - protein, 72 aa, Glycine max
  Coding DNA Sequence Number=SeqID_41826
MHIVVVRQGQDHLELPSGVRTKCGRQKPIKVLRDGCKWGWGHDRPIVAPSLREASRECRCWIGGLYGMALGL

SEQ ID NO: 133512 - protein, 167 aa, Glycine max
  Coding DNA Sequence Number=SeqID_41827
MTCADKIWSFCTLLSSRGGGPDDMRRQNLVIPHPFAIQTQSCPMARRDKIWSFCTLLSSRGGGPDDMRRQNLVIPHPFAIQTQSCPMARRDKIWSFCTLLSSRGGGPDDMRRQNLVIPHPFAIQTQSCPMARRDKIWSFCTLRQSRPTSPLTRGDLHHLPHSQDLSY

SEQ ID NO: 133513 - protein, 140 aa, Glycine max
  Coding DNA Sequence Number=SeqID_41828
LQVVPFRVRLMNHVIAFPLKSTLRKFITWEINRDKDTPRRIFGVPSRPPQQGPNIFQRTTKLEETIAQFMQVAMSNHKSTESALKNLEIQKNPKEECKAVMTRSKKLMSAEDEDVVALNEQVVLNDTTDKKKNGVKDERI

SEQ ID NO: 133514 - protein, 179 aa, Glycine max
  Coding DNA Sequence Number=SeqID_41829
  Pfam annotation: Domain name=MAP7; Domain location=5-167; Score= -84.5; E_value=0.1; Accession=PF05672.2; Description=MAP7 (E-MAP-115) family
MSHHSSSVNGEGTSHKDPLSRILDELSSLKLWKEKQERKEKGKKRVEEISQDERKKIREEERRKIMKEMKREKHPSYGSHNSCKSLSEELRDHYEGRHRSHLRPHSHRKEKERKPQEANINLPYFHGKDNVEANLVWEIRVEQQLKKKSTSKSYGSHSYPKKDQGQGILGVTPSKPKDV

SEQ ID NO: 133515 - protein, 141 aa, Glycine max
  Coding DNA Sequence Number=SeqID_41830
IVPTRHPVDPKEPNKALGFPTLVMGLCQSYRVPVPPARSCHRDIGKDRAHKTPSRPGGAQQGPGVSGSGYGPLSVYEGCPSPKQGHAIVTMRDRAHKTRSGPGGAQQGLGVSSSGYGPLLVLQGARFPPARDRARKTPSGP

SEQ ID NO: 133516 - protein, 166 aa, Glycine max
  Coding DNA Sequence Number=SeqID_41831
  Homolog annotation: Hit_ID=UPI00006A2D9E; Match level="QueryCoverage =97%, HitCoverage=85%, E-value=3e-13, Identity=17%"; Hit description =UPI00006A2D9E related cluster
MRGPLDESISCFLIRVDPWVTSTVTFKGLHTLAIRGLHVPAFRGLHILAFRGLHALPFRGLHILAIRRLHVLAIKGLHVHAFRGLHVLAFRGLHALAFRGLHALTFRGLHVLAFRGLHALDFRGLHVLAFRGRHALAFRGLHALMFKGLYALAFRGLHVLHFKGLH

SEQ ID NO: 133517 - protein, 71 aa, Glycine max
  Coding DNA Sequence Number=SeqID_41832
MELLRLHQHEENDKKKKGIALKASSSIQVESDKENDLDEDDDLSLFVKRFNKFLKVRGNQRRADFKSKRRT

SEQ ID NO: 133518 - protein, 392 aa, Glycine max
  Coding DNA Sequence Number=SeqID_41833
  Gene Ontology: Mol. function=histidinol dehydrogenase activity; Cellular component=chloroplast; Biological process=amino acid biosynthetic process
  Homolog annotation: Hit_ID=A8GC79; Match level="QueryCoverage=100%, HitCoverage=90%, E-value=0.0, Identity=86%"; Hit description =Histidinol dehydrogenase
  Pfam annotation: Domain name=Histidinol_dh; Domain location=18-392; Score=750.5; E_value=1.1e-222; Accession=PF00815.11; Description =Histidinol dehydrogenase
MSTFSTPIDWATCSAERQAELLMRPAIAASDSITRTVSEILDNVKANGDRALRDYSARFDKAEVAALRVSAEQIAAACARLGDDIKQAMAVAVANVDTFHNAQRLPAVDVETQPGVRCQQVTRPIDSVGLYIPGGSAPLFSTVLMLATPARIAGCRRVVLCSPPPIADEILYAAQLCGVQEVFQVGGAQAIAALAFGTESVPRVAKIFGPGNAFVTEAKRQVSQRLDGAAIDMPAGPSEVLVIADAGATPAFVASDLLSQAEHGPDSQVILLTPDAAMARAVAEAVESQLAELPRAETARQALASSRLIVARDLPECVAISNRYGPEHLIIQTRNARELVDGITSAGSVFLGDWSPESAGDYASGTNHVLPTYGYTATCSSLGLADFQKRMT

SEQ ID NO: 133519 - protein, 115 aa, Glycine max
  Coding DNA Sequence Number=SeqID_41834
MSSHSTSLEPKSRLTINLDPGRRRRKRRREKKENSPIKEWEKAKRKERKFPIKEWEKVKKEEEEGKKAPDRGSKEKQKGMQRGLWTGQYLNNTELSPNEQKKKERKPRPKMVFSL

SEQ ID NO: 133520 - protein, 166 aa, Glycine max
  Coding DNA Sequence Number=SeqID_41835
  Subcellular localization annotation: CTP_CleavageSite=70; ConfidenceScore=5.13e-01
MVKVGTSYVPINVSFSPKVGPGLPGINRDTRIYCSWRIMVLSAVPSCSAMTGNGVIRSIGTQAYRPEHQRASVKPGRETLSPFAAFKAAQLCAKGDRCGPFAITPAALKGGCVHTGDYYVGTDNARGEFLVSSTVGVMRHALELVAYPHGAEFDRSWDCSGRYLTG

SEQ ID NO: 133521 - protein, 327 aa, Glycine max
  Coding DNA Sequence Number=SeqID_41836
  Homolog annotation: Hit_ID=A5C7Z4; Match level="QueryCoverage=24%, HitCoverage=28%, E-value=9e-09, Identity=36%"; Hit description =Putative uncharacterized protein
  Pfam annotation: Domain name=Transposase_23; Domain location=23-93; Score=10.9; E_value=7.6e-05; Accession=PF03017.5; Description =TNP1ENSPM transposase
MQFQGLTLPLEPLVGPSENHPETGDSDRCCLYIEANHARLVALGRVYEGFTVVHNTPLFPGQVKVGVEEVKDPDAPVPVPTDEVSLVGQAIHTFLAWLTHLVKSLSQHVLYSYYMFLLFELIHLACLKLGHLTLFHEQHVVSPAKSPQKLDPEVDDPFYLMTLTIPELFLRPYQVTWDATMFGVFNPNFPLYIKHKDLSEITHGDQCLSISVLQLWILRHWQMMVIVPKEYLVVWFCSLHSRPDNNLKGIINIALKGLDDAPQPKSKAPARWIVIKCNRQKGNTECGYYVMHWMSTIILGNFRNNWEAYFNDPRPLESERLKALQIQ

SEQ ID NO: 133522 - protein, 44 aa, Glycine max
  Coding DNA Sequence Number=SeqID_41837
MNSRNQSMYIGTDASGGGVTTDRSLPLLCAKQAENVAARQPSIL

SEQ ID NO: 133523 - protein, 115 aa, Glycine max
  Coding DNA Sequence Number=SeqID_41838
  Homolog annotation: Hit_ID=Q1J7G7; Match level="QueryCoverage=31%, HitCoverage=64%, E-value=8e-07, Identity=60%"; Hit description =Transposase
LELLRADQRLISPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTL

SEQ ID NO: 133524 - protein, 322 aa, Glycine max
  Coding DNA Sequence Number=SeqID_41839
  Pfam annotation: Domain name=G-patch; Domain location=200-244; Score =10.7; E_value=0.0096; Accession=PF01585.14; Description=G-patch domain
LGKARLAKEKFKSAATHIRKECTELQEENAATTRALEQETKRARKEEYGREKFRGALWGSNNELKLRREERDRSRVHGMILKEELVACARSKRSLAQHLEATEQSMLAIIGQYKEELNQSVAHEQKLVEDFAQVYAEKEARGRVIDALHQEATMWMDRFALTLNGSQDLPRLLAKAKAMAEVVSCASVEPSPSLPSLSNAAIMVARVMLRNGFEPRMGLGKDCLGNADMVDIKGNPYKYGLGYEPGMPGRRNVPSRFRADRVWPGRISQCFTSAGMVSEEEVVAIEEEFPQDPPIFVQPCHPGSQVGDWRVISQSEVYTADS

SEQ ID NO: 133525 - protein, 137 aa, Glycine max
  Coding DNA Sequence Number=SeqID_41840
MPISPCRCIGWDRAHKTPSGPEEVQQGPGVSSSGYGPLSVLQGVRSPNEESHPQRHPVDPEKSNRALGFPALGSRLQNTQWTRRSPTGSWNCQALIRGLCQFYRVPVTSSKGIRPPTNRAFIKKYCGSRQAQGKTPQ

SEQ ID NO: 133526 - protein, 61 aa, Glycine max
  Coding DNA Sequence Number=SeqID_41841
MEVDEPCLGLWLPLNYQVDFVVDLGMTYMDNWVEWQSQHGFLPHPHPLHLPQFSDSFKQDD

SEQ ID NO: 133527 - protein, 66 aa, Glycine max
  Coding DNA Sequence Number=SeqID_41842
MGGKCAESPPTFIRGKRRKKLKKVWSTNFKCERFGSCFYAWGRCFPRSYVSSIAMMESQTYVVLQN

SEQ ID NO: 133528 - protein, 220 aa, Glycine max
  Coding DNA Sequence Number=SeqID_41843
EKQKKKKDSKALCSKAKGKKKEEKDSSKKIVNKENHFATKCDIKIALLLKQSFYLLLSRETSLSTAIPLELEVIPQVKELLDEGLVRKSLNPRALLVPKIGIIRHQIPMIGGIMNVLSGATLFCKITHAPNIFMICVHRDSLGSDQGLPMDPKRIKVIPDWPTPPTPLIELVRNYILSWEDDQERGVEERIHEFQEPLDLRSNPFQGGGNDAILPPKGIG

SEQ ID NO: 133529 - protein, 242 aa, Glycine max
  Coding DNA Sequence Number=SeqID_41844
MVKVGTSYVPINVSFSPKVGPGLPGINRDTRIYLFCEVIFAGHGIYSAQCWAWAARSKLIDYRRPRGGARYQLLFPLVRVNFQLGVHVSISCPPVQLLKLYPLTAKATSRKHQRASVKRARPLSPFRNLSATAFEATGDRGGPLLLRQLAKGGCAQRLICWVTDARVSQSKRCKAGIVIINRANWSSTAVAAALELVDPPGQEYVLPSLTKLRSAFDCGAAEMAYERGGDFLEDARKILNRE

SEQ ID NO: 133530 - protein, 101 aa, Glycine max
  Coding DNA Sequence Number=SeqID_41845
MAADFVEEIHSDPKNHFLQFTQWNNKASINNRWKFLWLALSFFVWHHRNAMIFKNQPFDPEKRRTTPGTTPSICSSCMWRSTPGCLMNDNSISHLPAVNDM

SEQ ID NO: 133531 - protein, 84 aa, Glycine max
  Coding DNA Sequence Number=SeqID_41846
  Homolog annotation: Hit_ID=A5BQU9; Match level="QueryCoverage=91%, HitCoverage=11%, E-value=3e-07, Identity=34%"; Hit description =Putative uncharacterized protein
MDQAGEERKLQLSELDEIRLEAYENAKFYKEKTKKFHDIEIKSDSTNKSFKVNGHRLKPFLTNPSLVDVVVEETSLLHPTLPPP

SEQ ID NO: 133532 - protein, 99 aa, Glycine max
  Coding DNA Sequence Number=SeqID_41847
MKPGIVIYCHYLPVSGLGNLRACCLPLDVVAVSQAPSPESNPNSPSPVTTMQAPGQASSETTDFKEQCGGTRPPTFTACTASERTITTRVPQEAVMMDD

SEQ ID NO: 133533 - protein, 150 aa, Glycine max
  Coding DNA Sequence Number=SeqID_41848
  Subcellular localization annotation: CTP_CleavageSite=58; ConfidenceScore=5.42e-01
MVKVGTSYVPINVSFSPKVGPGLPGMHVFWASLSIPSTSRGGRYQLLFPLVRVNFELLAFMVYQLSSSTPHPLIALRYTALRHSANCREGPDRCGPLAIKTPAGERGDEYSLPLLELTRYAPVVRLRRAEMAYERGGDFLEDARKILNRE

SEQ ID NO: 133534 - protein, 264 aa, Glycine max
  Coding DNA Sequence Number=SeqID_41849
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSEMGKTVGATDMEGLGVWFWAFGDLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133535 - protein, 271 aa, Glycine max
  Coding DNA Sequence Number=SeqID_41850
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMLCLLLLTIKKVLPLRTMLVTCEHQRASLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133536 - protein, 317 aa, Glycine max
  Coding DNA Sequence Number=SeqID_41851
  Gene Ontology: Mol. function=transferase activity; Cellular component= cytoplasm; Biological process=sulfate transport
  Homolog annotation: Hit_ID=Q4J334; Match level="QueryCoverage=83%, HitCoverage=50%, E-value=1e-83, Identity=62%"; Hit description =Rhodanese-like
  Pfam annotation: Domain name=Rhodanese; Domain location=158-250; Score=9.6; E_value=0.035; Accession=PF00581.11; Description =Rhodanese-like domain
  Subcellular localization annotation: CTP_CleavageSite=31; ConfidenceScore=5.03e-01
MPVFVIRYSRCATAPLAGRWPVMRWSMGRAAAMATPAKPRNVRPRARHAPLPIALQEARTTYLFDVRDAEEYAAGHLPGSRHVAGGQLVQETDHYASVRGARIVLVDDDGVRANMTGSWLAQLGWQVAVPDALQASDFSAVGSWQPQVAPVAAPESISPAQLAEWLAAGDTQVLDFTTLANYRNSHIPGAAWLLRSTLQQQGKALLPDAGRYVLTCGSSLLASYAVEQIATLSGKPVRVLAGGNAAWRAAGLPTEQGEQRLLSPPIDRYRRPYEGTDIEPDVMHGLSRLGYGLVAQLDRDGTHGFRVLQLQPQAVTV

SEQ ID NO: 133537 - protein, 70 aa, Glycine max
  Coding DNA Sequence Number=SeqID_41852
MEDARTALGNQFVALRTQWWRMHERQSIHGALNKMVEDARTALGYQFVGLRPQWWRMYERQSIHGASNKI

SEQ ID NO: 133538 - protein, 84 aa, Glycine max
  Coding DNA Sequence Number=SeqID_41853
NGCKITLILHHGGRFTPRASDGKVEYIGGEFDAWEDIFADYMNTFILYPIPEEVPLMLDFKCHPIPEASNEDDLDDVPVVGHEE

SEQ ID NO: 133539 - protein, 22 aa, Glycine max
  Coding DNA Sequence Number=SeqID_41854
MARTKKTGEMTTEAVKEIIAKI

SEQ ID NO: 133540 - protein, 107 aa, Glycine max
  Coding DNA Sequence Number=SeqID_41855
MISPPNLSQKNDDLRLIHREIVVKFEHHVCNPITSIFAVGDFDIMFELREIPFASETKESHQDSTSGGFNPLSVSLTFENSIGAVRGKNWKNLRKPLEMLLSRSEDT

SEQ ID NO: 133541 - protein, 104 aa, Glycine max
  Coding DNA Sequence Number=SeqID_41856
MVAVGDGESAWNFRNGFGRKKEEEMTFFLSYMKAKAELRAHSRYLLKDPNGQIMDKCLVKLQTKCQEEPTVNEGWAAFLPRQLHVAFSRSFIKKVPPEASSWLL

SEQ ID NO: 133542 - protein, 74 aa, Glycine max
  Coding DNA Sequence Number=SeqID_41857
RKMQGSCMNEHNMRTMKIECMQYGSKASKLILMMPKTQVKNQDSSKIQESKSHSIKNQDSSEESRKDSRYARAS

SEQ ID NO: 133543 - protein, 262 aa, Glycine max
  Coding DNA Sequence Number=SeqID_41858
  Gene Ontology: Mol. function=transporter activity; Cellular component= integral to membrane; Biological process=transport
  Homolog annotation: Hit_ID=A6TH60; Match level="QueryCoverage=84%, HitCoverage=29%, E-value=9e-93, Identity=70%"; Hit description =Putative fimbrial biogenesis outer membrane usher protein
METKEVTLKQNVTASGITWKIVNDYGGAGTLYSSSFDPSNAPDLSVFEARNAQAPAGPAPLAMRSKLAPCFSLKDLSQYGVRVKAFTKLQEDANGCTNLTVIPDTKADFDFNAQRLNISIPQAALSTVVQGFIPEDQFDDGINALLVNYQFSGSDDFESEDEYYSLNLQSGLNLGPWRIRNLSTWNKTKGDAGDWESAYLYMQRSIRPINSNLVMGESSSLSGIFDSVPFTGVQLATDTSMLPESLRGYAPIIRGIAKPTPG

SEQ ID NO: 133544 - protein, 29 aa, Glycine max
  Coding DNA Sequence Number=SeqID_41859
MESKVLGIPLQAHEFANELRASLSRASGL

SEQ ID NO: 133545 - protein, 133 aa, Glycine max
  Coding DNA Sequence Number=SeqID_41860
MVYAILTRMSVHVAQLIADAIYLFAGLCQSFGVPVAPSKVIRPPITRAFIEKYCTQRQAQGGDPQAPDAPPPPPQADPFVSFDTERAEVAWPGDWPEAQAAKAPTETPGEPDEAREDEEMSDLLGFLGGSGAT

SEQ ID NO: 133546 - protein, 260 aa, Glycine max
  Coding DNA Sequence Number=SeqID_41861
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=46; ConfidenceScore=5.19e-01
MVKVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDAHAVLHQQHPQAGREGTACLRAGAAPGAGAGARGKYEIAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133547 - protein, 122 aa, Glycine max
  Coding DNA Sequence Number=SeqID_41862
MAPKKLSAKRSRSDAAAEGTSAAPEFDSHRFRSAEHQQRFEAIKGWSFHRERHDQLRDDEYTDFQEEIAHRHWTSLVTPMAKFDPDIVLEFYANAWPTVEGVRDMRSWVRGQWIPFDADALS

SEQ ID NO: 133548 - protein, 331 aa, Glycine max
  Coding DNA Sequence Number=SeqID_41863
MELDEFKAELERHNFHKHLTNLADSNIDLALVKEFYANLYSPKGPLPKQVRIQGHLIKIDADNLNTFLETPVVLAEGESLPAYSRYCRMPIDIKEIEAALCIPGRGFVLNAEGHPGKILRKYLDLTTLAQVWSVLSYSNLSLTSHTSDLISDRARLIFGLVSQLDMNVGSLISGQITSMAHSNSSRLGFPALITSLCRSRGVASDSLVFERLSPFINLAYIRKNCWNLADLTVTIRGARRARARPAKAPSTSTAPPPARTLAAPSTPSSVDFQRLEAMLQSIHQGKIVLLQSLQLVAPPDSIPSVEQFNEWVAWPGTQPPLHREDEGLTAQ

SEQ ID NO: 133549 - protein, 109 aa, Glycine max
  Coding DNA Sequence Number=SeqID_41864
MSGAISLSWESSVKDLNEYFLIERKFPCSGQTSLYSENLSESSSTELALNQKYVPVARVCGLCSSADHHTDLFPSMQQPGAIKQPEAYAANIYNRPPQPQQQITTAEQL

SEQ ID NO: 133550 - protein, 17 aa, Glycine max
  Coding DNA Sequence Number=SeqID_41865
MDTHLRVIDDPMNEVQR

SEQ ID NO: 133551 - protein, 95 aa, Glycine max
  Coding DNA Sequence Number=SeqID_41866
MPASCKAPKINLLEVIMSFICLGLCSTHASIAFTAGPPWLVSGFVFTFGPSSWKMSFVGRVPTWRGFRHESKSSDGAKHTDEYHEGLIGVLAKQS

SEQ ID NO: 133552 - protein, 116 aa, Glycine max
  Coding DNA Sequence Number=SeqID_41867
MSVLELYIEKDVSGGSMFHSANSLTSCGNNLSNNEAEPSRNVSNLHGDEDNDDDYLVSNSYVEESLDEDDNVDDISDTDDEVTNMIQPVRIVHPAEGVEQIQNPFWNDVFHYNNIN

SEQ ID NO: 133553 - protein, 95 aa, Glycine max
  Coding DNA Sequence Number=SeqID_41868
  Subcellular localization annotation: CTP_CleavageSite=47; ConfidenceScore=5.27e-01
MKGNQQRGKSRGVANCRNLPFGGRATRDSRDANQRFWVRSPVESPTVATYPSAGGRRETRGMRVPRKEYARSRHQRLFEENVGKTGKDAIYELLS

SEQ ID NO: 133554 - protein, 98 aa, Glycine max
  Coding DNA Sequence Number=SeqID_41869
  Subcellular localization annotation: CTP_CleavageSite=28; ConfidenceScore=5.35e-01
MATELKQAQSQNSDKLPSQSVQNPKNVSAITLRSGKQYQGPQPIASSSSANEPAQLHSTTEKDDDKNLKTVAYPSSIPSKSNFQQKNGRGREGNLGNI

SEQ ID NO: 133555 - protein, 152 aa, Glycine max
  Coding DNA Sequence Number=SeqID_41870
MVKVGTSYVPINVSFSPKSLASKPASRIDSIVDQFIKLIDTVDLEGAGPLLKLLSVTIRHTSIPSRKHQRASVKPGVPNDVSYTHTLNCVALQLPFAFVPTVGKGPDRCQGLFAIKNRQRGERGVLQVAIKLGNARSVPSHGLLCCKTDEGQ

SEQ ID NO: 133556 - protein, 114 aa, Glycine max
  Coding DNA Sequence Number=SeqID_41871
MKVLRFRNGGTAQGRRSCVRDSENVIFIEQDAWRRQLTGNRLHEYCNRLQAICSSVIDYSIHVYDQEGYHSQIIVASSIKFVHNNCRQKYIPLQQWIKQHCFVSYYAMRQERIQ

SEQ ID NO: 133557 - protein, 92 aa, Glycine max
  Coding DNA Sequence Number=SeqID_41872
MVLREKALFHNRKALRGGHAFPQRMRSLTAYAGMSVMSVISLIQCDFYRSKNAGSTPYNENLLSFVLKSRGNRVTRMGASRANPCMTRSSFG

SEQ ID NO: 133558 - protein, 95 aa, Glycine max
  Coding DNA Sequence Number=SeqID_41873
MRETIWYPQLFFVSLRFISRVITHAETTLWSSVPFVIRGQGNRVWWHTETNYDHSAPCRPGSIMPNNTQRQIMVILRLVSTKRNGFDSIRMMCRY

SEQ ID NO: 133559 - protein, 43 aa, Glycine max
  Coding DNA Sequence Number=SeqID_41874
MEQVSIGYQNWGMAFMDKWVVGKEKGCYWLSNDIVGLVGNLAV

SEQ ID NO: 133560 - protein, 116 aa, Glycine max
  Coding DNA Sequence Number=SeqID_41875
  Gene Ontology: Mol. function=aspartic-type endopeptidase activity; Biological process=DNA integration
  Homolog annotation: Hit_ID=A5AGP4; Match level="QueryCoverage=85%, HitCoverage=16%, E-value=2e-11, Identity=34%"; Hit description =Putative uncharacterized protein
  Pfam annotation: Domain name=zf-CCHC; Domain location=56-73; Score =3.5; E_value=0.45; Accession=PF00098.14; Description=Zinc knuckle
  Pfam annotation: Domain name=zf-CCHC; Domain location=77-94; Score =14.9; E_value=0.0085; Accession=PF00098.14; Description=Zinc knuckle
  Pfam module annotation: Pfam domain module=zf-CCHC::zf-CCHC; Domain location=56-73::77-94
MGAKIAKEAWNTLQEEFQGSVKPQNKENRGKKNYGETSRRREGSRNFLKNKTDKNPPCNICKRQGHAEKNCWFRNMPQCNHCKKFGHVEKNCHNKNRHQANIVEEHDQEQCTFYAT

SEQ ID NO: 133561 - protein, 40 aa, Glycine max
  Coding DNA Sequence Number=SeqID_41876
MPHVMQSYPARALDRRLQEDWARDAREGPRVLMSLRGSIM

SEQ ID NO: 133562 - protein, 152 aa, Glycine max
  Coding DNA Sequence Number=SeqID_41877
  Pfam annotation: Domain name=zf-CCHC; Domain location=39-56; Score =21.9; E_value=0.00073; Accession=PF00098.14; Description=Zinc knuckle
KDQGQGILGVTPSKPKYDKGKTIEKQPLKASMQEKTSSMKCFKCLGIGHITSQCPTKKTMTMRGQDIYSSQDEATTPPSSSESEEAKAEESSEEICPQEERQPLMVKEECKETPASIATPIRLEFNPQVKELLDEGLVHKSLNPCALLVPKI

SEQ ID NO: 133563 - protein, 198 aa, Glycine max
  Coding DNA Sequence Number=SeqID_41878
  Subcellular localization annotation: CTP_CleavageSite=28; ConfidenceScore=5.09e-01
MVKVGTSYVPINVSFSPKVGPGLPGLISSSMAYHGLSAVLLFSTEECVIRSIATSIPSRKHSGQVLRKLWNDRCGPFAIRRQAGERGMCCKANWKKAATAVAAALELVAPGLNRKFVLSARLDNARSFDCGERKWLTNGAEISWKMPGRYLTGKTIKIPAFPPGGSLVRSPVPAFRFTGVIPLLWPRLSHSTPDTQFP

SEQ ID NO: 133564 - protein, 317 aa, Glycine max
  Coding DNA Sequence Number=SeqID_41879
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
WNSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLRGDFLHRPAASDQGLDDGLLHLRPVTVNRGMQGAVRVLNGFAGAGHGAQQGKGYQGNNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133565 - protein, 174 aa, Glycine max
  Coding DNA Sequence Number=SeqID_41880
HPMDPDTSNRALGFPALITGLCQSFGVPVAPTKVIQPPITRAFIEKYCTQRQAQGDAPKAAGAPPPPHRAGPAGSFDMEQYLRHLVQQQAANHRAHVQTHDCLYQLSLSMQSQGFASSSCPTPDQFRAGVAWPGDWPEAQAGEAPPEVPDDGEEAHEDEEMADFLDFLGGSGAT

SEQ ID NO: 133566 - protein, 149 aa, Glycine max
  Coding DNA Sequence Number=SeqID_41881
  Gene Ontology: Mol. function=RNA-directed DNA polymerase activity; Biological process=RNA-dependent DNA replication
  Homolog annotation: Hit_ID=A2Y2J4; Match level="QueryCoverage=55%, HitCoverage=15%, E-value=2e-08, Identity=37%"; Hit description =Putative uncharacterized protein
MKREKHVSYSSHDSCKSLSEELSDYYRGRHRSHTKHNSQRREKDRRPQEINISLPYFHGKDNREKFQCLPLAFKGMPFIGGLPLLGNEGFMGVLPVEYWNDLKSALRKRHIPSYYERELMDKLQRLRQGSVSVEEYRKKNGTTPFNSWT

SEQ ID NO: 133567 - protein, 123 aa, Glycine max
  Coding DNA Sequence Number=SeqID_41882
MSLATLFGKLQEHEMELLRLHQHEENDKKKKGIALKASSSIQEESDQDNDPDDDDDDLSLFVRRFNKFLKKKMEKSEKKNHSEKKLKKAYITWDENDMESSEDSENEEINLCLKAKSYESDEE

SEQ ID NO: 133568 - protein, 81 aa, Glycine max
  Coding DNA Sequence Number=SeqID_41883
  Pfam annotation: Domain name=G-patch; Domain location=2-43; Score =10.5; E_value=0.01; Accession=PF01585.14; Description=G-patch domain
MMVAWVMLGHGYELGMGLGKNNGGRASLVSVRGNCRKFGLGYKPMQADIRKNISKRKNKGQGPRSGQQAKEVPSCHISRSF

SEQ ID NO: 133569 - protein, 132 aa, Glycine max
  Coding DNA Sequence Number=SeqID_41884
  Pfam annotation: Domain name=G-patch; Domain location=1-42; Score =29.0; E_value=1.7e-05; Accession=PF01585.14; Description=G-patch domain
MVAQVMLGNGYEPGMGLGKDNSGRTSLISARGNHGKFGLGYKPTQADIRKSVAGRKSGGQGSRLGQEVEGGPPYHISKSFISADLRHEGQVVAICEDDSLSESDLVRPCPPGFRLGNWRVEERPDIYATSIM

SEQ ID NO: 133570 - protein, 325 aa, Glycine max
  Coding DNA Sequence Number=SeqID_41885
  Pfam annotation: Domain name=zf-CCHC; Domain location=123-140; Score =16.4; E_value=0.005; Accession=PF00098.14; Description=Zinc knuckle
SSHNSCKSLSEELHDYYEGRHRSHLRPHSHRREKERKPQEANINLPYFHGKDNVEANLVWEIRVEQQLKKNSTLKSYGSHSYPKKYQGQGILGVTPSKPKDDKGKTIEKQAPKASMQEKTSSIKCFKCLGKRHITSQCPATKTMIMRGQDIYSSQDKATTSPSSSESEEAKGEESSEEIYPQEEGQPLVVKEKCKEVSVSSKRLAKKETHFTIKTNIKETLPLRQPPHFLFCKKTLASIATPLGLEFIPQVKKLLDEGLVRKSLNPCALLVPKIGFNTNLGAHMGHLSIQGVPTNPKRIKVIPDWPTPPSIREMWGFHDLTNFYK

SEQ ID NO: 133571 - protein, 64 aa, Glycine max
  Coding DNA Sequence Number=SeqID_41886
MGEEEKKPEENKVEEKKANEEKKKEEEKKSEESKDDKESKEKSARPEIVLGTTFAMHGYFKHDF

SEQ ID NO: 133572 - protein, 221 aa, Glycine max
  Coding DNA Sequence Number=SeqID_41887
  Gene Ontology: Biological process=transposition, DNA-mediated
  Homolog annotation: Hit_ID=Q1J7G7; Match level="QueryCoverage=17%, HitCoverage=67%, E-value=2e-10, Identity=72%"; Hit description =Transposase
MVKVGTLLRADQRLIFAKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPEFDGPPKLLFKCTVNWGACSTDTSSNAIAAGIIKLIDTVDLEGGPVGKPVVPAALMNRPTRGERRFAYWALAECILAYYVGTDEGVSEVLHVAGEKRLH

SEQ ID NO: 133573 - protein, 149 aa, Glycine max
  Coding DNA Sequence Number=SeqID_41888
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MAFELVSVEHAPQFTVHLNKSFGGPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133574 - protein, 252 aa, Glycine max
  Coding DNA Sequence Number=SeqID_41889
  Gene Ontology: Mol. function=oxidoreductase activity; Cellular component=cytosol; Biological process=metabolic process
  Homolog annotation: Hit_ID=A6EP41; Match level="QueryCoverage=61%, HitCoverage=55%, E-value=7e-58, Identity=70%"; Hit description=Short- chain dehydrogenase/reductase SDR
YGQIGTLEELSDEEARENFDVNVFGSLNVIRNVMPYLRNQGSGNIFNIASVGGLFGSFPGWGIYCSTKFAVAGFTEALAEEAKAFGVKATVVYPGYFRTDFLAKGSVRTPKNTIKAYEAARESEQLHLDTINGNQANDPEKAAEVLIAISKEAQPPDGYVRHELLPGNRYDEARGSRESAYQGSYIVSGNHIDYKDDTGFTADGEFKEGILYHGGPEHPLISLIDYSRVSYPVKDDEMKWIQNLYSIGLKRN

SEQ ID NO: 133575 - protein, 44 aa, Glycine max
  Coding DNA Sequence Number=SeqID_41890
MSPNLKGKTIATQPLDMVVSCSSHEFGSYTKISSMNIAPLKIIK

SEQ ID NO: 133576 - protein, 452 aa, Glycine max
  Coding DNA Sequence Number=SeqID_41891
  Gene Ontology: Mol. function=aspartic-type endopeptidase activity; Biological process=proteolysis
  Homolog annotation: Hit_ID=A7QKZ4; Match level="QueryCoverage=99%, HitCoverage=44%, E-value=3e-71, Identity=33%"; Hit description =Chromosome chr8 scaffold_115, whole genome shotgun sequence
MLSDNFSIDKETLRKNFYSPENEPQRRWFFQHYKGTNRKQIQDKFYEFVERVKINVLFFDWFHAYAIRKDIDYPWKQDIIGNPTTNVITNWQVKDGELIQSELPPTTQYQLPNIKDSNNKPVMAIPFKTKDVNEEVTSRDIKSLMEQANYTNKYLQALGETIKTKVVPKQKSIEEASPSVPIEKPLFKPFKVSDKAKRKIRELRKTKSLIEGVDNTTEIGSVSEKNINPINSKHWKTPSKLYYQRPTAPDLLLEERGENNFKSFSANNIYEWNIDAQTEYNIMNTLQHMTMVATAYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYES

SEQ ID NO: 133577 - protein, 235 aa, Glycine max
  Coding DNA Sequence Number=SeqID_41892
MTTLTQIWMTLLLSNIQPSDHNSHLPLPKCQLVYAILTRMSIHVAQLIADAIYLFVGMAPTRHPLDPDKSNRALGFPALITGLCQSFGVPVAPSKVIRPPITRAFIEKYCTQRQAQGDAPQATDAPPPHQAGPAGSFDTEQYLRHLVRQQAANHQAHVQTHDCLYQLSLSLQSQDFTSFPCPTPDQFRAEVAWPGDWPEARAGEAPAEAPDEADEAHEVEEMTDLLDFLGGSRAP

SEQ ID NO: 133578 - protein, 279 aa, Glycine max
  Coding DNA Sequence Number=SeqID_41893
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIDLDAQRLEQKKDALKKKANSFPVFASVHLLKVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133579 - protein, 92 aa, Glycine max
  Coding DNA Sequence Number=SeqID_41894
  Homolog annotation: Hit_ID=A5C528; Match level="QueryCoverage=54%, HitCoverage=8%, E-value=2e-10, Identity=56%"; Hit description =Putative uncharacterized protein
MGKNYESDEEVSLKKKWYIDSGCSKHMTGDSSKFTHISPKKSGHVTYGDNTKYVISVCFCLDHVDACFVRIIQQWKLFWSSSVQQEEFEDDA

SEQ ID NO: 133580 - protein, 252 aa, Glycine max
  Coding DNA Sequence Number=SeqID_41895
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPAHRQKGLAYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133581 - protein, 148 aa, Glycine max
  Coding DNA Sequence Number=SeqID_41896
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=71%, E-value=1e-24, Identity=69%"; Hit description=LacZ protein
  Subcellular localization annotation: CTP_CleavageSite=42; ConfidenceScore=5.34e-01
MTMITPSSKLTLTKGNKSWHWVNTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133582 - protein, 156 aa, Glycine max
  Coding DNA Sequence Number=SeqID_41897
  Gene Ontology: Mol. function=endonuclease activity; Cellular component=cytoplasm
  Homolog annotation: Hit_ID=A6T507; Match level="QueryCoverage=99%, HitCoverage=60%, E-value=1e-82, Identity=94%"; Hit description =Putative uncharacterized protein yafD
  Pfam annotation: Domain name=Exo_endo_phos; Domain location=1-149; Score=1.3; E_value=0.0026; Accession=PF03372.14; Description =EndonucleaseExonucleasephosphatase family
MTLSSAHPVYCCPLREREPILRLAKSALVTVYPLPDTRMLMVVNIHAVNFSLGVDVYSKQLLPIGDQIAHHSGPIIMAGDFNAWSRPRMNALYRFAREMSLREVRFSDDQRKKAFGRPLDFVFYRGLSVHDASVLVTRASDHNPLLVEFSPGKPDK

SEQ ID NO: 133583 - protein, 139 aa, Glycine max
  Coding DNA Sequence Number=SeqID_41898
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=84%, HitCoverage=41%, E-value=5e-60, Identity=98%"; Hit description=Beta -lactamase TEM precursor
MHSIGVRDPLEQPPPPPPIETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDHTAANLLLTTIGGPMS

SEQ ID NO: 133584 - protein, 171 aa, Glycine max
  Coding DNA Sequence Number=SeqID_41899
  Subcellular localization annotation: CTP_CleavageSite=72; ConfidenceScore=5.60e-01
MVKVGTSYVPINVSFSPKVGPGLRAGSTGTPGLFIAKVFPPGVIMVLSAVPSCSAMTGNWLSASQFGKSTSRTSAGKCKAGACPSHWCATVGKGLIGAACINDASAGECCKAIKLGNARSVLLTMFTDVEGAEIPMLRMTRTLGRSTAASEMAYERGGDFLEDARKILNRE

SEQ ID NO: 133585 - protein, 167 aa, Glycine max
  Coding DNA Sequence Number=SeqID_41900
PGPPPDIGGRPTVRAHPEREAIMHLLCIPEQDFPRAAAKRRGSRPQDTQWTRRSPTGPWGFQLWLRASVSPTGCPFPQQDHAIEWHPQRHTVDPEKSNRALGFPALVTGLCSPTGCPFPPARSRYHDIGIAPARHPVDPKKSNRVLELPSSNYGPRSVLRSACRPQQ

SEQ ID NO: 133586 - protein, 60 aa, Glycine max
  Coding DNA Sequence Number=SeqID_41901
MKTRVGSQVMVLSCWGFESKSVSLNLGVLLSPIALKVVAPLLLDSNSSRYGTNPPFQFPI

SEQ ID NO: 133587 - protein, 141 aa, Glycine max
  Coding DNA Sequence Number=SeqID_41902
  Subcellular localization annotation: CTP_CleavageSite=41; ConfidenceScore=5.06e-01
MVGKDLGSTGGPHYSQIQNKHAFSPYGLPPNYTPPNVAYTPSENVNNSTPILIESRQPQTDHSHVSQTVGETHEIPHHNLADFEPCLGYATEGQVVGGILLQNTLEGPQFRPQPQPLHSTAGKIPPIMEGMGKVGSSKGKA

SEQ ID NO: 133588 - protein, 86 aa, Glycine max
  Coding DNA Sequence Number=SeqID_41903
MATSWIPLRTIASFLALNCWELEAIFSTKFLASAGVISPRAPPLAASIILLSIGPRCREEFLHEHPLKVILAENRPGSKELMKHWA

SEQ ID NO: 133589 - protein, 30 aa, Glycine max
  Coding DNA Sequence Number=SeqID_41904
MGTETHDSFRAWEASKRQLDRNVGGGKRKT

SEQ ID NO: 133590 - protein, 67 aa, Glycine max
  Coding DNA Sequence Number=SeqID_41905
MVKGRKPFVLNEKLKGIKGALKEWSKQHGEDFDGRIVEANKEVDDIDKLGELQDLVDKQHNRSDGST

SEQ ID NO: 133591 - protein, 73 aa, Glycine max
  Coding DNA Sequence Number=SeqID_41906
MEKKSIAGLCFLFLVLFVARVHASPLAAAMITARTKSTCSEADAGTIFAVGAPKTVKWIHSLQREEDACSAIL

SEQ ID NO: 133592 - protein, 778 aa, Glycine max
  Coding DNA Sequence Number=SeqID_41907
  Gene Ontology: Mol. function=protein phosphatase type 2A regulator activity; Cellular component=protein phosphatase type 2A complex; Biological process=signal transduction
  Homolog annotation: Hit_ID=A7P1I9; Match level="QueryCoverage=74%, HitCoverage=76%, E-value=0.0, Identity=56%"; Hit description =Chromosome chr19 scaffold_4, whole genome shotgun sequence
  Pfam annotation: Domain name=WD40; Domain location=344-382; Score =39.5; E_value=1.2e-08; Accession=PF00400.23; Description=WD domain, G-beta repeat
  Pfam annotation: Domain name=WD40; Domain location=462-506; Score =37.1; E_value=6.2e-08; Accession=PF00400.23; Description=WD domain, G-beta repeat
  Pfam annotation: Domain name=WD40; Domain location=510-570; Score =0.2; E_value=30; Accession=PF00400.23; Description=WD domain, G-beta repeat
  Pfam annotation: Domain name=WD40; Domain location=572-612; Score =11.0; E_value=1.4; Accession=PF00400.23; Description=WD domain, G -beta repeat
  Pfam module annotation: Pfam domain module=WD40::WD40::WD40::WD40; Domain location=344-382::462-506::510-570::572-612
KLSFGSSRVIGSDRRCDRIIDLTLVWERGIFIANGNAQSQQHSSQSSSSPRTMSKALGGTTEDEDEEEQQLLEQDQDCFYDSHDRLLSLSSSCSCSNSNSDNENDAEEHQNDTLPNFTNFYDIWISQPSSVSERRTRLLLSLGLSSLTRPIPRDRASPLRFISDTTTTNPNKPPNPKPPPPPPPPPPPPPPPPSPPIEELCTIRDLDNGKEFVVNELENLREVATGRQLTMEEFEMTVGHSPIVQELMRRQNVEEANVDSNAGGSKAKKKGTGWLKSIKSVASSVAGYRDRRSSDERDTSSEKGGRRSSSATDDSQEGSGGAFHGSERVRVKQYGKSCKEVTALYKSQEIRGHSGSIWSIKFSLDGKYLASAGEDCVIHVWQVVEGERKGELLLLDREKGEDGNVNMFLVVNGSPEPMAGAAGLLSPLGDGERKRKGRSSVSRKSLSLDQFVVPQTVFALTDKPVCSFLGHLHDVLDLSWSKTQFNPVDDRYFISGSLDAKVRIWSIPDRQVVDWTDLHEMVTAACYTPDGQGALVGSYKVLTEFYEQFAPGSSSEVLITSADSRIRVVDGVDLVHKFKGFRNATSPISASLTANGKYVVAASEDSHVYIWKNEADCRPNRTKGVTVTRSYEHFHCKDVSVAIPWPGVGDAWDMHDTLSGEQPELDNHADEVASANHPPTPVEENFVTEGSRSASGYSNSPRHATIASATNTYFFDRISATWPEEKLLLATRNQSPRVSMDFSNGVSQKMSAWGMVIVTAGLRGEIRTFQNFGLPLRI

SEQ ID NO: 133593 - protein, 207 aa, Glycine max
  Coding DNA Sequence Number=SeqID_41908
  Gene Ontology: Mol. function=abscisic acid binding activity; Cellular component=plasma membrane; Biological process=regulation of abscisic acid mediated signaling
  Homolog annotation: Hit_ID=A7P1J1; Match level="QueryCoverage=99%, HitCoverage=62%, E-value=2e-79, Identity=60%"; Hit description =Chromosome chr19 scaffold_4, whole genome shotgun sequence
  Pfam annotation: Domain name=LANC_like; Domain location=3-207; Score=- 10.4; E_value=6.7e-07; Accession=PF05147.4; Description=Lanthionine synthetase C-like protein
MGAYQVTKDGNDHNLCSEIVKACDSASIDSRKVTFICGRAGVCALGAVIARHSEQIGIPHDLPYELLYGRAVADEVTMAGRQLGRKGRCPLMYEWHGKKYWGAAHGLAGIMHVLKDMELKPDEVEDVKGMLRYVINNRFPWGNYPSSEGSENDRLVHCCHGAPGLTLTLEFLQATVDAGEVVWKRGLLKRVGICHDIGGNTYVFLSL

SEQ ID NO: 133594 - protein, 87 aa, Glycine max
  Coding DNA Sequence Number=SeqID_41909
  Homolog annotation: Hit_ID=A5BYP3; Match level="QueryCoverage=70%, HitCoverage=12%, E-value=8e-10, Identity=53%"; Hit description =Putative uncharacterized protein
MADNNSFIPNPYKSSKPLACITFTNVTKLLPNNYPNWKQQVEALLDGYDLLQYPDGSFLAPSKTILTVPTSSTSTLSETTPTIASLL

SEQ ID NO: 133595 - protein, 367 aa, Glycine max
  Coding DNA Sequence Number=SeqID_41910
  Gene Ontology: Mol. function=structural constituent of ribosome; Cellular component=intracellular; Biological process=translation
  Homolog annotation: Hit_ID=Q9AVH1; Match level="QueryCoverage=70%, HitCoverage=98%, E-value=1e-101, Identity=69%"; Hit description =Putative senescence-associated protein
  Pfam annotation: Domain name=Ribosomal_L18p; Domain location=132-257; Score=161.5; E_value=2.2e-45; Accession=PF00861.13; Description =Ribosomal L18pL5e family
  Subcellular localization annotation: CTP_CleavageSite=18; ConfidenceScore=5.11e-01
MDMLESLLGVGLKFNHLRAKRFGGGVSALLRISLLATRLFFSPGSMPVWTGEPRPSTYLCAAHNSNHPPCARKRAPLVKVVNFLRFVAQIPKHPYEGGFEKWKLCVDFGLEEVLKLPYEGGFVEVETLVWFETRDIILKGSNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEILAEDEPEKYQSHFSEYIKRGIEADGIEALYKKVHAAIRADPTLRKSDKQPPKEHKRYNMKKLTYEERKAKLVARVAAINSAADNDEDDE

SEQ ID NO: 133596 - protein, 110 aa, Glycine max
  Coding DNA Sequence Number=SeqID_41911
MSYDGSLKSSQGMATCGGLLRDHHGRWKIGFAKKWGALQPFLLSYGEFYRASVLLEIKEANRCADAMVSLACDMEADYMIYEEPPAPLLQLISFDVKGISSCTYYYLILA

SEQ ID NO: 133597 - protein, 94 aa, Glycine max
  Coding DNA Sequence Number=SeqID_41912
  Homolog annotation: Hit_ID=A7P1G9; Match level="QueryCoverage=71%, HitCoverage=19%, E-value=1e-08, Identity=43%"; Hit description =Chromosome chr19 scaffold_4, whole genome shotgun sequence
MERNLPSKKATSLHGNARKINIMVTLPEVVEIYVNVVPVTKEDSRIHNYQIPDNDCFACLEVQFKFYGLISQIFRIQQSQVWQCQWLEGKTNIE

SEQ ID NO: 133598 - protein, 97 aa, Glycine max
  Coding DNA Sequence Number=SeqID_41913
MSMILWCIWKRRNQKLWESAEILLQISICSALQYYEEWSRARNAHHQQRSHQPLAQVSTSLGCAYIRHEFKQRHTLRIQKRPRHGVLNGFKSCAVIV

SEQ ID NO: 133599 - protein, 373 aa, Glycine max
  Coding DNA Sequence Number=SeqID_41914
  Gene Ontology: Mol. function=ubiquitin-protein ligase activity; Cellular component=ubiquitin ligase complex; Biological process =protein ubiquitination
  Homolog annotation: Hit_ID=A7R2Q8; Match level="QueryCoverage=95%, HitCoverage=99%, E-value=2e-96, Identity=55%"; Hit description =Chromosome undetermined scaffold_442, whole genome shotgun sequence
  Pfam annotation: Domain name=Arm; Domain location=162-204; Score=9.1; E_value=0.78; Accession=PF00514.14; Description=Armadillobeta-catenin- like repeat
  Pfam annotation: Domain name=Arm; Domain location=208-246; Score=9.5; E_value=0.69; Accession=PF00514.14; Description=Armadillobeta-catenin- like repeat
  Pfam annotation: Domain name=Arm; Domain location=247-283; Score=1.9; E_value=6.4; Accession=PF00514.14; Description=Armadillobeta-catenin -like repeat
  Pfam annotation: Domain name=Arm; Domain location=284-325; Score =10.5; E_value=0.51; Accession=PF00514.14; Description=Armadillobeta -catenin-like repeat
  Pfam annotation: Domain name=U-box; Domain location=6-81; Score=86.9; E_value=6.6e-23; Accession=PF04564.6; Description=U-box domain
  Pfam module annotation: Pfam domain module=Arm::Arm::Arm::Arm::U-box; Domain location=162-204::208-246::247-283::284-325::6-81
MAAEAELPEYLKCPISLEIMSDPVILSSGHTFDRSSIQRWLDAGHRTCPITKLPLPEHSSLIPNHALRSLISNYAPINPLINSSNSHPQTLISTLTSPSSPLPSKLHALHHLTRLSHSDSLFRRRLFNSPALVPALLTFLQHISAADLRHRALSLLLHLSLDDDAKVGLVAEGLLSPLISLLLSSAAPSDCRALAATLLTSLAVLHVNKATIGAFPGSINALVTLLRDGKGRERKEAATALYALCSFPDNRRKAVECGAVPVLFRCADSGLERSVEVIGVLSKSKEGREQMERFCGCVQILTRVFRNGSSRGVQYALMALYSLCCHSQETVVEALKNGVLEICQGLVEDDNVTVRRNSSCLVQLLRGNTHRLS

SEQ ID NO: 133600 - protein, 186 aa, Glycine max
  Coding DNA Sequence Number=SeqID_41915
  Gene Ontology: Mol. function=NADPH:quinone reductase activity; Cellular component=flagellum; Biological process=negative regulation of transcription
  Homolog annotation: Hit_ID=Q8L5Q7; Match level="QueryCoverage=92%, HitCoverage=83%, E-value=2e-59, Identity=67%"; Hit description =Putative quinone oxidoreductase
  Pfam annotation: Domain name=Flavodoxin_1; Domain location=6-123; Score=-8.3; E_value=0.016; Accession=PF00258.16; Description =Flavodoxin
MENMDVILATNRLYDGVEAKLWQVPETLSEEVLVKKGAPPKSDDVPIIKPRELADADGFLFGFPTTFGTMASQFKAFLEGTIGLWHTQALAGKPAGFFSSTSSQGGGQEETPLTSVTQLVHHGMIFVPVGYTFGDGMYEMEKVKGGSPYGSGTVVGDGSRQPSDLELAQAFHQGKYFAAIAKKLKG

SEQ ID NO: 133601 - protein, 100 aa, Glycine max
  Coding DNA Sequence Number=SeqID_41916
  Homolog annotation: Hit_ID=A7PVI3; Match level="QueryCoverage=91%, HitCoverage=39%, E-value=3e-13, Identity=44%"; Hit description =Chromosome chr9 scaffold_33, whole genome shotgun sequence
MVLDSILTSPRLKSPSFRRQFKKDELGSWSTLFQRHRFLLSALVLLTLLCTVYLYFAVTLGASGTCSGLTGAQKASCHMELVKDSVAKGNILSLFLPEYR

SEQ ID NO: 133602 - protein, 68 aa, Glycine max
  Coding DNA Sequence Number=SeqID_41917
MVGSRVDVGAVVNGDLGEDGVSVRADSRSRMTLSLTVICKVLVVLSEAIYNLFKAVHGGVVAVVSEHD

SEQ ID NO: 133603 - protein, 224 aa, Glycine max
  Coding DNA Sequence Number=SeqID_41918
  Gene Ontology: Mol. function=ribonuclease inhibitor activity; Cellular component=cytoplasm; Biological process=regulation of RNA metabolic process
  Homolog annotation: Hit_ID=A5C5H1; Match level="QueryCoverage=70%, HitCoverage=95%, E-value=3e-63, Identity=72%"; Hit description =Putative uncharacterized protein
  Pfam annotation: Domain name=Methyltransf_6; Domain location=2-159; Score=187.3; E_value=3.8e-53; Accession=PF03737.6; Description =Demethylmenaquinone methyltransferase
MAALPTAELSDANATHVASCDVRVLHPVFKVYGGATAFSGPVVTVKVFEDNVLVRELLETKGEGRVLVVDGGGSLRCALVGGNLALIAHNMGWAGIVVNGCIRDVDEINASDIGVRALASHPLRSNKKRTGEKNVPVYVGGTFIREGEWLYADNDGILALSGGWGEMLRSLSSKYTIFHWIGAAVKSELAKDVPSPNETNSFLKYLIEDASRVLALLAKIAWLG

SEQ ID NO: 133604 - protein, 448 aa, Glycine max
  Coding DNA Sequence Number=SeqID_41919
  Gene Ontology: Mol. function=transcription regulator activity; Cellular component=integral to membrane
  Homolog annotation: Hit_ID=A9PAA7; Match level="QueryCoverage=57%, HitCoverage=59%, E-value=9e-45, Identity=40%"; Hit description =Putative uncharacterized protein
  Pfam annotation: Domain name=DUF573; Domain location=199-298; Score =157.3; E_value=4e-44; Accession=PF04504.5; Description=Protein of unknown function, DUF573
MAQKQKLRPSPLDEPPTASSSDSEEEEPQQQQPSSQKNKEEEDEEVSSGEEEEEDEEEEEAASSEEEEEDEDLPPPPVSKNPPPPPANPQPQHSSSESETESGSETESEPDPTPVKVKPLASKPMDQAQKPKAQPSPAPPPKLTLKRPAENNNNNARVADSKRAKKKATESSSAANSAAAAASDDEMEEDGKKSGDNSKKFQRLWSEEDELAIVKGVVEFTSKTGLDPLKFPNTNAFHDFVKKSLHVEVSCNQLKEKVRRLKKKFETQAGKGKNGEAPKFSKPHDQKFFELSKKVWGREVTAGANGGPVEKPKSNGSAVKSPKKKESGSRNVASAKKPKPESKPEPVPVLSLEYKDSEKMQINQKPDGGDASLFLRELARSKEGASICKLDEDDVKRGLELIGESKRAELRGKWKKLHLAEMELFANRSELIGEQTKLILEALQASDH

SEQ ID NO: 133605 - protein, 699 aa, Glycine max
  Coding DNA Sequence Number=SeqID_41920
  Homolog annotation: Hit_ID=A5BPC2; Match level="QueryCoverage=85%, HitCoverage=91%, E-value=7e-88, Identity=34%"; Hit description =Putative uncharacterized protein
MAETRCLAIIDEEEIEVDDDDIYENIEAPKFVDLTAPDCRRPDHDRHWFCFRVGCDQKHEQELDSEAIYKNFVLRVMAARSPNVRLRKALNRREASANLKCPLTAPAKSRVSRMDLISSLPHKMTDNNVKVKPLSMVAATPNAKVKQSPSVAKALTTPRNHQKKVSKVEQFRSVQSKKALTVGVPKSRVVAKALVFHSPKKVLKIKSSIELKTAMRTLCSAMNKLELNGVKKNGKGGSNSLAVATSKKQLRGREVKSRVFDSLYSNNRKEPETNTKTSLKEKKVKKGTQKCPVAVPHENDTSHMEIDEKSRCGSLEGCHESGTSGSGGELSFGDEKSHKSTRGESSVPVLTEASRSDITSLSSLNNEENKTTERSENEETKNSVSNKGKVSVAKKRKAEENSLASDDRENERQLTENDEKENVSAPHENIEISNNDDVPKKKAILGSKHEDSRKTQKKFTSTSTTPQVLKFRKLKPTNPKPFKLRTDERGILKEANLDRKIPSSLKETTVKGSESKAMRKYQNANRSSETCSTKSEQDTDNHYSSCDEKSNQTTRENQSGSIKSNNSNCKVQRKLSATSPLRNPPGPKLQKVTDLDDNLKRKSRMMQRKIVRPRSALPRKKERVVLATKLSVIVEKASDIVKPKETKPRKNDAVSSPTSKTTGSIHRPFSRGKRDLTVPKEPKFQSLHVPKDCTTGGHT

SEQ ID NO: 133606 - protein, 300 aa, Glycine max
  Coding DNA Sequence Number=SeqID_41921
  Homolog annotation: Hit_ID=A7UQS8; Match level="QueryCoverage=81%, HitCoverage=52%, E-value=1e-117, Identity=86%"; Hit description =Metal ion transporter , putative
MAAKDGVVAGFSIGLGLGSGKFMELARHRVMENGVGEEMEGETSARVPLRERRVYPAHPSCLVRKRAYIFDGMGNFYHKDWDLADLFQKEEKESGVGEGRGNEFSWYHVELPKGNQKLSQSAQDLIGVFCPPLKLQDILSLVSNGPFCAHVDGALVFRVNSPGPPSSDFTFRIAARVTEHSVITVSLGRVPRLGFSRVGESLLSEIPSVESSYPSRGQQQERTVIKEHVLEFLLTMNHSEEADNPVPRSVSNLVVHIIDTHVDQIQDLVTKLEMELDSVELDLDKGDFVINSLIPPPNPF

SEQ ID NO: 133607 - protein, 109 aa, Glycine max
  Coding DNA Sequence Number=SeqID_41922
MRTTTKLQQSKSFKSEANRSDQGTMTVTQQRQEKRNEGGTTKDDSTICKSEQNIDMRAWRWCECDQRKDYAQRWQEKVAVARVVRVPPGSRRCMSTMARECRCGATSVG

SEQ ID NO: 133608 - protein, 437 aa, Glycine max
  Coding DNA Sequence Number=SeqID_41923
  Gene Ontology: Mol. function=zinc ion binding; Cellular component =outer membrane-bounded periplasmic space; Biological process =negative regulation of gluconeogenesis
  Homolog annotation: Hit_ID=A7QSA7; Match level="QueryCoverage=88%, HitCoverage=100%, E-value=1e-154, Identity=71%"; Hit description =Chromosome chr3 scaffold_157, whole genome shotgun sequence
  Pfam annotation: Domain name=zf-C3HC4; Domain location=380-423; Score= 9.5; E_value=0.0076; Accession=PF00097.16; Description=Zinc finger, C3HC4 type (RING finger)
MVVVVVVVGSSGSADRVVVVRMVVVAAVVVAIERGREVAQCGDEESRILGIKMELSSIKDAFDRVAKKQKLSSSKSQEVVDQVGCEIEQALATIQSSHDPSAPVDQKSVLTELKFKLNAIGPLQQLEGSNKELNISLTKYQKLLEKLLNPDISKAYRNVDFDTHIVNQIIANHFYHQGLFDLGDSIINEAGEPDAAALRSQFLEMHQIIGAMRERNLQPALTWVSANREKLVQIGSNLELKIHTLQFVEVLQNGTRADALKYARTYLAPFASLNKGEFPKLMGCLLYAGRLESSPYSELLSPIHWEMTTEELTRQFCTLLGQSYENPLSVAVAAGVEGLPTLLKLANVMAAKKQEWQEMKQLPVPVELGKEFQFHSIFVCPVSRDQGSEENPPMLLPCLHVLCKQSIMKLSKNSTRTFKCPYCPAEATVANCKQLYF

SEQ ID NO: 133609 - protein, 178 aa, Glycine max
  Coding DNA Sequence Number=SeqID_41924
  Gene Ontology: Mol. function=methylmalonate-semialdehyde dehydrogenase (acylating) activity; Cellular component =mitochondrion; Biological process=valine metabolic process
  Homolog annotation: Hit_ID=A7QSD0; Match level="QueryCoverage=82%, HitCoverage=35%, E-value=7e-55, Identity=64%"; Hit description =Chromosome chr3 scaffold_158, whole genome shotgun sequence
  Pfam annotation: Domain name=Aldedh; Domain location=1-175; Score= -304.3; E_value=0.05; Accession=PF00171.13; Description=Aldehyde dehydrogenase family
MGAKNHVVVMPDANVNALVAAGFGAAGQRCMALSTVVFVGGSKLWESKLLEHAKALKVNVGTKPDADLGPVISKQVLGYESGNFIDPTILSDVTANMECYKADSLEEAINIINENKYGNGASIFTTSSVAARKFQAEIEAGQVGINVSSSFALFLIYWQQGLICWRSQFLRYSDFSLS

SEQ ID NO: 133610 - protein, 689 aa, Glycine max
  Coding DNA Sequence Number=SeqID_41925
  Gene Ontology: Mol. function=hydrolase activity; Cellular component =mitochondrion; Biological process=cell division
  Homolog annotation: Hit_ID=A7QM20; Match level="QueryCoverage=95%, HitCoverage=79%, E-value=0.0, Identity=75%"; Hit description =Chromosome undetermined scaffold_123, whole genome shotgun sequence
  Pfam annotation: Domain name=Dynamin_M; Domain location=237-525; Score=399.7; E_value=4.5e-117; Accession=PF01031.11; Description =Dynamin central region
  Pfam annotation: Domain name=Dynamin_N; Domain location=47-228; Score= 307.3; E_value=2.9e-89; Accession=PF00350.14; Description=Dynamin family
  Pfam annotation: Domain name=MMR_HSR1; Domain location=45-229; Score=- 1.2; E_value=0.0014; Accession=PF01926.14; Description=GTPase of unknown function
  Pfam module annotation: Pfam domain module=Dynamin_M::Dynamin_N::MMR _HSR1; Domain location=237-525::47-228::45-229
  Subcellular localization annotation: CTP_CleavageSite=50; ConfidenceScore=5.40e-01
MADEVPSPPAASAATAPLGSSVISLVNRLQDIFARVGSQSTIDLPQVAVVGSQSSGKSSVLEALVGRDFLPRGNDICTRRPLVLQLVQTKRKPNLDNNDEYGEFLHLPGRKFHDFSEIRREIQAETDREAGGNKGVSDKQIRLKIFSPNVLDITLVDLPGITKVPVGDQPSDIEARIRTMIMSYIKTPTCLILAVTPANSDLANSDALQMAGIADPDGNRTIGVITKLDIMDRGTDARNLLLGKVIPLRLGYVGVVNRSQEDIQMNRSIKDALVAEENFFRNRPVYNGLADSCGVPQLAKKLNQILAQHIKAVLPGLRARISTSLVAVAKEHASYGEITESKACVNTGMRLGSFSSMLEGKNEMSTSELSGGARIHYIFQSIFVRSLEEVDPCEDLTDDDIRTAIQNATGPKSALFVPEVPFEVLVRRQISRLLDPSLQCARMCLNKIPSLQISHRCMVTELQRFPFLRKRMDEVIGNFLREGLEPSENMIAHLIEMEMDYINTSHPNFIGGSKALEIAAQQTKSSRVAIPVSRQKDALESDKGSASERSVKSRAILARQANGVVTDPGVRAASDVEKIVPSGNTGGSSWGISSIFGGGDSRMTMKENIASKPHAEPVHSIEQSISMIHLREPPPILRPSESNSETEAIEITVTKLLLRSYYGIVRKNVEDLIPKAIMHFLVLYYFISL

SEQ ID NO: 133611 - protein, 89 aa, Glycine max
  Coding DNA Sequence Number=SeqID_41926
  Homolog annotation: Hit_ID=A7R3I3; Match level="QueryCoverage=51%, HitCoverage=4%, E-value=1e-09, Identity=67%"; Hit description =Chromosome undetermined scaffold_525, whole genome shotgun sequence
MAGSVRPKARDEQYILRVALQDLSQPKSEISPPDGLLAVPLLRHQCFNISNACHKASILSHLILASLAAPPQQVLRGTPYSFMQCVKGG

SEQ ID NO: 133612 - protein, 171 aa, Glycine max
  Coding DNA Sequence Number=SeqID_41927
  Gene Ontology: Mol. function=sequence-specific DNA binding; Cellular component=nucleus; Biological process=regulation of transcription, DNA-dependent
  Homolog annotation: Hit_ID=Q9FUY6; Match level="QueryCoverage=83%, HitCoverage=56%, E-value=2e-13, Identity=37%"; Hit description=MADS -box protein JOINTLESS
  Pfam annotation: Domain name=K-box; Domain location=15-114; Score= -12.5; E_value=0.0051; Accession=PF01486.8; Description=K-box region
MSSMQQILERRDRHSGIQGLVNPSIGQQLGSDSLGILRKEIEHKTNEMSQLNGEEIQGLTIKELQKVEELLQRRWTTISKIKDEKIIQEINHLKTKKPSDLNLEAYETSTILKCVNDRGGRFATLQVPTPERPLKVSNLKVGQSIIPLALSLKHLKHIIQSASVVTTSQNS

SEQ ID NO: 133613 - protein, 382 aa, Glycine max
  Coding DNA Sequence Number=SeqID_41928
MEGIVVGIVNVGIEGVLGNEGMVGMLLGSGGKVVGKDGRVGCGSVELNEITIEWDLDSFPGWFYSMNPTPKPRSSDPTYLQLGGSVRINGEGNLYSGQSVTGGNGGNITRGGELPILGIVGVEGGGERNGMEGIVVGIEGNGGMLSCGSVGMVGMLLGSGGKVVGKDGKGGNVGEGKLGIPGKFGAVLVCIRWRAARLMLMLEKVRARRKAVMNNLLEAIAQWKWLKDSAWSYIGLESWDISWFHFNFVNLENQIERGEKGGSVRINGGGNLYSGQSVTGGNGGNIRRGREFPKSGLEAEGGGERNGMEGIVVGIEGNRGRLSCGTVGMVGMLLGSGGKVVGKDAARLMLMLDMVRARRKKAVMNALLEAIARMKKNKNFQI

SEQ ID NO: 133614 - protein, 108 aa, Glycine max
  Coding DNA Sequence Number=SeqID_41929
MFSWCWVVAAVVLGFLRHWVVRTQEAKKKVQEVIIYMHMQKKKKNKRGSRRALLPTPATLLERRRHTTIGAGRTGREERDPPLALAGHANLGSLAIGSCGTPPMCANF

SEQ ID NO: 133615 - protein, 163 aa, Glycine max
  Coding DNA Sequence Number=SeqID_41930
  Gene Ontology: Mol. function=protein heterodimerization activity; Cellular component=microtubule; Biological process=cell division
  Homolog annotation: Hit_ID=A7R3U5; Match level="QueryCoverage=92%, HitCoverage=44%, E-value=3e-78, Identity=57%"; Hit description =Chromosome undetermined scaffold_569, whole genome shotgun sequence
  Pfam annotation: Domain name=WD40; Domain location=1-36; Score=2.4; E_ value=16; Accession=PF00400.23; Description=WD domain, G-beta repeat
  Pfam annotation: Domain name=WD40; Domain location=124-161; Score =3.8; E_value=11; Accession=PF00400.23; Description=WD domain, G-beta repeat
  Pfam annotation: Domain name=WD40; Domain location=40-78; Score=44.0; E_value=5.2e-10; Accession=PF00400.23; Description=WD domain, G-beta repeat
  Pfam annotation: Domain name=WD40; Domain location=82-120; Score =46.0; E_value=1.4e-10; Accession=PF00400.23; Description=WD domain, G-beta repeat
  Pfam module annotation: Pfam domain module=WD40::WD40::WD40::WD40; Domain location=1-36::124-161::40-78::82-120
MQSLSGHTSPVESVAFDSGEVLVLGGASTGVIKLWDLEEAKMVRTVAGHRSNCTAVEFHPFGEFFASGSMDTNLKIWDIRKKGCIHTYKGHSQGISIIKFTPDGRWVVSGGFDNVVKVWDLTAGKLLHDFKFHEGHIRSIDFHPLEFLLATDGSFTADMSSEQ

SEQ ID NO: 133616 - protein, 326 aa, Glycine max
  Coding DNA Sequence Number=SeqID_41931
  Gene Ontology: Mol. function=oxidoreductase activity; Cellular component=cytoplasm; Biological process=response to red or far red light
  Homolog annotation: Hit_ID=Q4W8C3; Match level="QueryCoverage=100%, HitCoverage=99%, E-value=1e-173, Identity=90%"; Hit description =Gibberellin 2-oxidase
  Pfam annotation: Domain name=2OG-FeII_Oxy; Domain location=172-276; Score=129.8; E_value=8.1e-36; Accession=PF03171.11; Description=2OG -Fe(II) oxygenase superfamily
MVLLSKATTEQYSYIKNYMPTAFSSTIPIVDLSKPDAKTLIVKACEEFGFFKVINHGVPIEAISQLESEAFKFFSMPLNEKEKAGPPKPFGYGSKKIGHNGDVGWVEYLLLNTNQEHNFSFYGKNAEKFRCLLNSYMSSVRKMACEILELMAEGLKIQQKNVFSKLLMDKQSDSVFRVNHYPACPELAVNGQNLIGFGEHTDPQIISLLRSNNTSGLQIFLRDGNWISVPPDHKSFFINVGDSLQVMTNGRFRSVRHRVLANGFKSRLSMIYFGGPPLSEKIAPLPSLMKGKESLYKEFTWFEYKNSTYGSRLADNRLGHFERIVA

SEQ ID NO: 133617 - protein, 1591 aa, Glycine max
  Coding DNA Sequence Number=SeqID_41932
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A7QXB2; Match level="QueryCoverage=99%, HitCoverage=82%, E-value=0.0, Identity=67%"; Hit description =Chromosome chr19 scaffold_218, whole genome shotgun sequence
  Pfam annotation: Domain name=Glucan_synthase; Domain location=707 -1467; Score=734.2; E_value=9.2e-218; Accession=PF02364.6; Description=1,3-beta-glucan synthase component
MAYELHGILSGAISLTTWEKVMPAYGGETESFLNNVVTPIYTVIRQEVANSKGGAADYSVWRNYDDLNEYFWSPDCFKIGWPMRLDHDFFFVKPRNKPEPDVKNALVVSPGKTKEKKKREKRDEEEPEDTREEIHEQQWLGKTNFVEIRSFWQIFRCFDRMWSFFILSLQAIIIIACHDLGSPLQLLDAVVFEDIITIFITSAYLKLIQAILDVAFMWKARYTMESSQKVKLVVKLVLATIWTIVLPVCYANSRRKYTCYSTKYGSLVEEWCFTSYMVAAAIYLTTNAVEVLLFFVPAVAKYIEVSNYKICKVLSWWTQPRIYVGRGMQEDQIKPLIAPTRQIMKIGVKKYEWHELFPKVKSNAGAIVAVWSPVVIVYFMDTQIWYSVFCTIIGGLYGVLHHLGEIRTLGMLRSKFDSLPSAFNVCLIPPSSKRGKKKRKGLLSNIFQKLPDEKNATAKFVVVWNQIVNHLRLEDLISNREMDLMMMPVSSELFSAKVRWPVFLLANKFSTALTIAKDFEGKEEILVKKITKDKYMFYAVRECYQSLKYVLEILVVGSIEKRIICDILSKIEKHIQETSLLKNFNLKVLPALHAKVVELAELLMEGDKDHQHKVVKALLDVFELVTNEMMFDSRILDMFHFPEQNECGFVYFRNDDQLFDSVEMNRDFYPFAKENSIHFPLPESGPLMEKIKRFHLLLTVKDTAMDVPSNLDARRRISFFATSLFTDMPDAPKVHNMMPFCSITELCLIYDMIGSVITPHYIEDINFSLKELGSDKEEDSIIFYMQKIYPDEWTNFLERMGCDNRKSLEDEHKTEDLRLWASFRGQTLSRTVRGMMYYREALKLQAFLDMAEEEDILEGYETAERGNRALFARLEALADMKYTYVISCQSFASQKASNDPRYQDMIDLMIRYPSLRVAYVEEKEEIVQGKPHKVYSSKLVKVVNGYEQTIYQIKLPGPPHLGEGKPENQNNAIIFTRGEALQTIDMNQDNYLEEALKMRNLLQEFLRRQGRRPPTILGLREHIFTGSVSSLAGFMSYQETSFVTIGQRVLANPLRVRFHYGHPDVFDRVFHITRGGISKASKTINLSEDVFAGFNSTLRRGCISYHEYLQIGKGRDVALNQISKFEAKVANGNCEQTISRDMFRLGRQFDFFRMLSCYFTTVGFYFSSLISVIGIYVFLYGQLYLVLSGLERALIIEARIKNVQSLETALASQSFIQLGLLTGLPMVMEIGLERGFLTALKDFVLMQLQLAAVFFTFALGTKTHYYGRTLLHGGAKYRPTGRKVVFHASFTENYRLYSRSHFVKAFELLLLLIVYNMFRRSYQSSMAYVLITYAIWFMSLTWLCAPFLFNPAGFSWTKTVDDWKEWNKWIRQQGGIGIQQDRSWHSWWHDEQAHLRWSGFGSRLTEVLLSLRFFIYQYGLVYHLDISQHSKNFLVYVLSWIVIVAIFLLVKAVNMGRQLLSANYQLGFRLFKAFLFLAVLAIIFTLSVICELSLTDIFVCCLAFMPTAWGLIMIAQAARPKIEHTGLWDFTRALAREFDYGMGIVLFGPIAILAWLPIIKAFHARFLFNEAFKRHLQIQPILSGKKKKHRT

SEQ ID NO: 133618 - protein, 94 aa, Glycine max
  Coding DNA Sequence Number=SeqID_41933
MNSCRGGFGGPCPRAGRSARRLWLRCGRSHPRNGVVILGFGGGWDRVEVLGLGETHQSCGVGVLGGGKLGQGEQQQEPRRGGGFQRNHDTSKGS

SEQ ID NO: 133619 - protein, 363 aa, Glycine max
  Coding DNA Sequence Number=SeqID_41934
  Gene Ontology: Mol. function=hydrolase activity; Cellular component =mitochondrial matrix; Biological process=transcription
  Homolog annotation: Hit_ID=Q9C8L4; Match level="QueryCoverage=66%, HitCoverage=99%, E-value=2e-99, Identity=70%"; Hit description =Putative hydroxyacylglutathione hydrolase 3, mitochondrial precursor
  Pfam annotation: Domain name=Lactamase_B; Domain location=144-299; Score=77.1; E_value=5.8e-20; Accession=PF00753.18; Description =Metallo-beta-lactamase superfamily
MPIATKLYASNVTSTLNSKTNSNNGDLIYVILIVIPVIKLFLYSTIHNQNPTTSTLQSLSSIQPFWWQLLFMLQKMLRLHFTTALSHFASKASPFPLTPVSVTVSRAIVCNNPTRFRSQMGSFSTSSSSSSKLLFRQLFEKESSTYTYLLADASHPEKPALLIDPVDRTVDRDLSIIEQLGLKLVYAMNTHVHADHVTGTGLIKSKVPSVKSVISKASGATADLYVEPGDKVQIGDLFLEVRATPGHTKGCVTYVTGDAPDQPQPRMAFTGDTLLIRGCGRTDFQILTLPKSTLIYPAHDYKGFTVSTVGEELQNNPRITKDEETFKNIMGNLNLSYPKMIDIAVPANMVCGIQSNPKQAEAS

SEQ ID NO: 133620 - protein, 73 aa, Glycine max
  Coding DNA Sequence Number=SeqID_41935
MMMCLRCRDVGKGVTHNYRGGGVAHTLIELGDYGCAIVVVAWVVAEWGKMKWLGRGKGLVAEHLMASEHHEPA

SEQ ID NO: 133621 - protein, 226 aa, Glycine max
  Coding DNA Sequence Number=SeqID_41936
  Gene Ontology: Mol. function=chalcone isomerase activity; Biological process=flavonoid biosynthetic process
  Homolog annotation: Hit_ID=Q53B73; Match level="QueryCoverage=83%, HitCoverage=74%, E-value=9e-85, Identity=81%"; Hit description =Putative chalcone isomerase 3
  Pfam annotation: Domain name=Chalcone; Domain location=41-226; Score =1.2; E_value=3.7e-05; Accession=PF02431.6; Description=Chalcone -flavanone isomerase
MNHERSYSFSFSIAPIFKVVMVPILDFTWAKAYHLARAVNAEYVEEPATNVKFQTSLSFPGCSNSLTLFGTDQSIALELNAWKGQSKEAIQGNSSLFETIFQSSFEKSLQIILVRDVDGKTFWDALSDAISPRIQQPTTTDETALTTFRGVFLDRPLKKGAIIILTWLNPSGLLVSVSSNGLPSTMDATIESANVASALFNVFLGDSPVSPSLKASVAESLSKVLK

SEQ ID NO: 133622 - protein, 564 aa, Glycine max
  Coding DNA Sequence Number=SeqID_41937
  Gene Ontology: Mol. function=protein binding; Biological process =response to stress
  Homolog annotation: Hit_ID=Q9LUC4; Match level="QueryCoverage=73%, HitCoverage=90%, E-value=5e-30, Identity=28%"; Hit description=F -box/LRR-repeat protein At3g14710
  Pfam annotation: Domain name=F-box; Domain location=21-68; Score =24.6; E_value=0.00035; Accession=PF00646.24; Description=F-box domain
  Pfam annotation: Domain name=FBD; Domain location=374-423; Score =57.8; E_value=3.8e-14; Accession=PF08387.1; Description=FBD
  Pfam module annotation: Pfam domain module=F-box::FBD; Domain location=21-68::374-423
MDSNAATMHGTTKQLKYGAKDIISQIHDSILGHILSFLPTMEAVQTSVLSTRWIDVWTSITNLKLNDGVLICSGKKMQKEQYEYFVNTMLLHLANLSIQSFSLCLTCFHYESSQVSAWISSILERGVQRLEIQYANKIFFPSHTLFSCNSLVQLVLQMRCTLSVPIFACLPNLQTLGLSGIKLVSDHESSTYSKDLVLSFPILKVFEAKGCEWSTKQNLCIQVPLLERFSIAMWNSLSNESCKSSIKIFSPHLTDFSYKGDLEQEIILLNTLLIRTASVVIVIDEDRKESMRRLGFQVHKLLTQICEVEQLKLLLYKVLVHAADIFTHLPVFGKLTYLLLNEVTGEALLNLLHNSPMLNTLILQNGVFDLNEDMLTSASVPQCFLSSLKVFQFKGFNVHEHELLLAKFVMANATVLERMTLSTAFWLQYSDIDMEKTMSIHSEARIFCFGQCTNIGYVSDIDTLGYALNTYLTHFSNEGDLEREITSIKFTLLSGKALQRDGSACTMVYSPVLAGQRLLYHNFTKYELYKRAITFMINESRKQNNRSLKQVINDQVVMKVRYLS

SEQ ID NO: 133623 - protein, 103 aa, Glycine max
  Coding DNA Sequence Number=SeqID_41938
METLRFESRSLMKHRSQTKICCRSHHRLWLDRWQSHGWLWRTSGVVGTKVVQATRQCQGWAQVVHDDASKGCVDVVEGTRVQEFGGKRVVRAIKFGGGSGMQH

SEQ ID NO: 133624 - protein, 480 aa, Glycine max
  Coding DNA Sequence Number=SeqID_41939
  Gene Ontology: Mol. function=oxidoreductase activity; Cellular component=endoplasmic reticulum; Biological process=electron transport
  Homolog annotation: Hit_ID=Q2MJ18; Match level="QueryCoverage=96%, HitCoverage=96%, E-value=0.0, Identity=66%"; Hit description =Cytochrome P450 monooxygenase CYP72A59
  Pfam annotation: Domain name=p450; Domain location=63-475; Score =192.5; E_value=1e-54; Accession=PF00067.13; Description=Cytochrome P450
MEAAWITILVLILILSLIGAWKLLNWLWLTPKRLERLLREQGLQGNPYTLLVGDSMEVIKIRKEALSKPITLFSHDIVPRVSSYAQHTLNKHGKNSFIWFGPIPRVTLTDPELIKEVLNKIYDFGKLKLNPHVKLLVPGLARLEREKWSKHRKIINPAFNLDKLKANGSSEINVWPFLQNLASDAISRTAFGSSYEEGRRIFQLLKEQTELTMKIILKVYIPGWRFVPTTTHRRIKEIDRVIKALLMDMINKREKALKADEATKNNLLDILLESNHKEIQEHKNNKNVGLNLEEVIQECKLFYFAGQETTSVLLVWTMILLSRYPDWQTRAREEVLKVTMILYEVLRLYPPAIGLVRKVNKDVKLGNLSLPAGVQISLPIVLVHHDCELWGDDAKEFKPERFSEGLLKATNGRFSFFAFGGGPRICIGQNFSFLEAKIALSMILQRFLFGLSPTYTHAPTTVITLQPQYGAHLILRKVEI

SEQ ID NO: 133625 - protein, 470 aa, Glycine max
  Coding DNA Sequence Number=SeqID_41940
  Gene Ontology: Mol. function=DNA binding; Cellular component=nucleus
  Homolog annotation: Hit_ID=A7R4S0; Match level="QueryCoverage=99%, HitCoverage=96%, E-value=1e-111, Identity=49%"; Hit description =Chromosome undetermined scaffold_764, whole genome shotgun sequence
  Pfam annotation: Domain name=Bromodomain; Domain location=268-351; Score=46.5; E_value=9.7e-11; Accession=PF00439.16; Description =Bromodomain
  Pfam annotation: Domain name=Myb_DNA-binding; Domain location=1-54; Score=18.6; E_value=0.024; Accession=PF00249.22; Description=Myb -like DNA-binding domain
  Pfam module annotation: Pfam domain module=Bromodomain::Myb_DNA -binding; Domain location=268-351::1-54
MGRWGTWEELLLGGAVLRYGARNWKVVAAELRARTVCPYIITPEVCKAKYEDLQKRYSGNKAWFEELRKTRVAELKRALEVSEDSIGSLESKLESLKAGKNEKKDDRYVDKGSARPKLHVASQKLERVESSTKETSKDGLSAGSFTHETRTNWSPECPVPARSVEDMETKPEVSHSTEQAKVLNVDNRAHTIYEGQGGSLKKRRGKRKRKDCGRNMKEASVGESDLLDSADIVSWCKESSTSNCGEVAKSCGVDDQNRNLKKDRVEDMMEILDFIFETKGAPAFRRRLDSQKRGRYKKMIRQHMDFDTIRSRISSQTIKSSVELFRDLLLLTNNALVFYSKSTREYKTVLLLRGIVTKKMKETLKGTTSNKVTTQATNVPIKLPVHNPHVKPRSVRPGNRKIVAKAVGGNNSASGVSHGTKKPSKVESPSSVESLTVKKKGFGRPKKVGRGAAGQRPAMPMKGKKRVRTK

SEQ ID NO: 133626 - protein, 110 aa, Glycine max
  Coding DNA Sequence Number=SeqID_41941
  Gene Ontology: Mol. function=oxidoreductase activity
  Homolog annotation: Hit_ID=A7QQH3; Match level="QueryCoverage=34%, HitCoverage=12%, E-value=5e-10, Identity=67%"; Hit description =Chromosome undetermined scaffold_143, whole genome shotgun sequence
MKTLAMEETIKNLSGTSLLVSSVQELAKQNLSSVPQRYIQPQNEDIVTMRMNYYPPCPQPEKVFGLTSHSDAASEVEGLQIRKDGMPSESISTTCPATTPSVLIDFTNSP

SEQ ID NO: 133627 - protein, 153 aa, Glycine max
  Coding DNA Sequence Number=SeqID_41942
  Homolog annotation: Hit_ID=A7QTZ0; Match level="QueryCoverage=41%, HitCoverage=31%, E-value=3e-07, Identity=40%"; Hit description =Chromosome undetermined scaffold_174, whole genome shotgun sequence
MRACQLMIPLDVIHQMPGWVALAFGTLVTTFHGQENSDAEEGLPIFFTPFAEEDDVVKVNREFKVTFSAASICVQGTNWNLAEKDSQSGRRLIAASGSDDYLRITKTPINGLTVALLVVSVRMGRFCWPWMLGNNRSYCVKVKVPGQKYNWVK

SEQ ID NO: 133628 - protein, 488 aa, Glycine max
  Coding DNA Sequence Number=SeqID_41943
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=A7P284; Match level="QueryCoverage=97%, HitCoverage=52%, E-value=0.0, Identity=67%"; Hit description =Chromosome chr19 scaffold_4, whole genome shotgun sequence
  Pfam annotation: Domain name=Trehalose_PPase; Domain location=154 -403; Score=262.0; E_value=1.3e-75; Accession=PF02358.7; Description =Trehalose-phosphatase
MEAIFLNKLKSHIHHIYNQKYALTAFTGRYVYILPVSYSDVALVTSLRDGMNLFAGAAQSLGAGAILVNPWNITEVATAIAKALNMPSAEREKRHKHNYEHVKTHTAQEWAETFVSELNDTVVEAQIRTKQVPPRLPTETAVERYLQSNNRLLILGFNGTLTEPVEREGDRFKERELTVHPELKLPLAELCSDPKTTVVVLSGSGRAVLDENFKEYDIWLAAENGMFLNPSKGEWMTTMPEQLNMEWVDSVKHVFDYFTDRTPRSYFEEREASLVWSYRHADAEFGRLQARDMLQHLWTGPISNASVDVVQGSRSVEVRAANVTKGAAIDRILGEIVHSKFMTTPIDYVLCIGHFLTKLQQDEDIYAFFEPELPSIGVGLQRSKGTEGVKFPVERVSSLKNPASRNGAAKSSSQKKGQRPVSNNEKKRNNHVCRGPRRLAPEKISWNVLDLKKENYFSCAVGRTQTNARYTLGSPDEVVAFLKELANV

SEQ ID NO: 133629 - protein, 303 aa, Glycine max
  Coding DNA Sequence Number=SeqID_41944
  Gene Ontology: Mol. function=metal ion binding; Cellular component =intracellular; Biological process=regulation of transcription
  Homolog annotation: Hit_ID=A7P279; Match level="QueryCoverage=80%, HitCoverage=72%, E-value=2e-50, Identity=47%"; Hit description =Chromosome chr19 scaffold_4, whole genome shotgun sequence
  Pfam annotation: Domain name=zf-B_box; Domain location=38-76; Score =30.4; E_value=6.5e-06; Accession=PF00643.15; Description=B-box zinc finger
  Subcellular localization annotation: CTP_CleavageSite=21; ConfidenceScore=5.09e-01
MLPQPPSLPPLLLLPSLPLTSSSLPLSPISPLPLLFIREALGYFFCLEDRALLCRKCDVAIHTANAYVSGHQRFLLTGVRVGLEAIDPGASLTSLKSDSGEKVSDTKSSSVSRKVSTVPQPSNYNEVLPIEVGGVGEFPPAKVSFGGGSTDGNISQWTIDEFIGLNEFSQHYDYMEGSSRSSDSSFVRDCRLYGSAPSLMHTHTHTHIPEKGQADGGKLGDSDSPVLKSGEEDMEEEDDYLERVPDSSWTVPQIPSPPTASGLCWPKDPQYSSDSVLFVPDISFSLIQQSQISSICLRRWRQL

SEQ ID NO: 133630 - protein, 270 aa, Glycine max
  Coding DNA Sequence Number=SeqID_41945
  Gene Ontology: Mol. function=kinase activity; Biological process =protein amino acid phosphorylation
  Homolog annotation: Hit_ID=A5B4N1; Match level="QueryCoverage=68%, HitCoverage=21%, E-value=4e-54, Identity=57%"; Hit description =Putative uncharacterized protein
MNPRNNSHANRSKTQQSFNSFHINCGGERELSSEGIVYDPDLDPSGAATSKIMGSNWAFSNTGHFLDAQKPVSETYIQQQNKTGLSKLYQTARVSPISLTYYGFCLENGDYTVLLHFAEIMFTDDNTYSSLGRRIFDVYIQGVQVMKDFNIANEAGGVGKNITRSFPAHVRNNSLIIRFYWAGKGTTAIPYGPLISAISVTHVSNDTNLLLLCNTCTETVSTTTSGSMSTGVIVGIVVAAIVLVILIVLGWRIYIGKRNSFGKGGFSRIK

SEQ ID NO: 133631 - protein, 32 aa, Glycine max
  Coding DNA Sequence Number=SeqID_41946
MADIKQPWEIDNMLIPHGEQSNYSNTRITSIK

SEQ ID NO: 133632 - protein, 331 aa, Glycine max
  Coding DNA Sequence Number=SeqID_41947
  Gene Ontology: Mol. function=transcription regulator activity; Cellular component=cytoplasm; Biological process=regulation of transcription, DNA-dependent
  Homolog annotation: Hit_ID=A9PB38; Match level="QueryCoverage=98%, HitCoverage=100%, E-value=1e-109, Identity=61%"; Hit description =Putative uncharacterized protein
  Pfam annotation: Domain name=DUF822; Domain location=2-146; Score =296.4; E_value=5.5e-86; Accession=PF05687.4; Description=Plant protein of unknown function (DUF822)
MTSGTRLPTSKERENNKRRERRRRAIAAKIFAGLRMYGNFKLPKHCDNNEVLKALCNEAGWTVEPDGTTYRKGCKPLERMDIVGGSSAASPCSSYHPSPCASYNPSPGSSSFPSPSSSPYTQIPNADGNSLIPWLKNLSTASSSASSPKLPHLYLHSGSISAPVTPPLSSPTSRTPRINVEWDEQSARPGWTRQQHYSFLPSSSPPSPGRQVVDPEWFAGIKLPHVSPTSPTFSLVSSNPFAFKEDGLPGSGSRMWTPAQSGTCSPAIPPGSDQNADIPMSEAVSDEFAFGSNTLGLVKPWEGERIHEEFGSDDLELTLGNSKTRYSTIIT

SEQ ID NO: 133633 - protein, 285 aa, Glycine max
  Coding DNA Sequence Number=SeqID_41948
  Homolog annotation: Hit_ID=A7P228; Match level="QueryCoverage=52%, HitCoverage=49%, E-value=2e-12, Identity=31%"; Hit description =Chromosome chr19 scaffold_4, whole genome shotgun sequence
  Subcellular localization annotation: CTP_CleavageSite=70; ConfidenceScore=5.71e-01
FLTAPSMGIFSTLFSRRTLSLSLLKIPSRPTSSQPAPTPTPTPTLAGPTKKPLHVLFTQALGLSQKPTPSDEEEEEEEETASETLTELKNNLKQLEQEIKTFKDSTKDVTLKSEKKKQKMSLFAVFTNKQREPKPKEESLAAAKKLSPDVAVFVQYLFKKGYFNDANFAKGRKNFNPDWFSNVFALGYIKFAANKFARDHREIANSNCNDKNINGGSGSNNSGGAYGGNVVGGGGCGDRSNINGDCSDVSDVGSNGDDIDVDESDTDDDSGSGNDTGDDDDDNLL

SEQ ID NO: 133634 - protein, 266 aa, Glycine max
  Coding DNA Sequence Number=SeqID_41949
  Gene Ontology: Mol. function=sequence-specific DNA binding; Cellular component=nucleus; Biological process=regulation of transcription, DNA-dependent
  Homolog annotation: Hit_ID=B0LUS2; Match level="QueryCoverage=81%, HitCoverage=71%, E-value=4e-37, Identity=42%"; Hit description =Transcription factor
  Pfam annotation: Domain name=WRKY; Domain location=131-189; Score =78.2; E_value=2.7e-20; Accession=PF03106.6; Description=WRKY DNA -binding domain
MENQPSNGKRAMEEELIKGCETANQLLEVLVHKSNTTHEDVELEGSVQPLVEDLVRKVLCSFTNTLLLLNTNNINDVSKYTIKDAPSSVKCPETQGTDEACKSFFHAEKRRGCYKRKSSAPTWETNSSILLEDGYAWRKYGQKITLNAKYLRCTHKYDQGCPATKQVQRTQEDPPLYRTTYYGHHNCKSSLSPEIMMEPAFSSGSSMILSFTSTLTSKEGYPFSSSLSSSTKLEPMEVIQDDHIVQNQLSSSDYLLLSDYGLDFNY

SEQ ID NO: 133635 - protein, 76 aa, Glycine max
  Coding DNA Sequence Number=SeqID_41950
  Homolog annotation: Hit_ID=A7QDG2; Match level="QueryCoverage=61%, HitCoverage=41%, E-value=2e-08, Identity=63%"; Hit description =Chromosome chr10 scaffold_81, whole genome shotgun sequence
MLIWDALRAAAEADLTLAQAIVDSAGVIVQSSDLTVCYDERGAKYELPKIEMQGYKKLPRWTLIIRLVKQVKDHSF

SEQ ID NO: 133636 - protein, 629 aa, Glycine max
  Coding DNA Sequence Number=SeqID_41951
  Homolog annotation: Hit_ID=A7P223; Match level="QueryCoverage=70%, HitCoverage=89%, E-value=1e-166, Identity=67%"; Hit description =Chromosome chr19 scaffold_4, whole genome shotgun sequence
  Pfam annotation: Domain name=NHL; Domain location=262-289; Score =35.3; E_value=2.3e-07; Accession=PF01436.12; Description=NHL repeat
MASKSDAEIPSPIKRNNVEELVEGNGGHGGAVGMGSRGGMDGGGGIGSGVSMGDEVGMGGGGDIGNEVSMSREVDMSIVDMIDYESPVVKHLNTRDGLSLCGSDFVRDFTKIVKISSGLLEYLTAQSLKKVIDGGGQGVDDNDEREKVKGGLAGAVDCGGLGWNENHGRQPLELYLASGVSCDGNVLQFENGYVVETVVEGNEIGVVPYRIRVSEEDGELFAVDAINSNIVRITPPLSQCMVARPLEGYTGHVDGKPSDARFNHPKGITVDDKGNVYVADTQNLAIRKIGDAGVTTIAGGKSNVAGYRDGPSEDAKFSNDFDVVYVRPTCSLLVIDRGNAALRQISLDQEDCDYQSNSISSTDILTVVGAVIVGYATCMLQQGFGSSFFSKTQQPSQKQFKGLASNEKHMPILESSKEEPGWPSFGQLIVDLSKLSLEALASTFIQFIPSHFRPSNSKRGLTPLKDRLVMPEDDVPPPLVNRQNAQGHTPLTENRMASQVHTPLTENRMASQVHTPTIAEKYSEMKPPKIKSSSFKDPSMSSKHRSSRRPEYAEFYGSSEIPPYTKSKSQKERPRHRQREKSGEVVMGAVGAEAKPVETRAVDHNNPKFDHYSMRTKYASEETFRFNSQ

SEQ ID NO: 133637 - protein, 390 aa, Glycine max
  Coding DNA Sequence Number=SeqID_41952
  Gene Ontology: Mol. function=inositol or phosphatidylinositol phosphatase activity; Cellular component=ribosome; Biological process=sulfur metabolic process
  Homolog annotation: Hit_ID=A7R1U1; Match level="QueryCoverage=95%, HitCoverage=94%, E-value=1e-166, Identity=77%"; Hit description =Chromosome undetermined scaffold_377, whole genome shotgun sequence
  Pfam annotation: Domain name=Inositol_P; Domain location=63-388; Score=148.7; E_value=1.6e-41; Accession=PF00459.16; Description =Inositol monophosphatase family
MEDEHKKLDSLPEFGLSEPEKYSKELEVAVRAVQMACSLCQRVQDTLISNARTNHRQVQSKDDNSPVTVADWSVQAIVSWMLSECLGSQNVSIVAEEDAQTLSEANASELLEAVVETVNQCLAEAPRFGVQEPKSPLGTSDVLEIISRCNSTGGPTGRFWVLDPVDGTLGFVRGDQYAVALALIEDGEVKLGVLGCPNYPMRKEWLSYHHRYHRIISKLTRPASETWNKGCVLYAKKGSEKAWMQPLLHVNKMFVWPNHAKQVSVSSIDNPALATFCEPVEKANSSHSFTAGLAHSVGLRKQPLRVYSMVKYAAIARGDAEVFMKFARAGYKEKIWDHAAGVIIIQEAGGMVTDAGGLPLDFSKGLYLEGLDRGIVACSGATLHAKIIDA

SEQ ID NO: 133638 - protein, 574 aa, Glycine max
  Coding DNA Sequence Number=SeqID_41953
  Gene Ontology: Mol. function=nucleic acid binding; Cellular component= heterogeneous nuclear ribonucleoprotein complex; Biological process =regulation of transcription, DNA-dependent
  Homolog annotation: Hit_ID=A7QYI0; Match level="QueryCoverage=56%, HitCoverage=77%, E-value=1e-116, Identity=58%"; Hit description =Chromosome undetermined scaffold_247, whole genome shotgun sequence
MASNKRHFAEKDDDPHSLSKKAKESESESESESVASPSSLQVLLNPADCDLEGFAYYWSGARAKVGITRGRYCFACKVVSAQTVNMEDTAPEQQHICCLGISRGDNAFGVGDTIVCCVDLESKPLASIGFSKTGKLLGAATQFDVARLGVADSSPGNLQWTSALFPHVLLKNVVVQMQFSVEDGLGRNIVIGPSFSEPRDCEVIMMVGLPASGKTTWAEKWVKDHPEKRYVLLGTNSILDQMKFLLKVNVTLVPGLLWRNNYGERFDLLMDRATRIFNVLLSRAANIPRNYIIDQTNVYKSARKPKLEPFADYQKFAVVVFPKPEELKIRYDKRFTEMGKEVPPDAVNKMIVRFGSGSGLHLPGSYSPITLPIYGTPGQVSQVNANDHVTELNGSMNSFSGVYPGSQIPHVARAPTSCEPYSNKESSCFARDIAGYNQTYGAILTGDIRNYNNSVVGGPYRPNIVENNMVSRDAFPDAYMSGMNEPSPIASARAISFDFSTCKEPYPGAYRSGMNESSPVARARAMSFDYPREVSSHFYRDSLSPYGTPTTRPTYGSSPINTPYSGRYASQRPR

SEQ ID NO: 133639 - protein, 401 aa, Glycine max
  Coding DNA Sequence Number=SeqID_41954
  Homolog annotation: Hit_ID=Q2HTY2; Match level="QueryCoverage=62%, HitCoverage=90%, E-value=3e-54, Identity=50%"; Hit description =Putative uncharacterized protein
  Pfam annotation: Domain name=Brevenin; Domain location=62-108; Score =9.4; E_value=0.017; Accession=PF03032.6; Description=Breveninesculent ingaegurinrugosin family
MEEESEFLLETKLIINSLCTETLSLLSVHSSQPLFSCIVTFCFLILLYLPHLFWKIVFSPVLFLSGVLLLLLLRLGAIQRSQNEEKKNPVEPEPIANEENRGNREEKQGNPIEPVETDSQDHVYRWITSQSQTTIKSQMGFQSSSRFDESFVEWNVKAPLEVIYEGEETEQNQNEKRDEGILRHPSLSRYYPETDSDSSSESGFPATENWDSPENMCFRWDEEDREGLIEIALDGCKKREVGFHFDEENLIEIDISPTRHREFSGEDDPFSDANSGVVVVRSGWDDDVGGKDDNRDNDSSANSDDRDDGSSNNAKSSDKMGYTLRFWISRKRTHCCCQLSVMRCMGIVNMKESLAIRWKPPSRLTLMPRRRRILARVRVSSIVIQRATSASSSKIKEGSGC

SEQ ID NO: 133640 - protein, 476 aa, Glycine max
  Coding DNA Sequence Number=SeqID_41955
  Homolog annotation: Hit_ID=Q2HVJ6; Match level="QueryCoverage=94%, HitCoverage=89%, E-value=8e-87, Identity=39%"; Hit description =Cyclin-like F-box
MAKRARSDSLALSSVSSVSLLPRIFEELPLEILLHVFSFLPIKVAAQNCTQGSKFRNCKQFNRKFIFGRELAMRRNRESVAKLVDHLFDTHKGDLIDSFQLHIDPVEIEELLDKWLRICVEKKIQDLELYFLRPGYTLTEDFLNQLKNLSSLKLVHCEFELPLKLQSLTNLRSLILWHVPLRNERLQTLIVRCRMLQTIDLLHCAELSRVEIYAAEHRYFKMLRIAGCNNLSMVEVVSPTLRCVHYCGHVPSTITFQAPQLSEALFNFVPAGNRRYLRASVLEKLVCDISNVTVLSASVLIPEALTAKIHHGVFGEICYNFLNLRELHLIMNGGLFCNPYDIIMLMKRCPILEKLFIDIDDYNFECGPYWELHQKPKLDKLDHYFDRLKYIKLKGFKFLQSELQLVKILLSKATHLEALILVTPKNGRIKLWRADGPKYSHLFDSWKASPEVKIVLFEHTADRSLVRPSHSKDWLL

SEQ ID NO: 133641 - protein, 141 aa, Glycine max
  Coding DNA Sequence Number=SeqID_41956
  Subcellular localization annotation: CTP_CleavageSite=22; ConfidenceScore=5.15e-01
MAFGGSGKGSRKGGSCVGSSSSSMMRRNTLELKQIPLSQHVANSSGDNCLKGTNDDLACGDTKGDDRLEHGMVVLKLLLGQSSQAYDLNQCQRLEHLNLLTNLKGRARDKATQEKRGWKSNDMIRERFKLGKVVIDRTMLG

SEQ ID NO: 133642 - protein, 268 aa, Glycine max
  Coding DNA Sequence Number=SeqID_41957
  Gene Ontology: Mol. function=DNA binding; Cellular component=nucleus; Biological process=regulation of transcription, DNA-dependent
  Homolog annotation: Hit_ID=Q0GPF4; Match level="QueryCoverage=83%, HitCoverage=100%, E-value=1e-128, Identity=100%"; Hit description =BZIP transcription factor bZIP132
MRQVETLRESHVNMHAPSPQPLSVLFINPHSYITISNGQKRATMNNPSSPSPCAAFADFYEQWFEELQSLMQQLRGEGRKEEVMEKVMWHHQNYYVAKSAAAEKDPLNVFLSPWATTLERSLHWITGWRPTTAFHLIYTESSLMFESHIIDILQGLRTGDLGDLSPSQFRRVSDIQCDTVKEENAITEELSEWQDSVSEMMGPGANINDKIGRLVCIIKKADDLRLRTLRSVVGLLSPQQAIEFLIASAELLVGIRGWGLNHDRPRGR

SEQ ID NO: 133643 - protein, 705 aa, Glycine max
  Coding DNA Sequence Number=SeqID_41958
  Homolog annotation: Hit_ID=A5AJA0; Match level="QueryCoverage=73%, HitCoverage=57%, E-value=5e-33, Identity=36%"; Hit description =Putative uncharacterized protein
  Pfam annotation: Domain name=zf-XS; Domain location=293-333; Score =2.4; E_value=0.11; Accession=PF03470.5; Description=XS zinc finger domain
  Pfam annotation: Domain name=zf-XS; Domain location=547-587; Score =9.1; E_value=0.016; Accession=PF03470.5; Description=XS zinc finger domain
  Pfam module annotation: Pfam domain module=zf-XS::zf-XS; Domain location=293-333::547-587
MEGTRRRGGGRAIERKVGGAWRLWFERRRSNVEAIIGLYEEGGMFPPQSTAASNEKIHKVKLNFMRERERERDEEKPVNGSSHWVGGEQRKKVIPMWSFVSLSLRLSFSGVPTIKIVSLSQYPSNTYSPLGMEPTGPDSFVKKGENSAEKVSELSLEKGEEVAKASHESLVSDAKWVCESPKAGVSSTASGWPSFNDIKAPPLTYSLSAEEKATVAVLQLQHKALEACQKFLVGDAGSDGDEDDKDDEDEDELVDDYDSKECEEYKFFEKVFAEDGDLRRYYESNHKEGDFHCLVCGGIGKKVWKRFKNCKTLIHHSTAILRTKRKRAHRAYAQVICKVVGWDIDQLPAIVLKDLDSSLTGSRKLLGCEKESVSLDGKVLEPSSENGGEIVKRKLPRFTGVDGTLWQSYKNVIFGAPSKAEESHESLVSEWESESPKAGFSSTASGWPSFDDIKSSSLTYSLSAEEKATVAVLQLQHRALEACQKFLVGDAGSDSDEDDEEAEDEDELVDNDSEESEEYKFFEKVFAEDGDLRRYYENNHKEGDFYCLVCGGIGKKVWKRFKDCIGLIQHSTAILRTRRKRAHRAYAQVICKVVGWDIDQMPAIVLKDLDSSLAGSRKLFVEPKNPAAGCTDDTNSNDVLQESVANVNSTLLIWFVGRLMYLLMMWRLVSCDRVYILCPVNFSPALADSFVNPSIASLAHPKFDG

SEQ ID NO: 133644 - protein, 90 aa, Glycine max
  Coding DNA Sequence Number=SeqID_41959
MEGLDQPKRSIASCTLYILNKIEFPKIPWNALFPLFYLIFYPDFVWSSRAPPTLFKGYWCNGEERVDDDLQNARTTTFAIVHASTTNNRH

SEQ ID NO: 133645 - protein, 80 aa, Glycine max
  Coding DNA Sequence Number=SeqID_41960
MNWGACKFRMSRTLKPQFVRYGHLRAFETQHHGCQIQQYISHEREEILGLWEKEEVMKFRPGIAVQFFVPHCASATGAKC

SEQ ID NO: 133646 - protein, 274 aa, Glycine max
  Coding DNA Sequence Number=SeqID_41961
  Gene Ontology: Mol. function=calcium ion binding; Cellular component =integral to membrane
  Homolog annotation: Hit_ID=A7P1W8; Match level="QueryCoverage=83%, HitCoverage=40%, E-value=3e-64, Identity=58%"; Hit description =Chromosome chr19 scaffold_4, whole genome shotgun sequence
  Pfam annotation: Domain name=Na_Ca_ex; Domain location=87-251; Score =5.5; E_value=0.0041; Accession=PF01699.15; Description=Sodiumcalcium exchanger protein
MASSLTFHWFLFLILWILVLCSHAHARFFTVDPVSDGFAAASGSKWQSILRLPTALTGESVCEQTYGFLPCTTTVLGNLFLIIVYGFLMFKAATFLSGGSELLLEILGPGIVGGLFLPILGALPDAMLILGSKEVAQSQVSVGMGLLAGSTTLLLTIIWGTCVIVGKCDIEGSIAIDSRDTRGFSLTGSGVSTDIWTSYAARIMVISVLPFVIVQLPQILNSTSGRHLAVLIALIVSLGLLIAYCLYQVFLFFHQPAPLLFNSDDTHFLLLDVI

SEQ ID NO: 133647 - protein, 707 aa, Glycine max
  Coding DNA Sequence Number=SeqID_41962
  Gene Ontology: Mol. function=tRNA isopentenyltransferase activity; Cellular component=mitochondrion; Biological process=tRNA processing
  Homolog annotation: Hit_ID=A7P1Y2; Match level="QueryCoverage=49%, HitCoverage=82%, E-value=6e-87, Identity=54%"; Hit description =Chromosome chr19 scaffold_4, whole genome shotgun sequence
  Pfam annotation: Domain name=IPPT; Domain location=473-707; Score =25.3; E_value=1.5e-12; Accession=PF01715.8; Description=IPP transferase
  Pfam annotation: Domain name=S-antigen; Domain location=133-371; Score=-252.5; E_value=0.039; Accession=PF05756.2; Description=S -antigen protein
  Pfam module annotation: Pfam domain module=IPPT::S-antigen; Domain location=473-707::133-371
  Subcellular localization annotation: CTP_CleavageSite=65; ConfidenceScore=5.91e-01
MATQILSRIFPKTLAPFLSRSLSTAPSPPSLSALSFLRRISVAANPSLHRALLPNSPSLRALSTRATTSSLNDPNPNWSNRPPKETILLDGCDFEHWLVVMEKPEGDPTRDDIIDSYIKTLAKVIGSEEEARMKIYSVSTRHYFAFGALVSEELSYKIKELPGVRWVLPDSYLNVKEKDYGGEPFINGQAAPYDPKYHEEWVRNNARANERNRRNDRPRNADRSRNFERRRENVVNRDMQGRPPSPNPGPNVGGPPPSNAAGYPPSNAAGYPPSNAGYAPPSNTGGYPPSNAGYAPPSNAGGYPPSNAGYAPPSNAGYAPPNTAGYSSPNAAGGYPPNAGGGYGPGGGVPQNNYAGNMGGPPSNQNMGGFQQNSGWSNNAPSRDVPSRDMGGPPGGNPYSGETTIPRTSALVQLSAAVSGDCVGNEEEREGDCDFWTHRFRQEPPRIGTRKAPQRRNRQCRLRPVALLACIVPQVYRGLDVGSAKPSPNERKDARQATGCILDNGRVPIVVGGTGLYLRWFIYGKPDVPKASPEIVSEAYQELAELQRNDDWDTAVQLVVKAGDPKAQFLAVNDWYRLRRSLEIIKSSGSPPSAFRVPYDSFREQGEYGVADGSELSDMNTYGDAMEKTNSSELDYEFMCFFLSSHRLDLYKSIDYRCEDMLLGRDGILSEAQWLLDTGLHPNSNSATKAIGYRQQEVLYALRNIFG

SEQ ID NO: 133648 - protein, 197 aa, Glycine max
  Coding DNA Sequence Number=SeqID_41963
  Gene Ontology: Mol. function=calcium ion binding; Cellular component =integral to membrane
  Homolog annotation: Hit_ID=A7P1W7; Match level="QueryCoverage=60%, HitCoverage=17%, E-value=2e-48, Identity=75%"; Hit description =Chromosome chr19 scaffold_4, whole genome shotgun sequence
MIRNVSKTPYFIFLLVLVTVEVQGRYLPERATELVSDGVHNNLQHNETSYLVLKGIDDESFEEPCKQMYGFLPCTNNIFGHLFLILVYEYLLFHGESYLAKGGEQIFKILGPGIFGASAFQILGALPESLILLVSGLVSNREIAQEYAFSGVGLLAGSSILLLTVVWGSCVIAGSQEFEHDSPTSNSAHTSLKALLT

SEQ ID NO: 133649 - protein, 685 aa, Glycine max
  Coding DNA Sequence Number=SeqID_41964
  Gene Ontology: Mol. function=kinase activity; Cellular component =mitochondrion; Biological process=protein amino acid phosphorylation
  Homolog annotation: Hit_ID=Q2HTV1; Match level="QueryCoverage=91%, HitCoverage=99%, E-value=0.0, Identity=79%"; Hit description=Protein kinase-like
  Pfam annotation: Domain name=ABC1; Domain location=330-456; Score =133.3; E_value=7.1e-37; Accession=PF03109.7; Description=ABC1 family
MRGNTGKVGMNWDSKKSGTYSGTYYKLDQLSFRLVDASWRNGRCVHSFDIVIGLHFCRYLMLRNIRRAAQSVCRINSRYLEVSKNGPVVSVGPNIHHCRLYMQYKFPSEACSSFLWHGTREGFRKRGSFRNFSVTSASNTVTHHSQIAWKRLYRKYCSSGDGTFPPTVNMIAQAVSLALARSYLLVPGILAFTCGELALAQQNWADAERYPSQNGLYMRAQDGYNYMFTFAFIIVEGLILLMRALYLAILFSPSIVMAPFADCFGPNFRKLWLHVVHRTLEKSGPAFIKWGQWAATRPDLFPRDLCTKLSELHTKAPEHSFCYTKKTIERAFGRKISEIFDNFEELPVASGSIAQVHRASLKCRYPGQQAKPLLVAVKVRHPGVGESIRRDFAIINLAAKISKFIPALNWLRLDESVQQFAVFMMSQVDLAREAAHLSRFIYNFRRWKDVSFPKPVYPLVHPAVLVETYEKGESVSYYVDDLQGHERVKSALAHIGTHALLKMLLVDNFIHADMHPGNILVRVSQNKSRKRLFKSKPHVVFLDVGMTAELSGSDRVNLLEFFKAVARRDGRTAAECALNLSNQQNCPNPEAFIEEVEESFTFWGTPEGDIVHPAECMEQLLEKVRRHRVNIDGNVCTVMVTTLVLEGWQRKLDPGYNVMQTLQTLLLRADWAKSLSYTIDGLMAP

SEQ ID NO: 133650 - protein, 319 aa, Glycine max
  Coding DNA Sequence Number=SeqID_41965
  Gene Ontology: Mol. function=structural molecule activity; Biological process=response to gibberellin stimulus
  Homolog annotation: Hit_ID=Q2HTV7; Match level="QueryCoverage=52%, HitCoverage=62%, E-value=3e-57, Identity=68%"; Hit description=Major sperm protein
  Pfam annotation: Domain name=Motile_Sperm; Domain location=129-242; Score=23.4; E_value=0.00035; Accession=PF00635.17; Description=MSP (Major sperm protein) domain
MSLRYMSRVIYQGGMRMLQGMKEQLGSNKCDSTIKSLNLRDSSSKQNRFLSSGTSFKPPNNDNKLKQAEDSLRTVMKATPRRIEVKCSGAENKGERTFLTLEEAGLVEISGLSTHERFLCRLTISSLNLLRVISEQEGCPIEELNAAKICDWFLKDKLKREQNLGSAFQTNAPKSCFMRPPGGILAPGESIIATVFKFIEHPLNNEKPQKTGVKFKITSLKVKGPIDYVPEMFDELKDQVTVEQILQVVFLDPERSCPALEKLKLQLAEADAAVVEARKRAPEDAGPKILGEGLVIDEWKERRERYLAKQQGEVVVDSI

SEQ ID NO: 133651 - protein, 293 aa, Glycine max
  Coding DNA Sequence Number=SeqID_41966
  Gene Ontology: Mol. function=inositol or phosphatidylinositol phosphatase activity; Cellular component=mitochondrion; Biological process=sulfur metabolic process
  Homolog annotation: Hit_ID=A7R3G7; Match level="QueryCoverage=86%, HitCoverage=82%, E-value=5e-58, Identity=62%"; Hit description =Chromosome undetermined scaffold_521, whole genome shotgun sequence
  Pfam annotation: Domain name=Inositol_P; Domain location=38-292; Score=6.2; E_value=1.5e-06; Accession=PF00459.16; Description =Inositol monophosphatase family
  Subcellular localization annotation: CTP_CleavageSite=14; ConfidenceScore=5.25e-01
MAIDILRSPVSAVRFFNGAATRSRCCSSTFRFNQNAKHYKELEAAVDVVRRACRLCLNVKSSLFSTDEKVLEKNDQTPVTVADFGVQALISLELNKLFPSIPLVAEEDSAFLLSRNLADTVLNEVTDTLSSTCKPLTQDDVLEAIDRGGKDAFVFGSKPATYWVLNPIDGPHGFLKAGKALYVVGLALVVEGEIVVGVMGCPNWEEDLSEKSSTEIEEGWDSLGGSGTVWDHAVGIICVHEAGGKVTDWQGSDIDLAVGHVGRRIIFPYGGVLVTNSNLHDKILQIIDQTSRV

SEQ ID NO: 133652 - protein, 461 aa, Glycine max
  Coding DNA Sequence Number=SeqID_41967
  Gene Ontology: Mol. function=GTP binding; Cellular component =intracellular; Biological process=RNA-dependent DNA replication
  Homolog annotation: Hit_ID=A2WKR7; Match level="QueryCoverage=84%, HitCoverage=76%, E-value=1e-107, Identity=46%"; Hit description =Putative uncharacterized protein
  Pfam annotation: Domain name=PPR; Domain location=103-137; Score=7.1; E_value=1.1; Accession=PF01535.11; Description=PPR repeat
  Pfam annotation: Domain name=PPR; Domain location=138-172; Score =12.1; E_value=0.28; Accession=PF01535.11; Description=PPR repeat
  Pfam annotation: Domain name=PPR; Domain location=188-222; Score =27.5; E_value=4.8e-05; Accession=PF01535.11; Description=PPR repeat
  Pfam annotation: Domain name=PPR; Domain location=223-257; Score =32.9; E_value=1.2e-06; Accession=PF01535.11; Description=PPR repeat
  Pfam annotation: Domain name=PPR; Domain location=258-292; Score =43.6; E_value=6.8e-10; Accession=PF01535.11; Description=PPR repeat
  Pfam annotation: Domain name=PPR; Domain location=293-327; Score =21.6; E_value=0.003; Accession=PF01535.11; Description=PPR repeat
  Pfam annotation: Domain name=PPR; Domain location=362-396; Score =21.9; E_value=0.0024; Accession=PF01535.11; Description=PPR repeat
  Pfam annotation: Domain name=PPR; Domain location=397-431; Score =31.7; E_value=2.7e-06; Accession=PF01535.11; Description=PPR repeat
  Pfam module annotation: Pfam domain module=PPR::PPR::PPR::PPR::PPR::PP R::PPR::PPR; Domain location=103-137::138-172::188-222::223-257::258 -292::293-327::362-396::397-431
  Subcellular localization annotation: CTP_CleavageSite=35; ConfidenceScore=5.34e-01
MACNIRASTRLHQGIFQTFSNNVKTSTPRFVHSCPATFIQNLLKFRRDKPTEQLYRALDQCGFDLNHDLVLDVLRRHRSDWRPAHVFFNWASKTTTGYQPSSDVCNEIVDILGKMQRFQELHQVLDEMSKREELLDEAVFATLVRRFVGAHKVDEAIQLFYRRKEFGLELNSEAFRTLLMWLCRADIKMWNVILNGWCVLGNSHEAKRVWRDIVASPCKPDIFTYATFIKALTKKGKLGTALKLFRGMWDKGGKPDVVICNCIIDALCFKKRIPEALEIFCDMSERGCEPNVATYNSLIKYMCKIQRMKKVYELVDEMERKKGSCLPNAVTYCYLLKSLKEPGEVCRVLERMERNGCGMNDDVYNMVLRLYMKWDDGDGVRKTWEEMERNGWGPDRRSYTIMIHENFEKGRVKDAVRYLEEMISKGMVPERRTEKLVSSMNIRLKGRSEKQEDVDGGTTSL

SEQ ID NO: 133653 - protein, 188 aa, Glycine max
  Coding DNA Sequence Number=SeqID_41968
  Homolog annotation: Hit_ID=A7P1T1; Match level="QueryCoverage=73%, HitCoverage=62%, E-value=9e-46, Identity=62%"; Hit description =Chromosome chr19 scaffold_4, whole genome shotgun sequence
MKDIAVQLEKDNLPDKAKELEDAVIELVGLSELSVQFSSAVQAFANAYQPKEEFTNFNTLFEDELSRFKANQSSDVPKNPVVRQFKEAVWNVHHAGQPMPGEEQEDIVMTSIQSNILNITCPLSGKPVTELAEPVRSTNFSENSCWNDKFKHAKPTFWVDYGVDVNGLAWLKAEDTCKSMRKMPVSVL

SEQ ID NO: 133654 - protein, 85 aa, Glycine max
  Coding DNA Sequence Number=SeqID_41969
MVEALYTIMIHDRFEKVNGVRELRMEKLVNSMSIELKGESTKTRKNLRGVRSYNVGPIGKQIDNVSFNYVVQLSSLSFVGSWNHI

SEQ ID NO: 133655 - protein, 91 aa, Glycine max
  Coding DNA Sequence Number=SeqID_41970
  Homolog annotation: Hit_ID=Q9LDN6; Match level="QueryCoverage=40%, HitCoverage=5%, E-value=3e-07, Identity=72%"; Hit description=MAP kinase
MADVAGLVEASGSRFSSLELIGQGSFGDVYKAVNKKLRTPLPRGSSLCEGMGEGYCTQPYPCICKETVSGFEPMTNKSPRHNFTAAPELAL

SEQ ID NO: 133656 - protein, 150 aa, Glycine max
  Coding DNA Sequence Number=SeqID_41971
MKILMLHEVAEGSSEDGGDEVKQEDLAMSNDAARDGPIKAVEEADMVRDTAKESMDGAWIAAQEASHKGGDSIVGASAQGAVKATEVLENVGERAKETVDTALDAAKKTTEGVTETTTMVEADNNVVDTVEYRCTEDLRGQLGDGHDSYN

SEQ ID NO: 133657 - protein, 504 aa, Glycine max
  Coding DNA Sequence Number=SeqID_41972
  Gene Ontology: Mol. function=drug transporter activity; Cellular component=membrane; Biological process=multidrug transport
  Homolog annotation: Hit_ID=A7P1Q5; Match level="QueryCoverage=96%, HitCoverage=98%, E-value=1e-153, Identity=57%"; Hit description =Chromosome chr19 scaffold_4, whole genome shotgun sequence
  Pfam annotation: Domain name=MatE; Domain location=288-451; Score =139.4; E_value=1e-38; Accession=PF01554.9; Description=MatE
  Pfam annotation: Domain name=MatE; Domain location=67-227; Score =126.2; E_value=9.8e-35; Accession=PF01554.9; Description=MatE
  Pfam module annotation: Pfam domain module=MatE::MatE; Domain location=288-451::67-227
MENVEQIKEEIEKMVASSSSEGTGVPLLRASDNNGRDQNTRSPQAEGWWNKVLDMEEAKHQLLFSLPMILTNLFYHLIILVSVMLVGHLGELQLAGATLANSWFSVTGVAVMVGLSGALETLCGQGFGAKEYQMLGIYLQASCIISLIFSIIISIIWFYTEPILVLLHQSPDIARTAALYMKFLIPGVFAYSFLQNILRFLQTQSVVIPLVVLSALPMLVHIGVAYGLVQWSGLSFTGAPVAASISLWISLLLLALYVMYAKKFKQTWKGFSTHSFRYVFTNMRLALPSAAMVCLEYWAFEVLVFLAGLMPDSQITTSLIAICINTEFIAYMITYGLSAAASTRVSNELGAGNPERAKHAMSVTLKLSLLLGLCFVLALGFGHNIWIQFFSDSSTIKKEFASVTPLLAISILLDAIQGVLSGVSRGCGWQHLAAYINLATFYLIGLPISCFLGFKTNLQYKGLWIGLICGLLCQSGTLFLFIRRAKWTKLDLSRDNDKERPLVV

SEQ ID NO: 133658 - protein, 322 aa, Glycine max
  Coding DNA Sequence Number=SeqID_41973
  Gene Ontology: Mol. function=drug transporter activity; Cellular component=membrane; Biological process=multidrug transport
  Homolog annotation: Hit_ID=A7P1Q5; Match level="QueryCoverage=89%, HitCoverage=92%, E-value=3e-59, Identity=59%"; Hit description =Chromosome chr19 scaffold_4, whole genome shotgun sequence
  Pfam annotation: Domain name=MatE; Domain location=52-269; Score =92.4; E_value=1.4e-24; Accession=PF01554.9; Description=MatE
MLKSRSLDGTVTHFTPLLDVSHHKENTRQYRWWNSKILDLEEAKHQLLFSLPMFLTNLFYYLIVLVSVIFAGHLGDLQLAGATLANSWFSVTGLAVMLAGATLANSWFSVTGLAVMYWAFEIMVFLAGLLPDPTISTSLIAICTNTELIAYLITYGLSAAARVSNELGSGHLDRAKHAMGVSLKLSLLLGLCFVLALAFGHNIWIQMFSDSSKIKEELASLTPFLSISILLDSVQGVLSGVIRGCGWQHLAAYVNLATFYLIGLPISGLLGFKFNLQVKGLWIGLICGLACQTGTLSFLAWRAKWTKLNVSLDRDEIQPPSA

SEQ ID NO: 133659 - protein, 147 aa, Glycine max
  Coding DNA Sequence Number=SeqID_41974
  Homolog annotation: Hit_ID=A7P1Q3; Match level="QueryCoverage=51%, HitCoverage=18%, E-value=7e-22, Identity=62%"; Hit description =Chromosome chr19 scaffold_4, whole genome shotgun sequence
MTSSRERLVKAVKQFVEVRYKVFGDRYGQNIIDILDFPIKVVLSPFTLAFDIAGSAPRGFGVPELISKLSATSVFEMEIIKMSFSPFTIPPSMAVRLFQLNQCSRNRIRVLGMPAYTLRESFVAYSGLTVRARAGISHVEDGGYMWS

SEQ ID NO: 133660 - protein, 217 aa, Glycine max
  Coding DNA Sequence Number=SeqID_41975
MQIYIANYWSMKRIKKNDNITKFSWFGFFKLPRPCLRGPHAIISSSIQRIGNRLNDENALPGGGAAKHREEPHERNDAVNLLVRAPPNAEPQRYNLQRNRNKHNPSQHVNPHPQAFVDDKRQNPPTREQEPRRVRNAKHSKKNTTQKRVRAEHGLEAVAVVENHRGFSRHSVLERGKEYEQCLERRKGEAREEHGRDGPLVIIFRCLRFDRSIEKKQ

SEQ ID NO: 133661 - protein, 102 aa, Glycine max
  Coding DNA Sequence Number=SeqID_41976
  Subcellular localization annotation: CTP_CleavageSite=41; ConfidenceScore=5.56e-01
MATIWKTNAARNAVRSLTQSLPFTARTPSIPSHFSSVRYLRTVAIPVILVLVSMWLITCGNPINVTKHTCILPDFCFDNNPAVYIHINIKLVGLRYSSHIAC

SEQ ID NO: 133662 - protein, 460 aa, Glycine max
  Coding DNA Sequence Number=SeqID_41977
  Gene Ontology: Mol. function=oxidoreductase activity, acting on CH-OH group of donors; Cellular component=cytoplasm; Biological process =regulation of transcription, DNA-dependent
  Homolog annotation: Hit_ID=A7QET2; Match level="QueryCoverage=91%, HitCoverage=89%, E-value=1e-160, Identity=66%"; Hit description =Chromosome chr16 scaffold_86, whole genome shotgun sequence
  Pfam annotation: Domain name=DUF895; Domain location=33-185; Score= -18.2; E_value=1.8e-06; Accession=PF05978.7; Description=Eukaryotic protein of unknown function (DUF895)
  Pfam annotation: Domain name=MFS_1; Domain location=35-405; Score =20.4; E_value=0.004; Accession=PF07690.7; Description=Major Facilitator Superfamily
  Pfam module annotation: Pfam domain module=DUF895::MFS_1; Domain location=33-185::35-405
  Subcellular localization annotation: CTP_CleavageSite=59; ConfidenceScore=5.26e-01
MGTPGNDEPGTQTPQNTKSSPLFRYNSPFIQIVLIGLVCFCCPGMFNALSGMGGGGQVNATASNNALTALYTTFAIFGILGGGIYNILGPHLTLFAGCSTYVLYAGSFLYYNHYQHQFFAIVAGAILGVGAGLLWAAQGAIMTSYPPENRKGTYISIFWSIFNMGGVIGGLIPFILNYNRGDSAVTVNDGTYIGFMVFMAVGAVLSLTILPASKVVRDDGTRCTKMLYSNAATESVEILKLFYNWKMLLIIPAAWSSNFFYTYQFNHVNKPQFNLRTRGFNNVFYWGAQMVGSVGIGYVMDFSFRSRRKRGVVGIGVVALLASAIWGGALANQIKHDPGVILDFKDSGSRYAGPFVLYFSFGLLDAVFQSMVYWVIGALANDSEILSRYAGFYKGIQSAGAAVAWQIDNHNVSAMAQLIVNWVLTTVSYPLLLILVVLAVKEGDNRGEEEPVKEVAGFAH

SEQ ID NO: 133663 - protein, 435 aa, Glycine max
  Coding DNA Sequence Number=SeqID_41978
  Homolog annotation: Hit_ID=A7QES6; Match level="QueryCoverage=53%, HitCoverage=88%, E-value=6e-44, Identity=46%"; Hit description =Chromosome chr16 scaffold_86, whole genome shotgun sequence
  Subcellular localization annotation: CTP_CleavageSite=36; ConfidenceScore=5.45e-01
MSAFVLVKRRVIGSLGKQNKSGLGLRQKESSRSRLVAAAVKAPSHSLLTLSSDSGSSRGGGSWNEDKTDDEGFSPKSSRFLKVTKSTRKTPEAASPKVEEQTPSKRKKLDKKKAKGNKEEKEAVNESNIDKHIDHKESIHSIWTLSSDSESFHDHSPKRDHIDQVETSQHEISDEGECGDGLVFGNDGKFPSKKGSKEKSSQKQIHVEGHTPVKGKEIKASAKGKGSGDLKVEEEETCEKPAEPNVSSARLPLMLSEKVQRTKALIECQGDSIDLSGDMGAVGRIIISDSPSGDQEMCLDLKDRDILGGFGIYRKDLLKSQLALGSQRQSQVEAIMNDFIQLKPQSNLYEAETMVEGTLDGFFFDSDEEAGKMQKSTNQTDQNENVEEQANGKSKGKTDKTSGAGKKRGRSTGGKPQAKIAKKKTPGSKKAKTKK

SEQ ID NO: 133664 - protein, 65 aa, Glycine max
  Coding DNA Sequence Number=SeqID_41979
MVPEEIEIEIEILGAERKAFGNLGGVFSKTRKPRKTGAISGPVIFGGELRGKNEPEAQEKEIEVY

SEQ ID NO: 133665 - protein, 1014 aa, Glycine max
  Coding DNA Sequence Number=SeqID_41980
  Homolog annotation: Hit_ID=A7Q3C6; Match level="QueryCoverage=97%, HitCoverage=97%, E-value=0.0, Identity=45%"; Hit description =Chromosome chr13 scaffold_48, whole genome shotgun sequence
MEEAIDATATLDYASIQIFPNLKRYEAFVCKGKQSDKVAAGHLEHLLPHLPAINDLHAEGFDTNFDLKLPENLHGAEWFSKATVQRFLHFASSPDLIHAISSILDEMSQLEDSKEFHVSLYGKPEVNIVSSDASKNELLRAMDLRLTALSDKLAETFSKATGATCSPEDLTCLAKFSQHFGATNIEHSLCKFIELTQKSQDVAPLSKETTLHSCDVTKDDANEAVKNLQVSKPLPSDTPVKYGVSPAKAAQVERHSSTESEESSNSSDEDQRSAERSRSLVRSATPRRSASPMRRVQIGRAGPRRAAALTIKSLNYFPGRERITVQDAAENDFEGEVSELPNKKSEIDVKRITVQDAISLFESKQRDQTTDIQKRKSLADVSVSTNKSVLRRWSAGMGETSVQDQPEYVPEDPVPVTSNDVVHAEAPRNSEVGVVSDFISECHNNNEITDHDVKPERQENIGYVAVDNPDETNPTVKQETNKKLAASAEWNQRKQEEFNQILKKMVESKPVLFGKSQPSRNQNISFEQRGGSYDNYKEKRDAKLRGAKAGKQVEKEAQFRQMQRLLDKRKVEMSKSVSASKKSSPRLPQSSLRNSTPPANSPKETSKPSTMKKTSSRTSPMPATRKSWSATPSPRAAGTSPAKARGGISSANSTPTHRKPVSTSVPQPSTQREKSLPRNRNEKEPQTNNARSLKSMNEKRQPAVPNKSKAVKAKVTKASEEASVPSKTSIGNKGTKKSSVVPLESKPFLRKGSRMGHGTADLNKKKGPPKMDKSLRVSADLIEDQESELVVNASDLVSQHSDGDTMTPIHQNAATEPDPQIHNQLQCGETENLDQNPTDGEVLTYTGESSINIRNEEESTISPSAWLETEEDLEMPKPCEDDTFQSASLANAAPVGSASPRVRHSLSQMLQEESSEPDTCEWGNAENPPAMIYQKNAPKGEDDAEEFKNSNKRNADNLLRKAAQNVKSYGQPKNSVHEGYERNLGRDDGKGSHKMRDGRDLGAGSTTRGQSFTP

SEQ ID NO: 133666 - protein, 354 aa, Glycine max
  Coding DNA Sequence Number=SeqID_41981
  Gene Ontology: Mol. function=RNA polymerase II transcription factor activity; Cellular component=nucleus; Biological process=regulation of transcription from RNA polymerase II promoter
  Homolog annotation: Hit_ID=A7QFP8; Match level="QueryCoverage=88%, HitCoverage=85%, E-value=7e-98, Identity=58%"; Hit description =Chromosome chr8 scaffold_88, whole genome shotgun sequence
  Pfam annotation: Domain name=TFIIS_C; Domain location=314-352; Score =79.9; E_value=8.5e-21; Accession=PF01096.9; Description =Transcription factor S-II (TFIIS)
  Pfam annotation: Domain name=TFIIS_M; Domain location=182-303; Score =158.5; E_value=1.8e-44; Accession=PF07500.5; Description =Transcription factor S-II (TFIIS), cen
  Pfam module annotation: Pfam domain module=TFIIS_C::TFIIS_M; Domain location=314-352::182-303
MEFLLGFGSFPFPTKPDSVFMRENDKLLCVESVDPELVMVGKHLKVLTKHPRQKIKSFAIDLIEIWKGIIIKETSKNKNGGSDSKDESANREKSKAGKMQKSPSVKIEKGETVKVEKIERNGTSKSSFENMKKVQNDVKNERTDRAASVKMEKIAEEKPISGAKKMSSSSTAPPKLKTMIKSNDATRDKIREILHEALSKVTREADEDLVAVVNDSDPIRVAVTVESVLFEKWGPSNGAQKVKYRSLMFNLKDSNNPDFRRKVLLGVVEPEQLINMSTAEMASEQRKQEYQKITEKALFECERGGQPKATTDQFKCGRCGQRKTTYYQMQTRSADEPMTTYVTCCVCNNRWKFC

SEQ ID NO: 133667 - protein, 141 aa, Glycine max
  Coding DNA Sequence Number=SeqID_41982
  Gene Ontology: Mol. function=two-component response regulator activity; Cellular component=nucleus; Biological process=two -component signal transduction system (phosphorelay)
  Homolog annotation: Hit_ID=A7Q3X7; Match level="QueryCoverage=99%, HitCoverage=78%, E-value=1e-38, Identity=62%"; Hit description =Chromosome chr13 scaffold_48, whole genome shotgun sequence
  Pfam annotation: Domain name=Response_reg; Domain location=17-140; Score=18.6; E_value=0.00014; Accession=PF00072.15; Description =Response regulator receiver domain
MAAGSSSNWVMESGDVPHVLAVDDNLIDRKLVEKLLRNSSCKVTTAENGPRALELLGLTSGGQNTMNGRFNLESGEYRRSSNICRKVSTSHRSKVNMVITDYCMPGMTGYELLKKIKESSVTKEVPVVIMSSENIPTRINK

SEQ ID NO: 133668 - protein, 205 aa, Glycine max
  Coding DNA Sequence Number=SeqID_41983
  Gene Ontology: Mol. function=ubiquitin-protein ligase activity; Cellular component=ubiquitin ligase complex; Biological process =protein ubiquitination
  Homolog annotation: Hit_ID=A7Q3X3; Match level="QueryCoverage=78%, HitCoverage=52%, E-value=5e-33, Identity=52%"; Hit description =Chromosome chr13 scaffold_48, whole genome shotgun sequence
MVISLCLYIFGLPISPKLVVIEAERKLAALVLNPRLRNQYLPTYAYRREEESQFYRSPKRRRERFDQGGFGDSVVMEPSRSRGVQFPFAVMDRVIIKVVYELARFYLQVFLPFSEKEIIREKMVQGNKRTPQRFVGREAIVTTQCLNGWKYGKLASVVNKRLVYRYVVKTLDNAESVKLQYRSLAKVMDDPSKPAASSKMPPNWL

SEQ ID NO: 133669 - protein, 53 aa, Glycine max
  Coding DNA Sequence Number=SeqID_41984
MAGLPARLRLQPTDVKAAALWGVTAATGALYLIQDLCPMPCLALRIRRRYMLI

SEQ ID NO: 133670 - protein, 156 aa, Glycine max
  Coding DNA Sequence Number=SeqID_41985
MKQCRYEPGKDLIERKERLLPFEEIESHAPFNRKGGQGLLGINGVDQRGGRGVGGVASPVTGATGFQMRRLGYGTGPDLGNDAAERDPPRGRSRWGCGNASRIEIDGGERTTSFWFRGGMRVSFRSCNGFKPVTAPFPSPLYVLLSLVLSFVRQIL

SEQ ID NO: 133671 - protein, 424 aa, Glycine max
  Coding DNA Sequence Number=SeqID_41986
  Gene Ontology: Mol. function=ribonuclease activity; Cellular component=exosome (RNase complex); Biological process=rRNA processing
  Homolog annotation: Hit_ID=A7PKV4; Match level="QueryCoverage=83%, HitCoverage=38%, E-value=1e-149, Identity=75%"; Hit description =Chromosome chr7 scaffold_20, whole genome shotgun sequence
  Pfam annotation: Domain name=OB_RNB; Domain location=310-371; Score= -3.1; E_value=0.035; Accession=PF08206.2; Description=Ribonuclease B OB domain
MHQQLKGRINDNFLINYRRYTPAPVSCSDTWAIVITAGKHRGLTPNTEKASKQAHSPGRVTQRRAISSASNMLHNKSFVKKTKGGKVMKQVREHYLRDDIYCGAPFCTVCDSSGARLSASPSTILVVDTNVVLNQIDLLENPAIDDVVVLSIVLEEVKNKNMSVYNRIRAICSNSMRKFFVFSNEYHRDTYIKEMSGETKNDRNDRAIRVATQWYQNHLGGAVKVLLITNDKENKRKASEEGILAETVESYVKSLVRPDLLDLLVRPASEDVDMEEVEDLRPSKRKVIYSEHKPMSEITSGLHRGIYHQGKLRVNRYNPFEAYVGSESIGDEIVIYGRSIMNRAFDGDIVAAELLPQDQWQGVSSLSIAHEEDEDENEDVHLAPNSADDAPRAVSQQGSSEQLNAVPSRPCGRIVGIIKRNWHS

SEQ ID NO: 133672 - protein, 117 aa, Glycine max
  Coding DNA Sequence Number=SeqID_41987
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=57%, E-value=5e-28, Identity=100%"; Hit description=LacZ protein
MNDSSPTRATRLISRVWTVAKQEVFGLELPMLLGNSVWEQLRYRIRRHASLALAVVLQRRDWENPGVTQLNRLAAHPPFASWRNSEEARTDRPSQQLRSLNGEWRLMRYFLLYASVP

SEQ ID NO: 133673 - protein, 190 aa, Glycine max
  Coding DNA Sequence Number=SeqID_41988
  Gene Ontology: Mol. function=ribonuclease activity; Cellular component=exosome (RNase complex); Biological process=rRNA processing
  Homolog annotation: Hit_ID=A7PKV4; Match level="QueryCoverage=80%, HitCoverage=16%, E-value=3e-73, Identity=90%"; Hit description =Chromosome chr7 scaffold_20, whole genome shotgun sequence
  Pfam annotation: Domain name=RNB; Domain location=9-183; Score=43.7; E_value=4.7e-15; Accession=PF00773.10; Description=RNB-like protein
MGFGSSKVREEKLCFHIVSSFYSHEERVDIADVTNFVHPGTPLDDEAAQRGTSVYLVERRIDMLPKPLTEDICSLRSDVERLAFSVIWEMTPEADIISTRYTKSVIKSSAALSYVEAQARMDDSRLMDPITADLRNMNSLAKKMRLRRIERGALTLASAEVKFQIDTETHDPLDIGIIFLLNNISVLLFL

SEQ ID NO: 133674 - protein, 267 aa, Glycine max
  Coding DNA Sequence Number=SeqID_41989
  Gene Ontology: Mol. function=DNA binding; Cellular component=nucleus; Biological process=regulation of transcription
  Homolog annotation: Hit_ID=Q0PJL5; Match level="QueryCoverage=52%, HitCoverage=48%, E-value=2e-10, Identity=28%"; Hit description=MYB transcription factor MYB57
  Pfam annotation: Domain name=Myb_DNA-binding; Domain location=109 -156; Score=42.8; E_value=1.2e-09; Accession=PF00249.22; Description =Myb-like DNA-binding domain
MVAEIIDLSDSPPSSPWSSHNDAARILNFDSVSNEKNQFEKVIPISLMACTNPNQPQTSLWRAASRHTNEHSQIATTFQPSMQLQRVATVLEPVPESITCMFPHGARLKEPWTHREHELFLMGLIKYGKGHWSKIARHFLLNKTPQQVQSYGASFFRNLPSTHLHGFRRRKPSYSTSSLMSKNNNLMAASASTTSYFMPMIVNEPQQTHMFFPENAPLNFLLAPSHGEASSSNNNTTMYGFQMQTSGARTSMNASANGEVDLELRLG

SEQ ID NO: 133675 - protein, 387 aa, Glycine max
  Coding DNA Sequence Number=SeqID_41990
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7Q3U4; Match level="QueryCoverage=96%, HitCoverage=98%, E-value=1e-166, Identity=68%"; Hit description =Chromosome chr13 scaffold_48, whole genome shotgun sequence
  Pfam annotation: Domain name=Melibiase; Domain location=48-323; Score= -83.5; E_value=4.5e-11; Accession=PF02065.9; Description=Melibiase
  Subcellular localization annotation: CTP_CleavageSite=66; ConfidenceScore=5.02e-01
MTKQKIRNALLVHLVILFFFSTSVVSARVVSLLQNYGNPIFRSNFHSIYDTSKYGVFQLSNGLGKTPQMGWNSWNFFACNINEMVIKETADALVSTGLADLGYVYVNIDDCWSSVTRNLKGQLVPDHKTFPSGIKALADYVHGKGLKLGIYSDAGYPPMRDALNATGQKIFYSLCEWGVEDPALWADKVGNSWRTTGDINDSWASMTTIADLNDKWAAYAGPGGWNDPDMLEVGNGGMTYQEYRAHFSIWALAKAPLLIGCDVRNLTAETLEILSNKEVIAINQDSLGVQGRKVQVSGADGCRQVWAGPLSGNRLAVALWNRCSKVATITASWEALGLESGVHVSVRDLWQHKVVTGDAVSSFSARVDIHDCQLYIFAPFTVSHSVE

SEQ ID NO: 133676 - protein, 339 aa, Glycine max
  Coding DNA Sequence Number=SeqID_41991
  Gene Ontology: Mol. function=superoxide dismutase activity; Cellular component=mitochondrial matrix; Biological process=superoxide metabolic process
  Homolog annotation: Hit_ID=A5JVZ7; Match level="QueryCoverage=57%, HitCoverage=80%, E-value=1e-111, Identity=100%"; Hit description =Superoxide dismutase
  Pfam annotation: Domain name=Ribosomal_S26e; Domain location=211-324; Score=231.2; E_value=2.4e-66; Accession=PF01283.10; Description =Ribosomal protein S26e
  Pfam annotation: Domain name=Sod_Fe_C; Domain location=128-213; Score= 117.7; E_value=3.4e-32; Accession=PF02777.9; Description =Ironmanganese superoxide dismutases, C-term
  Pfam annotation: Domain name=Sod_Fe_N; Domain location=40-121; Score =171.8; E_value=1.8e-48; Accession=PF00081.13; Description =Ironmanganese superoxide dismutases, alpha-
  Pfam module annotation: Pfam domain module=Ribosomal_S26e::Sod_Fe _C::Sod_Fe_N; Domain location=211-324::128-213::40-121
MAARALLTRKTLATVLRNDAKPIIGVGITAAATHSRGLHVYTLPDLDYDYGALEPAISGDIMQLHHQKHHQTYITNYNKALEQLQDAIAKKDSSAVVKLQGAIKFNGGGHVNHSIFWKNLAPVREGGGEPPKGSLGWAIDTHFGSFEALIQKVNAEGAALQGSGWVWLGLDKELKRLVVETTANQDPLVTKGPNLVPLIGIDVWEHAYYLQTFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKREPPQRFIRRRDDAPRPGQPGQAPRPAGVGAPART

SEQ ID NO: 133677 - protein, 72 aa, Glycine max
  Coding DNA Sequence Number=SeqID_41992
MDHPSWLINGFRRAVLDCNPVGIPMMGYPFTWSHSKAFTQEASNHHHIRIRFKFENVWLLLEEDVKEIVKGD

SEQ ID NO: 133678 - protein, 1331 aa, Glycine max
  Coding DNA Sequence Number=SeqID_41993
  Gene Ontology: Mol. function=oxidoreductase activity; Cellular component=extracellular region; Biological process=response to oxidative stress
  Homolog annotation: Hit_ID=A7QEU4; Match level="QueryCoverage=17%, HitCoverage=70%, E-value=3e-78, Identity=59%"; Hit description =Chromosome chr16 scaffold_86, whole genome shotgun sequence
  Pfam annotation: Domain name=peroxidase; Domain location=1083-1286; Score=174.0; E_value=3.9e-49; Accession=PF00141.14; Description =Peroxidase
  Subcellular localization annotation: CTP_CleavageSite=34; ConfidenceScore=5.24e-01
MKGVGGYHDWPYYASPTSNLSAFAAPFSVNPYTSSEASSQFMDTAESAETLPPIQFQPYRYDFFSGPVRELDSAAQFSHLGLPSYSARSNLVEAQPYTASSAIHDHSSNSAAPYHWSSGAPSSDWPSLREANRSPELGFSGQSAVSWDQFPEFNSRGKGKQVGVGSNLSVKETNAAGSVGEQRRNQGNQDVKDSSNCEVPQIIDWENYNVPASANHIHNTSNWWGTIKPMPVEFSGTSVMQSPSMSLETHHETPLKVVADSGNNHSLNIGSYYKHSSHVDKPSRVDTVSSMPGTMLVTDLNVQDIIADEHVGHDDFYNTKEASHMPSPGTAGLFNPGPIHMHLRRNEPSSSNKAMISDKNVSRNVADYIFRESHEFQNPHANMDNLRLGLSAIEDVNFVEKSFEGGDRCNPAEDSPCWKGASAARFSHFEPSAALSQEYVHKKESSFGSVIKEPQNYLLDTENNMKKSCGNSNGFQMHTGIVYQDRSSAGSPRRFSVTKFAPEYCKSGSALNDGPFQSKPSCDFGLQQYVDITKMKENTVPPAKPTDCESGSSQMGLQLVDLKEFITQKQQALLCTGDVNSGCNVNNCSEYDSSHTAEHVLPLPSSVLDATTPENSAGKASTEKLDVQMLLDRMQNLSELLLSHCLNDACEWKEQDCNVLKNVISNLNTCALKNEQIAPVQECLFNQPETSKHAGESRKFRQNSCLKRPQLTKIGPESSKIEFENPLVAEANFCFRSGKPHRKLSDSISPRVDTEMTKADNMTKDLKRILSENFHGDDDEGAEPQTVLYKNLWLEAEATLCSVYYRARYNQMKIEMDKHSYKEKVMEKQSKSEVIPTLSQSQSSATKVHYPNPDSSADLKFPVLDVTNLEELSRLNISTDMNKSNAITPEGRGQNLDSFIDNYLVPCSVNKTERNDESSVMMARYQVLKARIDQSSTVTTNLEEPLDVADSSSPRGRDNQNQVNLCQDSPIPEKNSAEYETSVLARFHILKSRDEGSSSISSEGKQLHGDESAAVEGMDGITVATNVSEGKSLDVHANPVVVHLNSYTAVDKSIPKEFHLDSEDNQETQPSGTCEFQPPTYYSDGFASDWEHGCDASVLLDSTSTNTAEKDSPANKPSLRGYEVNDNAKAKLEAVCPGIVSCADIVAFAARDSVELEGLAMMFQQEEEIAESHQLQIQEQSSPSNFQSHTIGRSHCWAFSSRLYNFSSTSSQDPSLDPSYAALLKRQCPQGSTNPNLVIPMNPSSPGIADVAYYVDILANRGPFTSDQTLLTDAETASQVKQNARDPYLWASQFADAMIKMGQISVITGNAGEIRTNCRVVNGEGLEYLHQ

SEQ ID NO: 133679 - protein, 81 aa, Glycine max
  Coding DNA Sequence Number=SeqID_41994
  Subcellular localization annotation: CTP_CleavageSite=61; ConfidenceScore=5.70e-01
MAKVLHVSDHSSTASGGSVETHPPPPTNVAVSHQPSSTSLSAFIPKSRTPTAVVGASQRSRQKAVEEWAEAVKGLAEKEEE

SEQ ID NO: 133680 - protein, 318 aa, Glycine max
  Coding DNA Sequence Number=SeqID_41995
  Homolog annotation: Hit_ID=Q6WAY6; Match level="QueryCoverage=38%, HitCoverage=21%, E-value=9e-14, Identity=34%"; Hit description =Putative uncharacterized protein
WDQLLAGIGGRTISWFPRWKEGKEGVLFSCGRYPNVPLVGTRGCINYNPTLAIRQLGYPMRGAPTEESMSPFLVRDLGAQNSKTIQRIHKAWETPLRKDQELRGIRNGIIGGYHEWLKVRIRGLDWLAKLKVVSEENFEAPEEDEEVQALKSELGKAKLAKEKFSWLLHTFGRSVPGYGKRMQLPELKLRREERDQSRAHSMVLKEELIACSRSKRGLSQHLCETETNMLAIIAKYQEELGLATAHEHRIADEYAQVYAEKEARGRVIDSLHQEATMWMDRFALTLNGSQELPRLLAKAKAMADTYSAPEEIHGLLGY

SEQ ID NO: 133681 - protein, 153 aa, Glycine max
  Coding DNA Sequence Number=SeqID_41996
MATMMEAMMRMKKIMEANAVVVTATSVVAKVNPMPPSGLNQMNHPTSARVGKDLGSTGSPHYAQIQNKHAFPPYGLPPNYTPPNVAYTPNTHEIPHHNLADFEPCLGYATEGQAVGGIPLQNTLEGPQFRPKPQPLHFTVGKIPPIMEGKGKV

SEQ ID NO: 133682 - protein, 140 aa, Glycine max
  Coding DNA Sequence Number=SeqID_41997
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=2e-24, Identity=68%"; Hit description=LacZ protein
MMLSRALFWRGSRKIATCSKCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133683 - protein, 78 aa, Glycine max
  Coding DNA Sequence Number=SeqID_41998
MSVAAYPSAGEQRGAHGCVFQGRKMRGVATNVYSRKTSEKPERCGLRTLSVKGSGVIFMHGEGISTPRVRHKGRQGIL

SEQ ID NO: 133684 - protein, 36 aa, Glycine max
  Coding DNA Sequence Number=SeqID_41999
GAEFVYARLSTQLLLSNDKGRRIRLCAFTTRLAAPE

SEQ ID NO: 133685 - protein, 54 aa, Glycine max
  Coding DNA Sequence Number=SeqID_42000
MDKSLNVGEDEWKEKERKRMKFCASNELWFNPLIQDQVQDSPLSVLKCYEACKA

SEQ ID NO: 133686 - protein, 79 aa, Glycine max
  Coding DNA Sequence Number=SeqID_42001
MKNGGKPSRNRPRKRLGSVTEAPRLAFSSWKQFFSLILSASQIPGGGKEGGGCHPARLGELGCFHQKAPPSVGRPWKAQ

SEQ ID NO: 133687 - protein, 152 aa, Glycine max
  Coding DNA Sequence Number=SeqID_42002
MELIENMTASDHAIFTDRTHYPTKKSLLELSSQDALLAHNKLLAKQLKTLTETLSCTLCGGAHESGCCIPTEESTHEVNYMGNQSRQNFYAGGFSGFQQGQHYNQQQNQWRIHPGNQLNKDQGGPSNRAPQQGPNLYERTTKLEETLAQFMQ

SEQ ID NO: 133688 - protein, 162 aa, Glycine max
  Coding DNA Sequence Number=SeqID_42003
MGIAPTRHPVDPEKSNRALGFPALVTGLYQSYRVPVPPPTRSHHHRDRACRHPVDPKKSNRVLECQALITGLCQFYRVPVTSSKGIRPPTNRAFIKKYCVSRQAQGKTPQQLGDGRQRATDAPPSPLEFTSAHPQKGLSIAYTTWPANRRPSPKPKDAPSCS

SEQ ID NO: 133689 - protein, 322 aa, Glycine max
  Coding DNA Sequence Number=SeqID_42004
  Homolog annotation: Hit_ID=Q6WAY6; Match level="QueryCoverage=82%, HitCoverage=54%, E-value=1e-14, Identity=25%"; Hit description =Putative uncharacterized protein
GVLFPNVDGLVDLAAIDVFLAYHNHKESPVVAMLADLYDTFDRRCEESNARIVCCTPALYEGRIKILSSCEGCPNVPLMGTRGCINYNPVLAIRQLGYPMRGAPLDESITPFTARGFSDHNARDRELRGSSNGIIGGYHKWLRVRTQGLDWLPNLKTVRDDEVKASEESDEVQALKAELERARVVEEKFKSIAIKGSNSKLKLRRGERKSSQVKGMILKDELKAYLRSKRNLSQQLSETEGNMWAVIDECKEKLNLVATHEQRLEDEYAKILAESEARERESRTSPITSQGQSNGGHLLRPQEDPQTSELLSTDDRLNGPYD

SEQ ID NO: 133690 - protein, 158 aa, Glycine max
  Coding DNA Sequence Number=SeqID_42005
MTIMPISPCRCINWDRAHKTPSGPEEVQQGPGVSSSGYGPLSVLQGAHSPSEESHPQRHPVNPEKSNRALGFLALVTGLCSPSGWSFPPARSRHHDIGIAPARHPVDPKKSNRVLELPSSNYGPRKVIRPPTNRAFIKKYCVPRQAQGKTPQQPGDGR

SEQ ID NO: 133691 - protein, 166 aa, Glycine max
  Coding DNA Sequence Number=SeqID_42006
AGPSEVRVIPPSRVVSVVGEAAQLLQVAAWKGKGLYGGQQRSTNHKPLQQVQISDSRPAGYLMHSSNDYGIISGAKLLGVGSHLAQLNFWLQQESCPPFQGLPPLADLSLLSSDPFIKILEKKLFLEESDELKCPGSRENFFAKMTLLKVPATLEKATCQKFCDCC

SEQ ID NO: 133692 - protein, 65 aa, Glycine max
  Coding DNA Sequence Number=SeqID_42007
MAEEHDLRITLEDYSREAKRWLHSFKGNNLKTWEDVVEKFLKKYFPESKTAEGKVAISSFHQFPY

SEQ ID NO: 133693 - protein, 121 aa, Glycine max
  Coding DNA Sequence Number=SeqID_42008
MGPDECKETRRTGTEEVACKPRQDFSIQKGPVFSSLWLSMRNFQQPFFLPPRCFFFLFFSTIVVSFEAPNFPSFPHQIARKSYFRSLGAYLYLVEPSISDRKLVERMGRVNLELNVRMVVL

SEQ ID NO: 133694 - protein, 63 aa, Glycine max
  Coding DNA Sequence Number=SeqID_42009
MNIHKKSDQGVPMNPKRIKVIPEWPTPPSVEERILEFQEPLDLRSNLFQGGGNDAILPPKGIG

SEQ ID NO: 133695 - protein, 98 aa, Glycine max
  Coding DNA Sequence Number=SeqID_42010
  Homolog annotation: Hit_ID=Q84VH5; Match level="QueryCoverage=51%, HitCoverage=7%, E-value=2e-18, Identity=98%"; Hit description =Envelope-like protein
KAAASGAVSKDALIAELKDTCKVLEATIKATTEKKMELERLIKRLSESGIDDEEAAEEEEEAAEEEEEAAEEEEEAAEEEEEAAEDTESDDDDSEATP

SEQ ID NO: 133696 - protein, 120 aa, Glycine max
  Coding DNA Sequence Number=SeqID_42011
QDEATTSPSSSESEEAKWEESSEEIYPQEDGQPLVVKEKCKETLASIATPLGLEFIPQVKKLLDEAPLIELVRNHVPSWEDAQEMGVEGRSPEYDETRDLRSNPFQGGGNDAILPRKGIG

SEQ ID NO: 133697 - protein, 43 aa, Glycine max
  Coding DNA Sequence Number=SeqID_42012
QYEKHGPNNDKGERSGRVRRGPSPQCAYAFFRPHHSDGGCEGR

SEQ ID NO: 133698 - protein, 134 aa, Glycine max
  Coding DNA Sequence Number=SeqID_42013
  Gene Ontology: Mol. function=carbohydrate binding; Cellular component= 6-phosphofructo-2-kinase/fructose-2,6-biphosphatase 1 complex; Biological process=fructose 2,6-bisphosphate metabolic process
  Homolog annotation: Hit_ID=A9PEZ0; Match level="QueryCoverage=59%, HitCoverage=10%, E-value=2e-33, Identity=85%"; Hit description =Putative uncharacterized protein
  Pfam annotation: Domain name=PGAM; Domain location=1-133; Score=-8.6; E_value=0.011; Accession=PF00300.13; Description=Phosphoglycerate mutase family
MQHRNIVSEAGELYSKKLAKFVGKRLKSEWAASIWTSTLQRTILTATPIIGFPKIQWRALDEINAGVCDGMAYAEIKKNMPEEYEYVCRLVYRNGNPYGIAEGIVFSMPCRSKVITKSKELVMVSFQVYWMLIY

SEQ ID NO: 133699 - protein, 195 aa, Glycine max
  Coding DNA Sequence Number=SeqID_42014
LTFAIRTTRPDLQRATRPHLKRTTGPHLQRATHHHLQRCTCPRLQRTTRPHLQRTTRLDLQRATRPHLKRLHVLAFIGLHVLPFSGVHALAFQGLHTLTFRGLQAHPCNILQRTTRPQLQRTTRPYLKSATHPYLQRTTRPCLQRATRPSFRGLHVLTFKATQDYTSPPSEDYTSSPSDEHVLTFKGYTPSPSQG

SEQ ID NO: 133700 - protein, 181 aa, Glycine max
  Coding DNA Sequence Number=SeqID_42015
  Homolog annotation: Hit_ID=UPI00006A2939; Match level="QueryCoverage =84%, HitCoverage=82%, E-value=2e-11, Identity=31%"; Hit description =UPI00006A2939 related cluster
MRGTVHEPQYPGLQRTTLLANRGLHALTLRGLCVLTFRGLHVLTFRGLHALAIRGLRVLTFRGLHALAIRGLHVLTFVGLHTLTFRGLHVLANRGLHALTLRGLHVLANVGLHALTFRGLHVLAFRGLHVLTIRGLHALTSRGLHVLALRGLHVLTIRGLHALTSRGLHVLALRGLLALAL

SEQ ID NO: 133701 - protein, 276 aa, Glycine max
  Coding DNA Sequence Number=SeqID_42016
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISQFHMGGEASGNLQPGWRGKQAPSSQGGRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133702 - protein, 113 aa, Glycine max
  Coding DNA Sequence Number=SeqID_42017
MKISLKLTRWSMSQHICYTVVDFHLTETSLRAGNSDVYGFLEPQSIQRSGQSQFESESYIKSWMQSSKRDVYLGAYLNGPDNYLKGIINSALKRLDDTPQPKSKAAARWIVVK

SEQ ID NO: 133703 - protein, 67 aa, Glycine max
  Coding DNA Sequence Number=SeqID_42018
MKANKTRNELKVSKFENLLVEERRTNEERMKNDENLHGFAHGNVSEALRKHLSLDFLHRNNFFTENS

SEQ ID NO: 133704 - protein, 40 aa, Glycine max
  Coding DNA Sequence Number=SeqID_42019
MEEVHWPVMPYAFGTEPSEPSRSEDRWSVAEMASSSGGGG

SEQ ID NO: 133705 - protein, 276 aa, Glycine max
  Coding DNA Sequence Number=SeqID_42020
MALVKEFYANLYTTEDQAPKQARVRGHLIKIDADKLNEFLQTPVVLKEGESLPTYFRFCRLRTKHQEIDARLCIPRKGKDLTALAQTWSVFSYSNLAPTSYTSDLNMDRARLVYGLVTNIDMNIGALISGHISSIAQSNSSRLRFPALITAESLSPTINLAYIKKNCWNVDDLTVNFRGARKARVRPTDVPSSSTPPAPSTSTTHIPTPPGLSAQDSQRFKSMLQSLHQGQILLMQSLQVVAPLGSILTVEQFIEKVSWPGILTSLEREGGGPSAQ

SEQ ID NO: 133706 - protein, 144 aa, Glycine max
  Coding DNA Sequence Number=SeqID_42021
MERSMIDAASGGTLGDMTPTEARNLIEKMASNSQQFIARNDAIVLRGVHKVAMDSSSSAENKKLEVKLDALVNLVTQLAMNQKSAYAPVARVCGLYSSADHHTDLCPSLQQSGVNEQPEAYVANIYNRPPQQQNQQQQNNYDLS

SEQ ID NO: 133707 - protein, 200 aa, Glycine max
  Coding DNA Sequence Number=SeqID_42022
  Gene Ontology: Biological process=transposition, DNA-mediated
  Homolog annotation: Hit_ID=Q1J7G7; Match level="QueryCoverage=20%, HitCoverage=71%, E-value=5e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGSEIYRQEAAVLGKIKLIDTVDLEGGPVGKPVVPAALMNRPTRGERRFAYWALAECILAYYVGTDEGVSEVLHVAEKKGCT

SEQ ID NO: 133708 - protein, 212 aa, Glycine max
  Coding DNA Sequence Number=SeqID_42023
  Homolog annotation: Hit_ID=Q2HW90; Match level="QueryCoverage=34%, HitCoverage=14%, E-value=3e-07, Identity=42%"; Hit description =Putative uncharacterized protein
  Subcellular localization annotation: CTP_CleavageSite=52; ConfidenceScore=5.34e-01
MTDVWGANTFPVRKYNSRAFHLKVRRSRLFRFFRRFPQINVGGDSACIPFVEHASRESRVALPPKGPYTRVHGNIRSGGESVIMLGLRPWQIKANGLSFIDILALLIFGVVLFPNMEGLVDLAAIDAFLAFHHGKESPIVAILAMYDTFDRGCEKSSARIVCCALALYVWLVSHLFFSKKVGPSIRYKVTARASKKERRIGTNSWLAWRGVC

SEQ ID NO: 133709 - protein, 286 aa, Glycine max
  Coding DNA Sequence Number=SeqID_42024
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRCNELTISSSNVPSDADATVATATDELDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133710 - protein, 111 aa, Glycine max
  Coding DNA Sequence Number=SeqID_42025
  Homolog annotation: Hit_ID=A5AMM4; Match level="QueryCoverage=80%, HitCoverage=4%, E-value=4e-10, Identity=39%"; Hit description =Putative uncharacterized protein
QIPRYAKVLKELCTNKRKLKGSERISMGRNVSALSGKSVPQIPENAKIQSTDVVIHLANRSVAYPVGFIEDVLVRVGELIFPVDFLYLEYGRWIFSRISSHHSRQTLYENC

SEQ ID NO: 133711 - protein, 250 aa, Glycine max
  Coding DNA Sequence Number=SeqID_42026
  Homolog annotation: Hit_ID=Q84VH5; Match level="QueryCoverage=100%, HitCoverage=37%, E-value=3e-95, Identity=73%"; Hit description =Envelope-like protein
MATSPKETSAPGSPSAPSNQERPEFNIQPIQMIPGQAPVPEKLVPKRQQGVKISENPSIATSPREVDPEMDKKIRSIVSSILKDASVPDAGEDVPTSSTPNVSVPDVEKDVPTSSAPNAEALPSPSEEESTEEDDQATEETSAPKAPEPAPGDLIDLEEVESDEEPIANKLAPGIAERLQSRKGKTPIKRSGRIKTMAQKKSTPITPTTSRRSKVAIPSKKRKEISSSDSDNDVELDVSTSKRAKKSGKK

SEQ ID NO: 133712 - protein, 142 aa, Glycine max
  Coding DNA Sequence Number=SeqID_42027
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=71%, HitCoverage=96%, E-value=5e-25, Identity=53%"; Hit description =Putative uncharacterized protein
MTMITPSSKLTLTKGNKSWHGQCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133713 - protein, 113 aa, Glycine max
  Coding DNA Sequence Number=SeqID_42028
CQSFGVPVTPSKVIRPPITRAFIEKYCTPRQAQVDAPQATDALPPPHQADHAGSLGMEQYLQHLFRAEVAWPGDWPEAQAGEAPAGSPGDAEEARMDEEMMDLLGFLGGSGAM

SEQ ID NO: 133714 - protein, 276 aa, Glycine max
  Coding DNA Sequence Number=SeqID_42029
RIPACAPFLVRDFGVQNFKVIQRVHKAWGSPLRKDKELRGIRNGIIGGYHEWLKVRTRGLDWLAKLKIINEENFEAPEEDEEVRALKTELGKARLAKEKFKLVATDVWKECSGLQEENVATAKALEQETKRARKEQHGRDKFREALWGSNSELKLRREESDQSRAQSMVLKEELVACSRSKRNLTQRLCETETNMLAIITKYQEELSLATHEHRVADEYAQVYAEKEARGRVIDSLLQAATMWMDRFALTLNGSQELPRLLAKAKAMADTYSAPDC

SEQ ID NO: 133715 - protein, 119 aa, Glycine max
  Coding DNA Sequence Number=SeqID_42030
MTSRDQVWSFCTLVSSRGGGPDDTRRYLYEAAGPMIRGDTLWLFAPFCHPEAAGPMTSRDQVWSFCTLVSSRGGGPDDTRRYLMVIHTLLSSRGGGPDDKQRPSLVILHPCIIQRRRAR

SEQ ID NO: 133716 - protein, 82 aa, Glycine max
  Coding DNA Sequence Number=SeqID_42031
MSQNFTDCLTMGVKFLEAVKQRLHAIKQWSPNETRAINSWGSGLDGGGCMNDNQFMGLRIRFNGGGCTNNARQSIHGAPNKI

SEQ ID NO: 133717 - protein, 85 aa, Glycine max
  Coding DNA Sequence Number=SeqID_42032
MSGFTRNSPQISASPYQLDFTLYASGSYNAQWNAPGLLHDKHTLHSSRILRKVEGVFLIGSAGKQTLWLIFDRPLGLPGGGGKEE

SEQ ID NO: 133718 - protein, 134 aa, Glycine max
  Coding DNA Sequence Number=SeqID_42033
  Homolog annotation: Hit_ID=UPI00016621D1; Match level="QueryCoverage =74%, HitCoverage=38%, E-value=1e-11, Identity=43%"; Hit description =UPI00016621D1 related cluster
MSQSLPRATRPHHQRATRPHLQRTIRPHLRGLHVLTYRGLYVLTFRGLHVLTFRGLYILTIRGLHVLTFRGLHVLTFRGLYVLTFRGLHILTFRGLQVLAFRGLHTLDFRGLHVLTIRGLHVLAFRGLHVLTFR

SEQ ID NO: 133719 - protein, 113 aa, Glycine max
  Coding DNA Sequence Number=SeqID_42034
MTGHDWPRILFPTCRYMGTDASGDRVTTDRSLPLPGGSSRQTLARKGGGDMVNVPLKKKCGRLARLGEQPLHPNYKKRGRGTFWHPKTSPPPPPHSKDKEHEGLRFLAPLSHF

SEQ ID NO: 133720 - protein, 118 aa, Glycine max
  Coding DNA Sequence Number=SeqID_42035
MVAWPGIQPSLHREDEGPTAQLPQHVEDESSEATIPEPFVIGEEAEETQATLEPSAPVVNLPSPQPAADPSTPLLEMLEDPTTPVLDMDTSPPTTLVLHLTDEEDVQTQDTQDQSQEF

SEQ ID NO: 133721 - protein, 338 aa, Glycine max
  Coding DNA Sequence Number=SeqID_42036
  Homolog annotation: Hit_ID=Q652R5; Match level="QueryCoverage=26%, HitCoverage=36%, E-value=2e-16, Identity=53%"; Hit description =Putative uncharacterized protein P0603C10.50
  Subcellular localization annotation: CTP_CleavageSite=56; ConfidenceScore=5.14e-01
ERAGAEARQGGALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGLVGSVRARKGSSMGPDLTGSHVIGLERAHPPFITAKSAMNPDFNQPRGGRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 133722 - protein, 149 aa, Glycine max
  Coding DNA Sequence Number=SeqID_42037
MDLIENMVASNIAILRDRAHIPTKKSLLELTSQDALLAQNKLLSKQLEALTETLRCTICGGAHESGCCIPIEEQPTHEVNYMGNQPRNNFNAGGFSGFQHGQQYNQQQGQWRNHPGNQFNRDQGGPSTRPQQQGCSLYDRTTKLEKTLA

SEQ ID NO: 133723 - protein, 155 aa, Glycine max
  Coding DNA Sequence Number=SeqID_42038
  Subcellular localization annotation: CTP_CleavageSite=35; ConfidenceScore=5.24e-01
MLMLASPLNKAKHSCYAKLLLLSAPCALSLRVILMASKKRKAPATPSQVRYDRSRFTSPKAWESFEEGNINVAIVKEFYANLYDLEDKSPKQVRVRGHLIKFDEDALNTFLKTPVIIEEGETLLAYSRFALLRPDPQELAAKLFIPGRGFELNAD

SEQ ID NO: 133724 - protein, 92 aa, Glycine max
  Coding DNA Sequence Number=SeqID_42039
MVIPKFKVLDFDKYKGTTRSKNHLKIERINVGPKRGKFDHPTRTTEKTGANKEGEDEGETHAVTAIPVRPSFPPTQQYLYSANNKPSPYPPP

SEQ ID NO: 133725 - protein, 106 aa, Glycine max
  Coding DNA Sequence Number=SeqID_42040
  Homolog annotation: Hit_ID=A7Q8D5; Match level="QueryCoverage=44%, HitCoverage=12%, E-value=6e-11, Identity=72%"; Hit description =Chromosome chr5 scaffold_64, whole genome shotgun sequence
  Subcellular localization annotation: CTP_CleavageSite=63; ConfidenceScore=5.23e-01
MSHTFPSPLLPPQHPLLPLPPIISFSSATNPLPHHEEITPWSMRTRSWSLEVLVPEREMASTSASSFERKVSRSRSVGCINKSFSGDFFDCISIGFGGCTLKWVES

SEQ ID NO: 133726 - protein, 110 aa, Glycine max
  Coding DNA Sequence Number=SeqID_42041
GSHPQRHPVDLKKSNRALGFPALVTGLCQPYRAPFPPASSGHHDIGIVPARHLVDPKKANRVLELPALNTGLYQFKGVPIAPSRVIRPPINQAFIKKYCAPRKAQGETPQ

SEQ ID NO: 133727 - protein, 240 aa, Glycine max
  Coding DNA Sequence Number=SeqID_42042
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNAREEPKHDQIAASLRGMQPMAVEHPKVYQTAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133728 - protein, 44 aa, Glycine max
  Coding DNA Sequence Number=SeqID_42043
FKAEVAWPRDWPEARAEAPDEADEARKDEEMTNLLDFLGGSGAT

SEQ ID NO: 133729 - protein, 113 aa, Glycine max
  Coding DNA Sequence Number=SeqID_42044
MGKVKEVQEYMEADMEAMKEQMAAMMEAMMSVKKIMEANAVAIAATSVVAKVNPTSPSDINQMNHPTSDKVGKDLGSTGGPHYAQSQNKHASPPYGLPSNYTPPNVAYTPNKN

SEQ ID NO: 133730 - protein, 381 aa, Glycine max
  Coding DNA Sequence Number=SeqID_42045
  Homolog annotation: Hit_ID=Q2HW90; Match level="QueryCoverage=94%, HitCoverage=70%, E-value=2e-43, Identity=33%"; Hit description =Putative uncharacterized protein
MGTNQNGKRFYQVKVKSLDVTSLKELGRLMGPLQRQAFRKVYGKILDLAAAEVFTEAVVSLAQYYDQLLRCFTFGDFQMVPTIEEFEEILGCPVGGRKPYLFSGFLPSLSKIAAVVGDSAKELDCTKQTRNGVVGLPRKYLEGKARDMVSQEKWGPFADILALLIFGVVLFPNVDGLVDLAAIDAFLAYHHSKESPVVAILVDLFDTFDRRCEKNSARIVCCLPALCVWLISHLFQQDTRHPCLLQRYRSCAEKGRVDWDQHLAGIGGSAINWFPRWKEGKEGVLFSCGDYPNIPLIGTRGCINYNPALTIRQLGYPMRGAPTEESLSPFLVRNLGAQSLKAIQRVHKAWRSLLRKDKELRGIRNGVIGGYHGWLRIHTPR

SEQ ID NO: 133731 - protein, 111 aa, Glycine max
  Coding DNA Sequence Number=SeqID_42046
MKREISSIPDSNCLRGHMSLDIVSTSKGQDMLLQRCCVQGCSDCHELTSGHMQRCWKFLYQRLALDHREEDGCGMDDQKAHHEVALMTGEAAVSKKYEAAEEEVHCQHSLR

SEQ ID NO: 133732 - protein, 75 aa, Glycine max
  Coding DNA Sequence Number=SeqID_42047
MESGDMRGYRMVIRTFRQPGPNELVDAQRLTSSSAPFSIQGQRVRWFLLSSSGDIQAQQHTRFFSAGRGRSSSMA

SEQ ID NO: 133733 - protein, 177 aa, Glycine max
  Coding DNA Sequence Number=SeqID_42048
MVGEMLVAKAISLESSRKILQLYNDEIAWMLWELARVLGLEGSRLNDEDLETIGKNLFKEKLKLLKTKLWGWHVEVFDGLGANINSKVEELEVVKTRLCVRVEDVGGRRLILSKEFWRSLKKWPKNIGFIYLYEIQAKSMKIKVLDDSQCIVIGRYCLNIQSSEEKCFDTSLIVQRQ

SEQ ID NO: 133734 - protein, 60 aa, Glycine max
  Coding DNA Sequence Number=SeqID_42049
MGQNTPNDYDDGWLKFSQSTIKRLKTIKSSKENRTSVIKAKKEIGKEKLPKSWWRKSRVE

SEQ ID NO: 133735 - protein, 69 aa, Glycine max
  Coding DNA Sequence Number=SeqID_42050
MTRVMSKMTTTDEVYFVEAFGKRRHREAPFGGGDSDCEVAEGVAGDGHVNDKLSVLEGGEKGAEAGNGN

SEQ ID NO: 133736 - protein, 165 aa, Glycine max
  Coding DNA Sequence Number=SeqID_42051
MSLHSSSSVNGEGSTPKDPLYKILDELRSLKLWKEKQERKEKGKKRVEEISQDEREKIREEERRKIMKEMKREKHASFSSHDSCKSLSEELSDYYRGSHSSHTKHHSQRRENERKPREFNIKLPYFHGKDNEEAYLDWEIRVEQKLKRKPTLKSYGCHSYPKKDQ

SEQ ID NO: 133737 - protein, 86 aa, Glycine max
  Coding DNA Sequence Number=SeqID_42052
MDCFVILLILLYRNMPLLRASEARLTGALSKGGKMRGVATNVYLWKTSEKPKVDKSGAFAPTYPPSKRKSDLRSSFLRVNQAILFT

SEQ ID NO: 133738 - protein, 239 aa, Glycine max
  Coding DNA Sequence Number=SeqID_42053
  Homolog annotation: Hit_ID=A7QUI1; Match level="QueryCoverage=100%, HitCoverage=55%, E-value=3e-52, Identity=48%"; Hit description =Chromosome chr10 scaffold_179, whole genome shotgun sequence
LQTQIQTEIAIGNPSEGDVRDAIEKVLALDKAYPLPLLGGAMLEKFPAKFEAARWWPESRLSSNDEDKIMEIKNNNNNGWNVELEEEMREVIEVLKRKDMEDYERLGNIALKKNKGFAVSAPLLTGIVALGSVFSGDGLVPALAGALATVVNAFEHGGQVGMVFEMYRTCGGFFQLLEETIETAIEEKDLDKRENGELFEMKMALQLGRSVSQLRELATKSASCRIEGREIHEFASKLF

SEQ ID NO: 133739 - protein, 99 aa, Glycine max
  Coding DNA Sequence Number=SeqID_42054
EGLFPPQNARVVVVGETEGPPKCLAWVYHQMLALQWHIRGKARSHLDCGGEFHVSPPRPDGGIGFTSTIICSFKASLSAFICSCTSSTSPITLALAQVR

SEQ ID NO: 133740 - protein, 313 aa, Glycine max
  Coding DNA Sequence Number=SeqID_42055
  Gene Ontology: Mol. function=RNA-directed DNA polymerase activity; Biological process=regulation of transcription, DNA-dependent
  Homolog annotation: Hit_ID=A7QSG9; Match level="QueryCoverage=39%, HitCoverage=19%, E-value=6e-33, Identity=52%"; Hit description =Chromosome chr12 scaffold_159, whole genome shotgun sequence
MAIPFKTKDVNEEITSKDIKSLMEQANYTNKYLQALGETIKTKVVPKQKSIEETSPKIPIEKPLFKPFKVSEKAKRKIRELRKTKSLIEGVGDNHSELLNKIGSLLKVIPDTPQASENTSKMVTRSTSKLINVINEDSDQNSDNTIEIGSVSEKNINPINSKHWKTPSKLYYQRPTAPRPSIRRKSAVKTDLNGKVITNDDDKEIPDAVNTLIFTIAQHFIGDPSLWKDMSVELLSNLKCRTLADFRWYKDTFLTRVYIREDSQQPFWKEKFLAGLPRSLGDKVRDKIRSQSVNGDIPYENLSYGQLISLCPK

SEQ ID NO: 133741 - protein, 125 aa, Glycine max
  Coding DNA Sequence Number=SeqID_42056
MGFHPTKLNFVPSDADEAPLDVSICLHAFGIVGVWFVLVVSSLANVRVLTIGSCVAYLPNGIRVARSDPFHPGLFVGDAGGFQSPTREPLNVGGLVPPHCSLKSVVSDDACPGACFVQRDATTLS

SEQ ID NO: 133742 - protein, 58 aa, Glycine max
  Coding DNA Sequence Number=SeqID_42057
  Subcellular localization annotation: CTP_CleavageSite=33; ConfidenceScore=5.09e-01
MGVQIATRPTWALQKIPPEGCCFWRKQPCSPGRAGNFAKVSTVLQRSSFVLHRSSIFN

SEQ ID NO: 133743 - protein, 292 aa, Glycine max
  Coding DNA Sequence Number=SeqID_42058
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMHHPQADPPTSPRVPHGRPVCAAGHTAPERRAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133744 - protein, 91 aa, Glycine max
  Coding DNA Sequence Number=SeqID_42059
MGDQEGTQEQMKANMSASKEKMASMMEAMLGMRKLMEKNVATAAAVNSAAEADPTLLATAHHPPPNAVGRERSTLGHSSNPHLGYNRAAYP

SEQ ID NO: 133745 - protein, 117 aa, Glycine max
  Coding DNA Sequence Number=SeqID_42060
  Subcellular localization annotation: CTP_CleavageSite=37; ConfidenceScore=5.01e-01
MTQCVDGSRAKFGQFCSPRRYLTVIRTPLPFRHSRVRWQAETKFGHSAPMIRGDTLWLFAPLLSSRGGGPDDKQRPKFGHSAPMIRGDTLRLSAPLCHSDTVVSDGTQRPSLVILHP

SEQ ID NO: 133746 - protein, 125 aa, Glycine max
  Coding DNA Sequence Number=SeqID_42061
  Homolog annotation: Hit_ID=UPI0000ECBAF8; Match level="QueryCoverage =47%, HitCoverage=69%, E-value=9e-20, Identity=81%"; Hit description =UPI0000ECBAF8 related cluster
MKHFTDTLISANISGRHRGGAPIRPIVSRITIHWPSFYNVVTGKTLALPNLIALQHIPLSPAGVIAKRPAPIALPNSCAALNGEWDAPCSGALSAAGVVVTRSVTATLASADVRRCFCRYAPLRQ

SEQ ID NO: 133747 - protein, 97 aa, Glycine max
  Coding DNA Sequence Number=SeqID_42062
MGKLDHLEERLRAIEGGEDYAFANLKELFLVPNIITPPKFKVLDFDKYKGTTCPENHLKMGAYAKGCNYRTCAKRGHKSFKEYAQRWRDLAAQVAPQ

SEQ ID NO: 133748 - protein, 265 aa, Glycine max
  Coding DNA Sequence Number=SeqID_42063
MVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVARLIADAIYIFAGMAPTRHPLDPDKSNRALGFLALITGLCQSFGVPVAPTKVIRPPITRAFYLRSTVPRDRLRVMLHRPQARPHHLIRRARLGHLTWSNESLARRARGFAPFSCPYSRPVQGRGLHGPEICPEAQAGEASPEAPGDGEDVHEDEEMADLLDFLGGSGDT

SEQ ID NO: 133749 - protein, 149 aa, Glycine max
  Coding DNA Sequence Number=SeqID_42064
  Homolog annotation: Hit_ID=A1IW39; Match level="QueryCoverage=46%, HitCoverage=98%, E-value=1e-17, Identity=69%"; Hit description =Putative uncharacterized protein ophh-69
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGGPGRLFTKNTGLRKVVRPCMGADACPVPE

SEQ ID NO: 133750 - protein, 80 aa, Glycine max
  Coding DNA Sequence Number=SeqID_42065
  Homolog annotation: Hit_ID=Q2A9Z4; Match level="QueryCoverage=65%, HitCoverage=8%, E-value=3e-08, Identity=63%"; Hit description=Zinc knuckle family protein
MVLGKPWSLTTSLKNSFEMWEMWEASSTLWHGIKRAILLNLSTTTKIESTPLWVLGSPRTKSILMSTQGAEGIGKGVYSP

SEQ ID NO: 133751 - protein, 74 aa, Glycine max
  Coding DNA Sequence Number=SeqID_42066
  Gene Ontology: Mol. function=structural constituent of ribosome; Cellular component=ribonucleoprotein complex; Biological process =translation
  Homolog annotation: Hit_ID=Q2PMT2; Match level="QueryCoverage=70%, HitCoverage=22%, E-value=6e-14, Identity=81%"; Hit description =Chloroplast 30S ribosomal protein S2
MGNPKMHISDISQRIATKDRGVNSFPKRDAAILKRHLAHLKYLGGIKKYMTGLPDIVIIVDQQEEKLIRLFENV

SEQ ID NO: 133752 - protein, 16 aa, Glycine max
  Coding DNA Sequence Number=SeqID_42067
EEKITKRLAFPHAWRQ

SEQ ID NO: 133753 - protein, 63 aa, Glycine max
  Coding DNA Sequence Number=SeqID_42068
MENWRTSLGNEFAGSRLDGGGHMNSARQQIHGAPKKSGEWRIGEQRYAITSRGSRLVGGGRMN

SEQ ID NO: 133754 - protein, 52 aa, Glycine max
  Coding DNA Sequence Number=SeqID_42069
MVHDIFVKVKLEVTRTLTVLNMFGSRRSSNKWVYDPNMVGSWYLTHATKNAS

SEQ ID NO: 133755 - protein, 34 aa, Glycine max
  Coding DNA Sequence Number=SeqID_42070
METIVPVPRAVDIDYSQIFLKNFVLVLKECGALC

SEQ ID NO: 133756 - protein, 42 aa, Glycine max
  Coding DNA Sequence Number=SeqID_42071
MCAQEMALKKLSTKRSRKDAAVEGSSATPEFDSHRFRSTEHQ

SEQ ID NO: 133757 - protein, 186 aa, Glycine max
  Coding DNA Sequence Number=SeqID_42072
  Homolog annotation: Hit_ID=Q6WAY6; Match level="QueryCoverage=83%, HitCoverage=30%, E-value=1e-10, Identity=30%"; Hit description =Putative uncharacterized protein
KGGADWDRLLANKEGASVNWFPRWKEGRTRVLISCEGFPNVPLIGTRGCISYNPVLAIRQLGYPMRGVRKAREVVQKMDKELRGSNNGPIGGYRKWLKAHVQGLDWLPSLRTAKREEVEAPEEDEEVHALRAELEQAQTVKERFKSAALKIRKKNAKLRDINIATTKALEQETKRAHREEHGRNKF

SEQ ID NO: 133758 - protein, 154 aa, Glycine max
  Coding DNA Sequence Number=SeqID_42073
  Homolog annotation: Hit_ID=A5AN95; Match level="QueryCoverage=88%, HitCoverage=14%, E-value=3e-11, Identity=31%"; Hit description =Putative uncharacterized protein
MVLVLRGMHPDFDHIRDQVLIGKEVPFLENLITRLLRVPSQKIGGNSVNSIETSAMVSNRVGRGGMETEEDKLKEEVALNVLTSETSEIKFLKADYQEYLQLKAAKESQTSSSISGHNSIACIAQSSNNQSPWMIDSELQQQESAMYHPLLLCL

SEQ ID NO: 133759 - protein, 59 aa, Glycine max
  Coding DNA Sequence Number=SeqID_42074
MKRCMMRSRKPDMGLPVTMHHQKRKTLDEASLLSSESETQHGHRSTSTPYGSHKPGYRA

SEQ ID NO: 133760 - protein, 81 aa, Glycine max
  Coding DNA Sequence Number=SeqID_42075
  Subcellular localization annotation: CTP_CleavageSite=61; ConfidenceScore=5.23e-01
MYQLGSRPQDTQWTRRSPTGPWVSSSGYGPLSVLQGARPPQDRACKTPSGPGEVQQGLGVSSSDYGPLSVLRSVCRPQQGH

SEQ ID NO: 133761 - protein, 102 aa, Glycine max
  Coding DNA Sequence Number=SeqID_42076
MEKSEKKNHSEKKLKKAYITWDENDLESSDDSENEEINLCLMAKSYESDEEVSLRKKWYIDSGCSKHMTGDASNFTYISPKKSGHALNTACLALVNYVTKAI

SEQ ID NO: 133762 - protein, 103 aa, Glycine max
  Coding DNA Sequence Number=SeqID_42077
AINSWGSGLDGGGCMNDIQFMRLRIRFDGGGRMNSARQSICGAPDSMVEDLLEINSWGSGLDGGGCMNDNQFMGLQIRFDGGGRTNSARQSLRGAPDSMVEDA

SEQ ID NO: 133763 - protein, 69 aa, Glycine max
  Coding DNA Sequence Number=SeqID_42078
MAFLEVVEVALKFEHYLHYWSCVLNSNRYRLVYTVNNRFFLKDNILYVLFLPKLNFLKKSRISRLEKGS

SEQ ID NO: 133764 - protein, 123 aa, Glycine max
  Coding DNA Sequence Number=SeqID_42079
  Homolog annotation: Hit_ID=Q84VH5; Match level="QueryCoverage=61%, HitCoverage=11%, E-value=3e-32, Identity=96%"; Hit description =Envelope-like protein
MKRESPLSLHYKLFEGTHVPDIVSTLGKAASGAVSKDALIAELKDTCKVLEATIKATTEKKMELERLIKRLSESGIDDGEAAEQEDEAAEEEVEAAEEEEEAAEEEEDAAEATESDDDSEATP

SEQ ID NO: 133765 - protein, 93 aa, Glycine max
  Coding DNA Sequence Number=SeqID_42080
MPAFSTKIPSITEENEVDEVYANCNDHDEGLWENTHMIMGTPPRSPPHSDGHSEPTSRKSKQSTRLRRLTLRTLHQQRPTVNVDPTIGRGSGP

SEQ ID NO: 133766 - protein, 74 aa, Glycine max
  Coding DNA Sequence Number=SeqID_42081
MLCNLTDYVIMPLLPSGTLRNFTDCALTPFNFQHVTKLHGLCYNAFLLASGMSRNFTNCLTMGAKYIEVVKRGL

SEQ ID NO: 133767 - protein, 123 aa, Glycine max
  Coding DNA Sequence Number=SeqID_42082
MCGISCQCQDLHAILLKFQPAPYQLDLAPYASEPYNAQWNAPGLLRDKHTLRLSRILGKMEVDEPWLGLWLPLNYQVDMGAMRKTDFVVVLGMAFVDNWAVGKEKVGYWLSNDIVGLVGNLAV

SEQ ID NO: 133768 - protein, 148 aa, Glycine max
  Coding DNA Sequence Number=SeqID_42083
MAPKKLSTKRSRRDATGEGSSVIPEEKRVQLKEDEYTDFQEEIACRRWTPLVTPMAKFDPEIVLEFYANAWPTEEGVRDMRSWVRGQWIPFDADALSQFLGDPLVLEEGQQCEFSQRRNRANGFDEEAIAQLLCIPGQDFARTIVGRQ

SEQ ID NO: 133769 - protein, 132 aa, Glycine max
  Coding DNA Sequence Number=SeqID_42084
  Gene Ontology: Mol. function=RNA-directed DNA polymerase activity; Biological process=regulation of transcription, DNA-dependent
  Homolog annotation: Hit_ID=A5BNN5; Match level="QueryCoverage=99%, HitCoverage=64%, E-value=9e-27, Identity=42%"; Hit description =Putative uncharacterized protein
MEYNIMNTLQHMTMVATAYQTSHECSKETIIDILVAGFSEQLKAEHFIRDPSLWKDRCAELLSNLKCRTLADFRWYKDTFLTWVYTREDSQQPFWKEKFLASLPRSLGDKVRDKICSRFANGGISYESLSYG

SEQ ID NO: 133770 - protein, 168 aa, Glycine max
  Coding DNA Sequence Number=SeqID_42085
  Homolog annotation: Hit_ID=Q57R09; Match level="QueryCoverage=57%, HitCoverage=41%, E-value=7e-19, Identity=45%"; Hit description =Putative uncharacterized protein
MTQQAVADALFRRGETLAIPRNGGAREIERVALRVHHDLHRVGVESLFGALDRHCQRRHAGLAACQIISHLTHDHRRDQRFVALHVNDDLIVGKAVVRDHFRQTLGAGMVIRAGHAHFAAGGFHRFGDFRVIGRHDDAAGAGLAGALHHVHHHRLAVNIGQRFARQTG

SEQ ID NO: 133771 - protein, 115 aa, Glycine max
  Coding DNA Sequence Number=SeqID_42086
MSANQRSTAPPFKEEFATVLRMTHSLNDAQPVPATPASFCNPTNCNIGCDDVVQNQKNENETPPATQNSKPKRGRPFKTPPESIKNWYVIRKERKIANRFDTVNITHSGHRDLFF

SEQ ID NO: 133772 - protein, 118 aa, Glycine max
  Coding DNA Sequence Number=SeqID_42087
MTRGYPGDLQPFDPEIDRTFHRLVRHSVHPGHSVHFEYFEHSEYSVVGDFEYSDFEHSTTNFHTENMAQPPPRERTLREMAALDFTYESLCIQYPDEGVPYVLKTGLIHLMPKFHGLA

SEQ ID NO: 133773 - protein, 199 aa, Glycine max
  Coding DNA Sequence Number=SeqID_42088
  Gene Ontology: Mol. function=oxidoreductase activity; Biological process=metabolic process
  Homolog annotation: Hit_ID=A2WG93; Match level="QueryCoverage=55%, HitCoverage=44%, E-value=5e-37, Identity=63%"; Hit description =Retinol dehydrogenase
RRRWHASQAYAESKLHDAILAFAIARRWPQVYSNALEPGWVPTKMGGAGAPDDLDQAHRTQVWLATADEARVSGEYFYHRQALAANPQARNPRLQQQLLAICADISDAAVSAHYGGSVFSPPGCPCMLPVKAVLLSFLCVVLLSLAASLAQATRSGEFTTERGGWATARRDSAGLAPDPQRFASEAIVQVYAAPTYGWK

SEQ ID NO: 133774 - protein, 95 aa, Glycine max
  Coding DNA Sequence Number=SeqID_42089
KTPSEPEEVQQGPGVSSSGYGPLSVLQGARTPPARSRHHRDRDCKTPSGPEEVQQGLGIFYGVPVTSSKGIRPPTNRAFIKKYCAPKRAQGETPQ

SEQ ID NO: 133775 - protein, 83 aa, Glycine max
  Coding DNA Sequence Number=SeqID_42090
MASYGGEHDEDMTKSKGKDPLEGLGGRMTRARARKAKEALQQVLSILLEYKPKFQGEKSKGPTGNLGISLLGDQMVADLLAVG

SEQ ID NO: 133776 - protein, 425 aa, Glycine max
  Coding DNA Sequence Number=SeqID_42091
  Gene Ontology: Mol. function=fructose-6-phosphate phosphoketolase activity; Cellular component=cytosol; Biological process=metabolic process
  Homolog annotation: Hit_ID=A1UGS3; Match level="QueryCoverage=97%, HitCoverage=50%, E-value=0.0, Identity=76%"; Hit description =Fructose-6-phosphate phosphoketolase
  Pfam annotation: Domain name=XFP; Domain location=55-231; Score =429.6; E_value=4.6e-126; Accession=PF03894.6; Description=D-xylulose 5-phosphateD-fructose 6-phosphate phosphoketolase
  Pfam annotation: Domain name=XFP_C; Domain location=242-424; Score =310.5; E_value=3.1e-90; Accession=PF09363.1; Description=XFP C -terminal domain
  Pfam module annotation: Pfam domain module=XFP::XFP_C; Domain location=55-231::242-424
VDSRGSPGLAPRTGKAIGSNPHANGGLLIRELDLPEVDQYAVPVGSPGAMTAEATKVLGAYLRDVIDLNPNNFRLMGPDETASNRLSTVYERTDKVWLERSETTDEHLGPEGRVMEVLSEHLCQGWLEGYLLTGRHGLFNCYEAFAHIVDSMLNQHAKWLSSSTEVPWRQPIASLNYLLTSHVWRQDHNGASHQDPGFIDHVANKRPEVVRVYLPPDANTLLAVTDHCLRSRHCVNVVVAGKQPALTYLSMEAARAHCARGLGIWDWASNAPNEPDVVLACAGDVPTLETLAAADILRRRLPELAVRVVNIVDIMRLQPASEHPHGLPHSDFDALFTPDKPIIFAYHGYPWLIHRLAYRHTNHDRMHVRGFKDRGTTTTPFDMVMLNDLDRFHLVMDVIDRVEGSGQPSRKPTAGNGRRPEIAAC

SEQ ID NO: 133777 - protein, 126 aa, Glycine max
  Coding DNA Sequence Number=SeqID_42092
  Subcellular localization annotation: CTP_CleavageSite=44; ConfidenceScore=5.39e-01
MLLPSAVHVSSTFEFGAVFHDCLSADPQGNPPFSTLFRSPMNCVFVHVSSTFKFGVMRSDCLVQFSILNPFSEPHECHCLALFMCPPLSSAKPLKKKRRSRDESRHHGKGRTDEISVLSLLSSYLR

SEQ ID NO: 133778 - protein, 44 aa, Glycine max
  Coding DNA Sequence Number=SeqID_42093
MGSSMEPQEKTITCFPSWIKCLRDLQGNPSTVSWTHTQVTIRLQ

SEQ ID NO: 133779 - protein, 189 aa, Glycine max
  Coding DNA Sequence Number=SeqID_42094
MPSPLEDYTSSPSEDYTSSPSEDSTSSPSEGCTPSLSKGYMPSPSEGYMPSPSKDYTSSPSEGCMPSPSEDYTSSPSEDYTSSPSEDSTSSPSEGYTHWATGRGALSTTFGSPIHECLYRFSLSQQGQGVAPFVSPTPEQFGTEVTWPGGWPDAQAGEEPAGSPSEADESHMDEDMTDLLGFLGGSGAT

SEQ ID NO: 133780 - protein, 113 aa, Glycine max
  Coding DNA Sequence Number=SeqID_42095
VPMNPKRIKVIPEWPTPPTPLIELVRNHVPSWEDAQEMGVEGRSPEYEEPWDLRSNPFQGGGNDAILSRKGISSSFFRNLLKEGCRNLSFGGRATRDSRDACSTKGIRAESPP

SEQ ID NO: 133781 - protein, 476 aa, Glycine max
  Coding DNA Sequence Number=SeqID_42096
  Gene Ontology: Mol. function=sigma factor antagonist activity; Cellular component=periplasmic space; Biological process=alginic acid biosynthetic process
  Homolog annotation: Hit_ID=A8GI30; Match level="QueryCoverage=63%, HitCoverage=94%, E-value=1e-147, Identity=88%"; Hit description =Sigma E regulatory protein, MucB/RseB precursor
  Pfam annotation: Domain name=MucB_RseB; Domain location=154-458; Score=508.4; E_value=8.6e-150; Accession=PF03888.5; Description =MucBRseB family
  Pfam annotation: Domain name=RseA_C; Domain location=71-140; Score =62.1; E_value=1.8e-15; Accession=PF03873.4; Description=Anti sigma-E protein RseA, C-terminal domain
  Pfam module annotation: Pfam domain module=MucB_RseB::RseA_C; Domain location=154-458::71-140
AALEKEPARLVPSAVQESQPQPHTWQKMPFWDKVRPWASQITQIGMAACVSLAVIVGVQQYNQPSAPSNASESPAFTTLPIMGQASPVSLGVPADSFSTGSGQQQQVQEQRKRINAMLQDYELQRRLHSDQLQLEQGNPQQAAIQVPGTQSLGMQQHLLYSSIAPAQPTASGALLQQMSSASRSLNYELAYISISKQGIESLRYRHAVIGNVPLGQLLHMDGPRREVLQRGGGISYFEPGLEPFTLTGDHIVDALPAIVYADFTRLAKYYDFISVGSTRIADRPCEVLRVVARDGSRYSYIVWMDEDTKLPLRVDLLDRDGETLEQYRVISFAVGADVQGAMQGLLKANLPPLLSLPAVENVKLSWSTGWLPAGVDEVARNRRKLPNVAVPVESRLYSDGLFSLSVNVSPAGSGAGQQYYRQGRRTIQTEVRAGNEITIVGELPPGTAKRIADSISFKGVALLRCEPKAGCGSCTA

SEQ ID NO: 133782 - protein, 235 aa, Glycine max
  Coding DNA Sequence Number=SeqID_42097
  Homolog annotation: Hit_ID=A5BSR3; Match level="QueryCoverage=49%, HitCoverage=37%, E-value=7e-11, Identity=35%"; Hit description =Putative uncharacterized protein
MQEIQKNNDCPHLLSRGGYDLLEKKLLDEKIKKRQHDALMTENPALIEDLPSPIQRHVKWKMARTNRYGMMTSKAARQIADKIDSLKEQVTQGEFVPQGRQDILNTTIGIPDHGGRVRAAGSGVTISQYYGRTSRASTTSSISFTKEQLVEIVVTIREQVRNEIEEEKKRSLHAWKNELKDAIITDIFNGDKVSAPANFDLNVLGARVSTKESNAEIVVNPSGEEHVGRVTPPMG

SEQ ID NO: 133783 - protein, 85 aa, Glycine max
  Coding DNA Sequence Number=SeqID_42098
LLKEGAQSIKNLGIRGQILSKGEGMMQSYPPRVLDRRLQKDWARAAKEGPRVLMNLRMNGSGMEKEEREETPLQGEDESRRSSPP

SEQ ID NO: 133784 - protein, 68 aa, Glycine max
  Coding DNA Sequence Number=SeqID_42099
MAYAPLGNSTKFQTPLLMIFFMNGFLCFLEDEWQRKEKEEREETPLQGEDESRRSSTPYEAMDKSLEE

SEQ ID NO: 133785 - protein, 74 aa, Glycine max
  Coding DNA Sequence Number=SeqID_42100
MKPCFYMFFHHLCLPLNVCGLCRQVGGCKHATAVGHTAQPRDIGLAIGRAGRGWSRSLGGLPLDGGGRSRLCGC

SEQ ID NO: 133786 - protein, 44 aa, Glycine max
  Coding DNA Sequence Number=SeqID_42101
MAVISLGKIYQPPFPKWYNPDATCAYHGKIPGHSTEKCLALKYK

SEQ ID NO: 133787 - protein, 138 aa, Glycine max
  Coding DNA Sequence Number=SeqID_42102
MTQELVARGDTLRLSAPRHSVTPSVIDERRPMWSSVPFPEMSAFSDGDFSSLTKAAGPMIRGDTLRLFAPFCHPEASRDQVWSFCTLVSSRGGGPDDTRRYLTVIRTLLSSRGGGPDDKQRPSLVILHPCIIQRRRAR

SEQ ID NO: 133788 - protein, 93 aa, Glycine max
  Coding DNA Sequence Number=SeqID_42103
MDTRVTISYCSTARKDSLLTLCFVSHEIHSGYVSALSKIVIYLMALNIMLTGSHPGHAEYGIHFLKVIQSADNISTGSEMCDKMRRLRILCCN

SEQ ID NO: 133789 - protein, 72 aa, Glycine max
  Coding DNA Sequence Number=SeqID_42104
  Homolog annotation: Hit_ID=Q4A3R5; Match level="QueryCoverage=70%, HitCoverage=79%, E-value=3e-08, Identity=61%"; Hit description =Capsule O-acetyl transferase
MPSKVILMMPKNQELSKDSRIKFQVSSFKIQDSSFKFQDSRFKFQDLRIKFQRSRFKTQDSRIKRRLNQDKY

SEQ ID NO: 133790 - protein, 124 aa, Glycine max
  Coding DNA Sequence Number=SeqID_42105
MERSMIDAASGGALGDMTPAEARNLIEKMDSKSLQFSARNDAIVIRGVHEVATNSSSSGETKKLEVYAANIYNRPPQPQQQNQPQQNNYDLSNNRPYVPPPIQQQQQQQPNKQQTVDDAILPRK

SEQ ID NO: 133791 - protein, 182 aa, Glycine max
  Coding DNA Sequence Number=SeqID_42106
  Homolog annotation: Hit_ID=Q6WAY6; Match level="QueryCoverage=57%, HitCoverage=18%, E-value=3e-13, Identity=35%"; Hit description =Putative uncharacterized protein
MKESPSSKVRVREGRDSPKEKFKSAATHIRKECTRCTNCLLFTRSCVWLVSHLFQQDTRHPCPLQSYRSCAEKGRVDWDQHLAGIGGNAINWFPRWKKGKEGVLFSCGDYPNVPLIGTRGCINYNPALAIRQLGYPMRGAPTEESLSPFLVRDLGAQSLKVIQRVHKAWRSPLKKDKELRGI

SEQ ID NO: 133792 - protein, 148 aa, Glycine max
  Coding DNA Sequence Number=SeqID_42107
MTLLLSNILPNDHNADLPLRKYQLGSRPQDTQWTRRSPTGPRGFQLWLWAFVSPTGCPSPQQGIAPARHPVDPKKSNRVLGFASLITGLCQFYGVSIAPSKVIRPPINRTFIEKYCAPKQAHGKASQQWATGAPPPPLEFTSAHPQKG

SEQ ID NO: 133793 - protein, 37 aa, Glycine max
  Coding DNA Sequence Number=SeqID_42108
GVMAGRNGRAIADALPALAQAIGNPNRREAGGVVEYR

SEQ ID NO: 133794 - protein, 135 aa, Glycine max
  Coding DNA Sequence Number=SeqID_42109
  Homolog annotation: Hit_ID=Q5XM22; Match level="QueryCoverage=93%, HitCoverage=85%, E-value=8e-29, Identity=47%"; Hit description =Resistance-like protein HAAS-2
MVSPESARVETVQCRGPYVRLQWVHDIYQRRCQAGHWTVAAHVYLLHLLGCTLFANKSATNVHVVYLQALGDLSMTERYAWGVAALVYMYDHLNDASMSHSRQLGGYITLLQCWIYEHFPSVAESTADQDYGEAS

SEQ ID NO: 133795 - protein, 114 aa, Glycine max
  Coding DNA Sequence Number=SeqID_42110
MVSTESVITNLNWCLLGLLLFAGFADIVAGQFEPGLLVDVIGVVEEVVFRQVSGKGRRVVFKLNDLSQQLLSCTLWDDYCLQFLKFLDDYEGDGPITVLLTHGRIKEAQGISLS

SEQ ID NO: 133796 - protein, 75 aa, Glycine max
  Coding DNA Sequence Number=SeqID_42111
MSKARQKGVRKENRGGACHPARPGEPGCFLQKQPPSGGIFWKAQVGLKLTDCVTILPFDFRHVMEFHGLRNNASF

SEQ ID NO: 133797 - protein, 98 aa, Glycine max
  Coding DNA Sequence Number=SeqID_42112
KWPRGSLPQKRSRKDKTAEGTSSAPEYDSHRFRSAVVATYPSAGGRRVTRGMRVPRKEYARSRHQRLFEENVGKTGKDVIYELLSERFGSCIYARGRY

SEQ ID NO: 133798 - protein, 94 aa, Glycine max
  Coding DNA Sequence Number=SeqID_42113
MAYTHIPVKVENPGEIYTQFSSNFSQHQLDLAPYTSEPYNAQWNAPGLLRDKHTLRSSRILGEMEVDEPWLGLWLPLNYQVVFVIGSAVDRLCG

SEQ ID NO: 133799 - protein, 209 aa, Glycine max
  Coding DNA Sequence Number=SeqID_42114
MRGCINYNPALSIRQLGYPMRGSPTKESLSPFLVRDFGVQNFKVIQSVHKAWETPLRKDKELRGIRNGIIGGYHEWLKVRTRDVRKECAGLREENAATARALEQETKRARKEEHGRDKFRGALWGSNSELKLRREERDQSRAHSMVFKEELAACSRSKRSLSQRLCETETNMLAIVSKYQEELSLATAYEHKVADEYARVFTEKEARGK

SEQ ID NO: 133800 - protein, 178 aa, Glycine max
  Coding DNA Sequence Number=SeqID_42115
  Homolog annotation: Hit_ID=Q2AA09; Match level="QueryCoverage=37%, HitCoverage=24%, E-value=9e-08, Identity=43%"; Hit description =Retrotransposon gag protein
  Pfam annotation: Domain name=Retrotrans_gag; Domain location=87-178; Score=25.8; E_value=0.00016; Accession=PF03732.8; Description =Retrotransposon gag protein
MQRRPFAGVLIPIDLEINATCRKRNAERNRMFLQDIEAAAIQEEPLSSEASSRFSKQGESHIVLFEANIMADEPRNPLKITLAQVYRSSLLALCGRREAKRWLHSFKGNNVKTWDEVVEKFLKKYFPESKTIEGKTAISSFHQFLDESLSEALERFCGLLSLLMDFQNESSSIFSLTG

SEQ ID NO: 133801 - protein, 85 aa, Glycine max
  Coding DNA Sequence Number=SeqID_42116
  Homolog annotation: Hit_ID=Q9KHC4; Match level="QueryCoverage=52%, HitCoverage=9%, E-value=7e-08, Identity=64%"; Hit description=SocE
MCHLAKPIHHHKDKVYTPLGPRKPKDKVHTYIYPSRETCRASCINESANARGEAVCVLGALPLPRSLTRCARSFGCGERYQLTHR

SEQ ID NO: 133802 - protein, 118 aa, Glycine max
  Coding DNA Sequence Number=SeqID_42117
MTKLKKTLSPKTKAVAPKWIEVKSHVQTDCYECGYYIMHWIWNIITSDIKSDWSMQQFSAAIVPPSLPLQQLSEQMKCPQSLDGCLVEMILSFDLAFALIPLLKFSSSKVTSSTSIEE

SEQ ID NO: 133803 - protein, 107 aa, Glycine max
  Coding DNA Sequence Number=SeqID_42118
MENESSEATILEPFDIGEEAEETQVRQVAATTLERSLEATSEPSAPVVNLPSPQPAVDPSNPLLQMLEDPTTPVLAVDTSPPTTPVLQLTDERDGQTQDTQDQSQEF

SEQ ID NO: 133804 - protein, 268 aa, Glycine max
  Coding DNA Sequence Number=SeqID_42119
EAIAHLLCIPGQDFARTAAGRRVRIMHTNMTTLTQIWMTLLLSNIQPSDHNSDLPLPKCQLVYAILTRMSIHVAQLIADAIYLFAGMAPTRHPLDPDKSNRALGFPALITGLCQLFGVPVAPSKVIRSPITRAFIEKYCAQRQAQGDAPQATDAPPPHQAGPAGSFDTEQYLRHLVRQQAANHRAHVQTHDCLYQMSLSLQSQGFTSFPCPTPNQFRAEVAWPGDWPEARAGEAPAVAPAEAPDKENEAREDEEMTDLLDFLGGSGAT

SEQ ID NO: 133805 - protein, 194 aa, Glycine max
  Coding DNA Sequence Number=SeqID_42120
  Homolog annotation: Hit_ID=Q6UUU1; Match level="QueryCoverage=30%, HitCoverage=40%, E-value=2e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133806 - protein, 57 aa, Glycine max
  Coding DNA Sequence Number=SeqID_42121
MSASDHVILRDKTHQPTKKSLIELSSHDGLLAQNKFLSKQLEILTKTLGYRVPSSNS

SEQ ID NO: 133807 - protein, 137 aa, Glycine max
  Coding DNA Sequence Number=SeqID_42122
LQGVPFVVELTILAAVSPMKNQLMKSIIWGTSQGKISMHVDIPGFNMASHIIHSRDSGGITLLADRPSSSFSANTEKNLKEECKVVMTRSRMTVQANEGRAEEKEEGYKQQSAAEPALELVSDFVELEEVVEDEDDQ

SEQ ID NO: 133808 - protein, 220 aa, Glycine max
  Coding DNA Sequence Number=SeqID_42123
  Gene Ontology: Mol. function=protein binding; Cellular component =cytoplasm; Biological process=iron-sulfur cluster assembly
  Homolog annotation: Hit_ID=A4W9R2; Match level="QueryCoverage=58%, HitCoverage=30%, E-value=2e-65, Identity=93%"; Hit description=FeS assembly protein SufD
  Pfam annotation: Domain name=UPF0051; Domain location=1-119; Score =35.9; E_value=3e-10; Accession=PF01458.8; Description=Uncharacterized protein family (UPF0051)
MPVKSEVCDTRTWLEHNKGYCNSRQLHKTIVSDKGRAVFNGLINVAQHAIKTDGQMTNNNLLLGRLAEVDTKPQLEIYADDVKCSHGATVGRIDDEQMFYLRSRGIDQQAAQKMIIYAFAAELTEALHDVNGLPLAYLDSAASAQKPNQVVDAEAEFYRHGYAAVHRGIHTLSAEATQRMENVRTQVAAFLNARSPEELVFVRGTTEGINLVANSWGNAQ

SEQ ID NO: 133809 - protein, 73 aa, Glycine max
  Coding DNA Sequence Number=SeqID_42124
MDQAGEERKLQLSELDEIRLEKPTRMPIEIKSDSTNKSFKVNGHRLKPFLTNPSLVDVVVEETSLLHPTLPPP

SEQ ID NO: 133810 - protein, 73 aa, Glycine max
  Coding DNA Sequence Number=SeqID_42125
MVMSFFLTQLLLEVASPIIFLPSPFRFHDLQEAKDSIDEEDPRPTSSTWSYIMWYQEHLHLGSIIFSFIIFLC

SEQ ID NO: 133811 - protein, 223 aa, Glycine max
  Coding DNA Sequence Number=SeqID_42126
KKKKDSKALSSKAKGKETEEKDSSKKIVKKENYFTTKGDIKIALLLKKSFYLLLSRETSLSTAIPLELEVIPQVKELLDEGITRHQIPMIGGMMNMLSGTTLFCKITHAPNIFMVCVHRDSLGSDQGLPMDPKRIKVIPEWPTPPTPLIELVRNYVLLWEDGQEKGFQSLPYSKLPNITNTYVFTPLTCDEERINEFQQPLDLRSNPFQGGGSDAILPPKGIG

SEQ ID NO: 133812 - protein, 51 aa, Glycine max
  Coding DNA Sequence Number=SeqID_42127
MDPKRIKVIPEWPTPPSVEERINEFQEPWDLRSNPFQGGGNDAILPRKGIG

SEQ ID NO: 133813 - protein, 69 aa, Glycine max
  Coding DNA Sequence Number=SeqID_42128
MAFVDNWVVGKEEVCYWLSNDIVGMTKFALGQTHIDPFTGKDQILKALKVLHLWAYSLKDLCPLFAHVL

SEQ ID NO: 133814 - protein, 126 aa, Glycine max
  Coding DNA Sequence Number=SeqID_42129
METFQVSQVIQNYVGHVTCTLVSSRGGGPDDTRRYLTETKFGHSAPLYHPEAAGPMIRGDTLRLFAPFCHPEAAGPMTSRDQIWSFYTLVSSRGGGPDDTRKYLTVIRTLVSSRGGGPDDTRKYPS

SEQ ID NO: 133815 - protein, 58 aa, Glycine max
  Coding DNA Sequence Number=SeqID_42130
MSIIVFCIQFLNNNGMMSNRKCSIGVIRLKAQVEKDEGPSGEGQSPRVEKDEGPSGEG

SEQ ID NO: 133816 - protein, 62 aa, Glycine max
  Coding DNA Sequence Number=SeqID_42131
MAVDYGGTDHPTHDGNQGIGNNRTHRNSPACTARELKNSWPEKPAVTRERDAQQMTAPHRVG

SEQ ID NO: 133817 - protein, 268 aa, Glycine max
  Coding DNA Sequence Number=SeqID_42132
  Homolog annotation: Hit_ID=Q6UUU1; Match level="QueryCoverage=22%, HitCoverage=40%, E-value=3e-18, Identity=78%"; Hit description =Putative uncharacterized protein
RRRTTGAPPARIDGGWQEILDLMADQGRRPDPLLTRAETAARLDAEIPAMGAPLLASRADRAVFGPDDLAEDVAEEYWTHVMAARRSMSAAEAGAGTRAGPGTGRAARGDAAPRTLVPARHCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 133818 - protein, 245 aa, Glycine max
  Coding DNA Sequence Number=SeqID_42133
  Homolog annotation: Hit_ID=Q5NRP4; Match level="QueryCoverage=38%, HitCoverage=6%, E-value=7e-07, Identity=35%"; Hit description =Putative gag-pol polyprotein, identical
  Pfam annotation: Domain name=zf-CCHC; Domain location=132-149; Score =8.0; E_value=0.095; Accession=PF00098.14; Description=Zinc knuckle
MKREKYVSYSSHNSCKSLSKELRDYYEGRHRSHLRPHSHRREKERKPQEANINLPYFHGKDNVEANLVWEIRVEQQLKKKSTSKSYGSHSYPKKDHGRGILGVTPSKPKDDKGKTIEKQVPKVSMQEKTSSIKCFKCLGKGYITSQCPTTKTMIMRGQDIYSSQDKATTSPSFSESEKAKGEESSEEIYPQEEGQPLVVKEKCKEALASIATPLGLEFIPQEKKLLDEGLLRKSLNPCALLGPIR

SEQ ID NO: 133819 - protein, 105 aa, Glycine max
  Coding DNA Sequence Number=SeqID_42134
MTRGSPGDLQPFDPEIDRTFHRLVRHSVHPDHSVHFEHSEYFVAGDSEYSDFEHSTTNFHNENMAQPPPHERTLRWMVAPDFTYESLCIQDWTNTFAGQVSWSCR

SEQ ID NO: 133820 - protein, 87 aa, Glycine max
  Coding DNA Sequence Number=SeqID_42135
MARTYSPLKVRACSPTKVKAHDPLTARTCSPLKLKVHDPLKARTCSPLKVKSSQGDRYKYPRVHPYEKARDRLIERAGHPKSTRFGH

SEQ ID NO: 133821 - protein, 63 aa, Glycine max
  Coding DNA Sequence Number=SeqID_42136
MAYQLATSRKITVSLTKKWYIDSGCSKHMTGDASDFTHISPKKSGHVLHMVTTIKVEFLEWVK

SEQ ID NO: 133822 - protein, 106 aa, Glycine max
  Coding DNA Sequence Number=SeqID_42137
MMNGDQWMYDIIISEEVDLNDENEDEGGVNEEEHVDCSDAFNTSQWVQLVAYEIGFVAVIMRSGINTGVVSIGVGIKVLLEEILTVGNVGVPLNFVRNQWLEAKVG

SEQ ID NO: 133823 - protein, 107 aa, Glycine max
  Coding DNA Sequence Number=SeqID_42138
MGLRIRFDGGGCTNSARQSIPGAPDLMAINSWGSGLDGGGFMNGNQFMGLRIRFDGGGCTNSARQSIRGAPDLMAINSWDSGFDGGGCMNSARQSIHGAPDLMVEDA

SEQ ID NO: 133824 - protein, 344 aa, Glycine max
  Coding DNA Sequence Number=SeqID_42139
MSSRGKKTISFLRVSPLFEQNCNCGQGFSKRFGPHKTDSERHSGPTTEVPRRQGEGYGQSRRLGPVYGYLAAIDAFLAYHHSKESPVERGVVLTNNPALAIRQLGYPMRGAPTEESMSPFLVRDFGAQNSKTIQRIHKAWETPLKKDQELRGIRNGIIGGYHEWLKVRIRGLDWLAKLKVVSEENFEAPEEDEEVQALKSELGKAKLAKEKFKLAATHVRKECAGLREENAITARALEQETKRARKEEYGRNKFRGALWGSDSELKLRREERDQSRAHSMVLKEELIACSRSKRSLSQRLCETEANMLAIIAKYQEELGLATAHEHRIADEYAQVYAEKEARGR

SEQ ID NO: 133825 - protein, 114 aa, Glycine max
  Coding DNA Sequence Number=SeqID_42140
  Gene Ontology: Mol. function=helicase activity; Biological process =viral genome replication
  Homolog annotation: Hit_ID=Q9FHV5; Match level="QueryCoverage=100%, HitCoverage=11%, E-value=1e-15, Identity=33%"; Hit description =Helicase
MYTIEFQKRGLPHVHLLLFLHPDNKYPSSDEIDQIISAEIPSQQDDLELFIRKYQAHINIEWCNQSTSIKYLFKYINKGYDRVIAILIDEDNDQTENGDTHNDEIKEYLDYRYC

SEQ ID NO: 133826 - protein, 43 aa, Glycine max
  Coding DNA Sequence Number=SeqID_42141
MSHSMTAEWRRKKDGWRRHFKEKMSQKEDHHHRKPSQNFTNYD

SEQ ID NO: 133827 - protein, 166 aa, Glycine max
  Coding DNA Sequence Number=SeqID_42142
  Subcellular localization annotation: CTP_CleavageSite=64; ConfidenceScore=5.18e-01
MVKVGTSYVPINVSFRQKLAQCASVSTGSIQDYLYSEVRKSFRSQIGVFIRRNSARFPFGKPVRCATVNEGQRAGESAGLFAITGVRRSVHTGLLCWVTERVFPVECVHVQEKKATVPVRICNTITIGLDPPRWRPLTDSLPRAAEFERKCLKDLLEEHRKILNRK

SEQ ID NO: 133828 - protein, 151 aa, Glycine max
  Coding DNA Sequence Number=SeqID_42143
  Gene Ontology: Mol. function=homoserine O-succinyltransferase activity; Cellular component=cytoplasm; Biological process =methionine biosynthetic process from homoserine via O-succinyl-L -homoserine and cystathionine
  Homolog annotation: Hit_ID=Q6D009; Match level="QueryCoverage=100%, HitCoverage=48%, E-value=1e-75, Identity=90%"; Hit description =Homoserine O-succinyltransferase
  Pfam annotation: Domain name=HTS; Domain location=2-150; Score=126.6; E_value=7.2e-35; Accession=PF04204.7; Description=Homoserine O -succinyltransferase
MPIRIPDELPAVNFLRNENVFVMTSSRASVQEIRPLKVLILNLMPKKIETENQFLRLLSNSPLQIDVQLLRIDSRESRNTPSEHLNNFYCNFDDIANDNFDGLIVTGAPLGLVDFNDVAYWPQIQRVLHWAKEHVTSTLFVCWAVQAALNI

SEQ ID NO: 133829 - protein, 64 aa, Glycine max
  Coding DNA Sequence Number=SeqID_42144
  Gene Ontology: Mol. function=RNA-directed DNA polymerase activity
  Homolog annotation: Hit_ID=Q2HSQ4; Match level="QueryCoverage=51%, HitCoverage=34%, E-value=1e-08, Identity=78%"; Hit description=RNA -directed DNA polymerase ; Zinc finger, CCHC-type; Peptidase aspartic, catalytic, putative
MARFLHGLNREIQDIVELHHYASVEDLIHQAIKDYGCIGVMGISLVLLLLVLLVRVKVNVMYSP

SEQ ID NO: 133830 - protein, 169 aa, Glycine max
  Coding DNA Sequence Number=SeqID_42145
MTLTIPELFLRPYQVIWDAIVFGVVNPDFPLYIKHEDLSEIAHGGQCLSISVLQLWILHLTETCMRVGNSDIYGFLEPQSIQRSGQSQFESESYIKSWMQSSQRDVYLGAYLNGAIKGLDDAPQPKSKASARWIVVKCNRQKGSTECGYYVMHWMSTIILGTFRNNWEA

SEQ ID NO: 133831 - protein, 99 aa, Glycine max
  Coding DNA Sequence Number=SeqID_42146
GAWETLEGNTRCRFWGTIRFTATSLVHPDEPVRTLQRTVEWILPTPTPYRLVEPVQVIEGDEDPLPEVDSPEDVMSASEADSTEDSGPGEMAISGGSSS

SEQ ID NO: 133832 - protein, 126 aa, Glycine max
  Coding DNA Sequence Number=SeqID_42147
  Gene Ontology: Mol. function=phosphoenolpyruvate carboxylase activity; Cellular component=cytoplasm; Biological process=carbon utilization by fixation of carbon dioxide
  Homolog annotation: Hit_ID=A6YM33; Match level="QueryCoverage=26%, HitCoverage=3%, E-value=4e-11, Identity=93%"; Hit description =Phosphoenolpyruvate carboxylase
MGTYSEWDEEKKLDFLTRELKGKRPLVPPSIEVRLLYIAKLYKLYIQASKEITLQKKMREKERERGRETERGRERRRVTNRDRRNERWSETDTARTSVKQYRNTARTSTNRRTPNGSPSRRWRSMD

SEQ ID NO: 133833 - protein, 113 aa, Glycine max
  Coding DNA Sequence Number=SeqID_42148
SFGVPVAPTKVIRPPITRAFIEKYCTQRQAANHRAHVRTHDCLYQMSLSMQSQGFAPFSCPTPDQFRAEVAWPGDWPEAQAGGTPPEAPGDGEEAHEDEEMADLLDFLGGSGD

SEQ ID NO: 133834 - protein, 41 aa, Glycine max
  Coding DNA Sequence Number=SeqID_42149
METTMMEATEWWCGSAGNGSDDNNGGMVVVATTMVERWNSR

SEQ ID NO: 133835 - protein, 161 aa, Glycine max
  Coding DNA Sequence Number=SeqID_42150
  Homolog annotation: Hit_ID=A0ST23; Match level="QueryCoverage=16%, HitCoverage=53%, E-value=1e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILEGVGKPVVPAALMNRPTRGERRFAYWALAECILAYYVGTDEGVSEVLHVAGEKRLH

SEQ ID NO: 133836 - protein, 120 aa, Glycine max
  Coding DNA Sequence Number=SeqID_42151
  Homolog annotation: Hit_ID=A5C5C1; Match level="QueryCoverage=69%, HitCoverage=10%, E-value=2e-17, Identity=54%"; Hit description =Putative uncharacterized protein
MTTLCKSKGRKSEHFHKDYLKCKSWFEKKSELNARRFLTIQTISPNEKFIFMGNEVKVPVKIVETYCLKRNTGHHLDLQETPYEKQAKHTKKGATRSTQLLEIVHTDICGPFDVSSFGKE

SEQ ID NO: 133837 - protein, 284 aa, Glycine max
  Coding DNA Sequence Number=SeqID_42152
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVPNPSTGIVMPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 133838 - protein, 58 aa, Glycine max
  Coding DNA Sequence Number=SeqID_42153
MARKGVLRKESMSSKNLWIRGQILFKGKGMIQSYPQGHWIEDSKKIGPKMQEKALGFS

SEQ ID NO: 133839 - protein, 141 aa, Glycine max
  Coding DNA Sequence Number=SeqID_42154
MIMRGQDIYSSQEETTSSLSSSGSEDEVRGEESGEEVYPHEEGDLLMVRRLLGGIMRHQIPMVGSMMNMLSGATLLCKITHAPNIFMICVHRDSLGSDQGLPMDPKRIKVIPEWPTPPSIRVPRVVFVLGFFSPCILGHLD

SEQ ID NO: 133840 - protein, 329 aa, Glycine max
  Coding DNA Sequence Number=SeqID_42155
  Gene Ontology: Mol. function=exonuclease activity; Biological process= DNA metabolic process
  Homolog annotation: Hit_ID=A8GAK4; Match level="QueryCoverage=98%, HitCoverage=79%, E-value=1e-112, Identity=62%"; Hit description =Nuclease SbcCD, D subunit
LIVLAGNHDSVATLNESRELLACLNTRVITSATPGGEQQVLTLQQRDGTPGALLCAIPYLRPRDILRSQAGQSGRDKQLSLLQAIEQHYQHCYAAAVAQREAMGSTLPIIATGHLTTVGVSKSDSVRDIYIGTLDAFPAQAFPPADYIALGHIHRAQRIADSDHIRYSGSPIALSFDELGREKSVFLLEFSTRLESVTPLVIPSFQPMQMLKGAMAEIEQQLTAFHTYEGDLPVWLDIEITTQEYLSDLQRRIEQLTDALPVEVLLVRRSRDQRQRSLARLENETLSELKVEEVFARRLALEEQLEDEQRAQLTQLFRSTLATLEDPGA

SEQ ID NO: 133841 - protein, 95 aa, Glycine max
  Coding DNA Sequence Number=SeqID_42156
MVVILPKEHLVVWFCSLHNRPDNYLKGIINSAIKGLDDASQPKSKASARWIVVKARTFRNNWEAYFNYPRPLEPERLKALWIQWAQIYLRVRDQA

SEQ ID NO: 133842 - protein, 75 aa, Glycine max
  Coding DNA Sequence Number=SeqID_42157
MASGNRLPRIAMAAQLIHDRVEMECLEGVWETFEGNARCRFRGTIRFTATSLVHPEKPARTLQCTVEWILPTPTP

SEQ ID NO: 133843 - protein, 228 aa, Glycine max
  Coding DNA Sequence Number=SeqID_42158
RGSEALEEDEEVQALRAELEQAQTVKERFKSAALKIRKENTELRDVNVATTKVLERETKRACREEHGRNKFRGALWGNNSELKLRREERDQSRVDSLILKDELKVCSKSKRNLSQRLCETEANMLAIASEYQEELNLATAHEQKVVDEYARVYAEKEAGGRVIDSLHQEATMWMDRFALTLNGSQELPRLLAKAKAMANTYSALEEIHRLLSYCQHMIDLMAHMIRNR

SEQ ID NO: 133844 - protein, 209 aa, Glycine max
  Coding DNA Sequence Number=SeqID_42159
  Homolog annotation: Hit_ID=UPI00006A2D9E; Match level="QueryCoverage =99%, HitCoverage=95%, E-value=7e-12, Identity=17%"; Hit description =UPI00006A2D9E related cluster
LTIRGLQVLAFRGLHVLAFRGLHVLTFKGLHALPFRGLRVLAFRGLHVLAFRGLHALAIRRLHVLAFRGLHALAIRGLHVLAFIGLHALTFRGLHVLGFRGLHALAIRGMHVLAFVGLHTLEGQHVLASKGGLHILAFRGLHVLAFKRTTRPRLQRTTSPPFRGLHVLATSEDYTSSAIRGLHTSHLQSDYHPHLQENLARPHSLQRML

SEQ ID NO: 133845 - protein, 78 aa, Glycine max
  Coding DNA Sequence Number=SeqID_42160
MRDGKRSSYVIRIGVNSGVGLGGKFLIALEPAPKWALPAGRVGVGAGAWGASLWMGAGTLGYTGAELEESPARAEKLK

SEQ ID NO: 133846 - protein, 83 aa, Glycine max
  Coding DNA Sequence Number=SeqID_42161
RTFHRLVRHSVHPGHSVHCEHSEHSIEGDSEYSDFEQSTTNFYTENMAQPPPRERTLREMATPDFTSLLHVYHGNNVGHPLYP

SEQ ID NO: 133847 - protein, 236 aa, Glycine max
  Coding DNA Sequence Number=SeqID_42162
  Homolog annotation: Hit_ID=Q6WAY4; Match level="QueryCoverage=97%, HitCoverage=58%, E-value=7e-19, Identity=26%"; Hit description =Putative uncharacterized protein
LKELGRLMAPFQRQAFRKVYGKILDLTAAEVFTEAIVSLTQYYDQPLRCFTKIATVVGDSARELDRMKQTRNGLVGLPRKYLEGKARDMASQEEWVLFADILALLIFGAVLFPSVDGARRTAHGSSAAYPLFVCGSTINWFPRWKEGKKGVLFSCGDYPNVPLIGTRGCINYNPALVIRPLGYPMRGAPTEESLSPFLVRDFGAQSLKVVQRVHKAWKSPLRKDKELRGIRNGIIS

SEQ ID NO: 133848 - protein, 106 aa, Glycine max
  Coding DNA Sequence Number=SeqID_42163
MAMRHGGDRIRSIQEGSTKVRKSTMGVDNDACHFLCIVKYNNVVSCFNFASEMHCYLSYPNFVRGLLRDDMQPLVSRFEILGVLCCTINEVPRRVRNQKEAGLRDP

SEQ ID NO: 133849 - protein, 70 aa, Glycine max
  Coding DNA Sequence Number=SeqID_42164
MAAAAPDEADVDNGYVAIADKLERLLNLRIMTEGTKTYTIAEECLSITRSYIGQPTVGHRSRRRRHTSGH

SEQ ID NO: 133850 - protein, 133 aa, Glycine max
  Coding DNA Sequence Number=SeqID_42165
  Subcellular localization annotation: CTP_CleavageSite=38; ConfidenceScore=5.32e-01
MGLSFTGICCGATGDGSRRNTKPNLGATDSPNGTTNMSAKENTKVGGEGAAVVSQLRRRQREHERNITCPPRATTDDTKTGLVTRPSLYGGDHLCMVIKKITCPPRETSNSTKMGLRTRPSLYGNHQKHVSAT

SEQ ID NO: 133851 - protein, 412 aa, Glycine max
  Coding DNA Sequence Number=SeqID_42166
MSVELPWSMRTLDTMKLAITMETTMGSSWLIGLMPLKSLFVKVMGGRLLGDCMSTQLMSISRMAWRQACFPALVDVDVRVFASDAFVFLFLLLCPSFYQYHDFCASPLGGLGGSGGGSFMGTSALKASFRIVVRLAIWVSLFIHVARRLLAQTISELARSQGKQLELKRSTKVSNLSMDIGGSPPHHVNDAPLRAIGKTRHKIASSLVQRLALVKNASKCSSRSVALSYRSKLSGFKPKGLELSKDVLYLRLDHMLTNGEKRPRGAVTVAEVQVLAVAKSFSMPSGDDTNTIAGGVGGNSSVSNISGDGNNGDKDDSNSSGNTNNSGDSDNDGGSVGVNDSDNNNDNVDVGDDKDISANGDDSGVGASGVVKNSDVYNAGFKRPCLNVVHSKTISPHEDRLRNNVHSKTVTT

SEQ ID NO: 133852 - protein, 157 aa, Glycine max
  Coding DNA Sequence Number=SeqID_42167
  Gene Ontology: Mol. function=mannosyl-oligosaccharide 1,2-alpha -mannosidase activity; Cellular component=membrane
  Homolog annotation: Hit_ID=Q93Y37; Match level="QueryCoverage=23%, HitCoverage=5%, E-value=1e-09, Identity=78%"; Hit description =Endoplasmic reticulum alpha-mannosidase, putative
MVKLEFNRFPSAVNWTLIIKHQIAVQFSRKLSFLVIIKRWCLVCFLPGTLAIGATKGLTKKQAMKNNMLNFEDLQYLKELYHQLHALDRFDQHYRRKLQEQDNSNATERASRHHPFSILGDRYIKHLVVVVNEPDSGIYTPRDTVPNTEELIEDPEV

SEQ ID NO: 133853 - protein, 105 aa, Glycine max
  Coding DNA Sequence Number=SeqID_42168
MILASLSKFLPKLAEKVRPFYWLLQIIDSFLWDDTTGFELTEAKSTPAPLPFNSRRGHQLSPRPRRWEAPKTHLFCHTFRVTKSLSRRTTLSGNYCESLSWQEEW

SEQ ID NO: 133854 - protein, 58 aa, Glycine max
  Coding DNA Sequence Number=SeqID_42169
MAENLHGITHENVSDALRKRLDENEGGTCHPARPSELGCFLQKQPPSGGTSWKAQVGL

SEQ ID NO: 133855 - protein, 84 aa, Glycine max
  Coding DNA Sequence Number=SeqID_42170
MRKSNRQVYRVVQGQEGLLKVLDTVLENYNCFSVQSVLENVKKKEQVLDDFGAREVSLIDLELGKKKEMMEGWFHVIICYLYIE

SEQ ID NO: 133856 - protein, 195 aa, Glycine max
  Coding DNA Sequence Number=SeqID_42171
MNDQLVARFNRCFIVVVASREIGDAVHVTEDGLVSWHGGGDEASVNADRAVDEDEVGGLAAESEGEFVARFGDAEEFKVGPALVTDEGLVDTAVTIQDLNHGVVDKVLEVEEEVKVAEADVGVDGDHGEAETGEGEAGVGGGGGLAHTILVGGDDSDVGYDPPMNACQKSIIVGLMKDLDELLERGIDVVGIGLT

SEQ ID NO: 133857 - protein, 130 aa, Glycine max
  Coding DNA Sequence Number=SeqID_42172
GNDKEGRPLKIVTVNESENRSYQRGQSVGEGKSMQREEEDKTTMPDLEKETMEKGGRGVDLRSGKRNDVEGETVSRDGGTNKEEMKWLSSKSQSLEKKSLAGDGKANILVVIHLDFLRIYTTYMPDKKLN

SEQ ID NO: 133858 - protein, 201 aa, Glycine max
  Coding DNA Sequence Number=SeqID_42173
  Homolog annotation: Hit_ID=A5AUR9; Match level="QueryCoverage=48%, HitCoverage=51%, E-value=4e-09, Identity=34%"; Hit description =Putative uncharacterized protein
MAEELSTVIIPQLQASSTKKRPSKNENWCLEDYLLLIHSRQTLHLTINQLNQVFVREKLLKRLWISAQKVLVDAVESLDLVDLPRSTVQESMSAFAAVALEDVVVDLGELNWQECCVTSVEKISFSNGQSVFPGCSNQSLHVVSHSQSQAQKENRIDETRDLIPEAFRRSLKPTKMVPKRKRSNARDSVASTVDSASLASC

SEQ ID NO: 133859 - protein, 84 aa, Glycine max
  Coding DNA Sequence Number=SeqID_42174
  Gene Ontology: Mol. function=catalytic activity; Biological process =auxin mediated signaling pathway
  Homolog annotation: Hit_ID=P33083; Match level="QueryCoverage=100%, HitCoverage=100%, E-value=1e-20, Identity=62%"; Hit description =Auxin-induced protein 6B
  Pfam annotation: Domain name=Auxin_inducible; Domain location=1-84; Score=83.0; E_value=9.6e-22; Accession=PF02519.5; Description=Auxin responsive protein
MGFRLPGIRKALFAANLASSKAVDTPKGHLAVYVAVCDSFIILEPIFIPGLVESSEEFGYDHSMGGLTIPCSEDVFQCITSYLN

SEQ ID NO: 133860 - protein, 96 aa, Glycine max
  Coding DNA Sequence Number=SeqID_42175
  Gene Ontology: Biological process=auxin mediated signaling pathway
  Homolog annotation: Hit_ID=P33080; Match level="QueryCoverage=50%, HitCoverage=52%, E-value=1e-11, Identity=64%"; Hit description=Auxin- induced protein X10A
  Pfam annotation: Domain name=Auxin_inducible; Domain location=26-93; Score=12.3; E_value=2e-06; Accession=PF02519.5; Description=Auxin responsive protein
MAHYGIGLQSPLAIIYALFLGATENYGFPHTRYYWATVSINQGATKKLEVAKGYLAVYVGDKIGRFMIPVSYLNQPAFQDLVKQKKNSDMIIQLAV

SEQ ID NO: 133861 - protein, 92 aa, Glycine max
  Coding DNA Sequence Number=SeqID_42176
RSCPTYGGTYEPGQCISQQDTSREVNYIGIPNCGFQGYNQGNSSGFHQGAAGFNHGPPGFNEGRNFMQGSGSRNQGNQYKEQRNQQPYQPPY

SEQ ID NO: 133862 - protein, 103 aa, Glycine max
  Coding DNA Sequence Number=SeqID_42177
  Gene Ontology: Mol. function=catalytic activity; Cellular component =chromatin; Biological process=auxin mediated signaling pathway
  Homolog annotation: Hit_ID=P33080; Match level="QueryCoverage=81%, HitCoverage=91%, E-value=2e-35, Identity=82%"; Hit description=Auxin- induced protein X10A
  Pfam annotation: Domain name=Auxin_inducible; Domain location=1-90; Score=168.3; E_value=2e-47; Accession=PF02519.5; Description=Auxin responsive protein
MGFRLPGFRKASFSSNQASSKVEDVPKGYLAVYVGEKMKRFVIPMSYLKQPSFQDLLNQAEEEFGYDHPMGGLTIPCKEDEFLSYQLIPGFKCSKFVGDIDQP

SEQ ID NO: 133863 - protein, 422 aa, Glycine max
  Coding DNA Sequence Number=SeqID_42178
MMHVLSRQPVLSTLMHLGERAKCPPLALSACQQQHEGGAKYQDNIQLRNILPERNVELGPGMFDEFLQELQRHRWDQVLTRLPEKQIDVALVKEFYSNLYDPEDHSPKFCRVQGQVVWFDAEMINDFLDTPDLTTLAQTWSVLSYFNLAPTSHTYDINVDRARLIYGLVMKMDLDEGSLISLQINQITQSNTSSPVINLADIKKNCWNPADPSITFQGTRRTRTRASASASEAPLPSQPPLLAFFPATTASTSIHLSTSRHAWTDAQMDLPLTTPEAYRQLVAWPGDQPSTDRGEEPSRVAATEDPAVDEDLMDDLAGSDWGPWVQTLEMPLILGETLNGKVSLMEQGHNWYAEYLLKSRPSPTRVLSARHALRVQGSTGAKRGVKLEDAESVKHAIQQKHTLSLQLALSAITKAQSPLQQL

SEQ ID NO: 133864 - protein, 91 aa, Glycine max
  Coding DNA Sequence Number=SeqID_42179
  Gene Ontology: Mol. function=catalytic activity; Cellular component =chromatin; Biological process=auxin mediated signaling pathway
  Homolog annotation: Hit_ID=P33083; Match level="QueryCoverage=100%, HitCoverage=100%, E-value=4e-37, Identity=84%"; Hit description =Auxin-induced protein 6B
  Pfam annotation: Domain name=Auxin_inducible; Domain location=1-91; Score=181.2; E_value=2.7e-51; Accession=PF02519.5; Description=Auxin responsive protein
  Subcellular localization annotation: CTP_CleavageSite=31; ConfidenceScore=5.08e-01
MGFRLPRIQKTSFSANKLASSKVMDVPKGYVAVYVGEKMRRFVIPVSYLNQPSFQDLLSQAEEDFGYHHPMGGLTIPCCEDVFQHITSCLN

SEQ ID NO: 133865 - protein, 211 aa, Glycine max
  Coding DNA Sequence Number=SeqID_42180
  Gene Ontology: Mol. function=ATP binding; Biological process=apoptosis
  Homolog annotation: Hit_ID=Q8LJ95; Match level="QueryCoverage=73%, HitCoverage=28%, E-value=1e-21, Identity=38%"; Hit description=NBS -LRR resistance protein RGH1-like
MIVIGGNYLNILLQDYLKAPATTDLAYNAILEHTIAERERSDISSLRWLWYLNLSECYLLDGMPKGIENLTWLGGFVLSSPSKTPCRISDIAAKLERLVRLSIRIGSGAVIQDGEFESLKMLSILKHLKISWGVFDTSLKKLHLEGFPGQNIPEWLKPSKLPQELELRQLHITGGKLKSLDHGENNDWGVEIVYLKYLKDLDVDLGHLRKL

SEQ ID NO: 133866 - protein, 209 aa, Glycine max
  Coding DNA Sequence Number=SeqID_42181
  Gene Ontology: Mol. function=catalytic activity; Biological process =auxin mediated signaling pathway
  Homolog annotation: Hit_ID=P32295; Match level="QueryCoverage=34%, HitCoverage=79%, E-value=1e-27, Identity=83%"; Hit description =Indole-3-acetic acid-induced protein ARG7
  Pfam annotation: Domain name=Auxin_inducible; Domain location=1-85; Score=121.4; E_value=2.7e-33; Accession=PF02519.5; Description=Auxin responsive protein
MGFRLPGIRKSLFAENQASSKAEDAPKGYLAVYVGEKMKRFVIPVSYLNQPLFQDLLSEAEEEFGYNHPMDHLLGAHTRILPQLDSTHLERKVCSSMIWDNKLLHFHSNIDCKVAFGTSTAFEGANLFAATDVFLMPASPFPRMLTTTKSRFYIGQSKLSTSGPPPSLFQMSLYVDNNDIVAPSLFGSISTLVSITAVVVRIHFNVGYP

SEQ ID NO: 133867 - protein, 128 aa, Glycine max
  Coding DNA Sequence Number=SeqID_42182
MEKDFDTHLNCLSSNLTDGFVLLEREGKCRDLFQEWVALGRHVQIHNSKSLKIYCPVTSILPKTPHFDETYSLWLIHYHDANQFAYQVNGCLAATMDNNVKGSLLWRHHRAQWHVYVAEIWISAIHHS

SEQ ID NO: 133868 - protein, 91 aa, Glycine max
  Coding DNA Sequence Number=SeqID_42183
  Gene Ontology: Mol. function=catalytic activity; Cellular component =chromatin; Biological process=auxin mediated signaling pathway
  Homolog annotation: Hit_ID=P33083; Match level="QueryCoverage=100%, HitCoverage=100%, E-value=2e-37, Identity=84%"; Hit description =Auxin-induced protein 6B
  Pfam annotation: Domain name=Auxin_inducible; Domain location=1-91; Score=176.9; E_value=5.2e-50; Accession=PF02519.5; Description=Auxin responsive protein
  Subcellular localization annotation: CTP_CleavageSite=58; ConfidenceScore=5.04e-01
MGFCLPGIRKTSFSANKLASSKVMDVPKGYVAVYVGEKMRRFVIPVSYLNQPSFQDLLSQAEKDFGYHHPMGGLTIPCSDDVFQHITSCLN

SEQ ID NO: 133869 - protein, 172 aa, Glycine max
  Coding DNA Sequence Number=SeqID_42184
  Gene Ontology: Mol. function=cysteine-type endopeptidase activity; Cellular component=endoplasmic reticulum lumen; Biological process =proteolysis
  Homolog annotation: Hit_ID=Q6Y1E6; Match level="QueryCoverage=95%, HitCoverage=52%, E-value=8e-48, Identity=58%"; Hit description =Cysteine protease 8
  Pfam annotation: Domain name=Inhibitor_I29; Domain location=22-79; Score=86.4; E_value=9.4e-23; Accession=PF08246.3; Description =Cathepsin propeptide inhibitor domain (
MAFLASQVTCRTLQDASMYERHEEWMSRYGKVYKDPWEREKRFRIFKENMNYIETSKNAAIKPYKLVINQFADLNNEEFIAPQNIFKGMIICRLLSRKYTFSFSFIVFFLHPRFCWAFYDVASTEGILALTAGKLISLSEQELVDCDTKGVDQGCEGDLMDDAFCNTLYPHK

SEQ ID NO: 133870 - protein, 86 aa, Glycine max
  Coding DNA Sequence Number=SeqID_42185
MPHNGQVRSRSLSEIIGRPVRVTLFCENALTMWNRHRLTRALKPDNPQGLHSEDAPQVINSSGSHSGSHHNSSCINSSLLKGLTVV

SEQ ID NO: 133871 - protein, 135 aa, Glycine max
  Coding DNA Sequence Number=SeqID_42186
  Gene Ontology: Mol. function=cysteine-type endopeptidase activity; Cellular component=endoplasmic reticulum; Biological process =proteolysis
  Homolog annotation: Hit_ID=Q6Y1E4; Match level="QueryCoverage=56%, HitCoverage=22%, E-value=7e-33, Identity=82%"; Hit description =Cysteine protease 12
  Pfam annotation: Domain name=Peptidase_C1; Domain location=1-113; Score=-53.4; E_value=8.2e-08; Accession=PF00112.14; Description =Papain family cysteine protease
MAVTLSNSSFKILESRCQLEDVPANNEKALQKVVANQPVSIAIDACDSDFQFYKRGVFTGSCGTELDHGVTIVGYGVSHDGTQYWLVKNSWETEWNSNRAIGVGVLENVRNVTIDNEEHLSDYIEIRDELLMLGG

SEQ ID NO: 133872 - protein, 230 aa, Glycine max
  Coding DNA Sequence Number=SeqID_42187
  Gene Ontology: Mol. function=cysteine-type endopeptidase activity; Cellular component=endoplasmic reticulum; Biological process =proteolysis
  Homolog annotation: Hit_ID=Q6Y1E4; Match level="QueryCoverage=71%, HitCoverage=65%, E-value=4e-41, Identity=44%"; Hit description =Cysteine protease 12
  Pfam annotation: Domain name=Auxin_inducible; Domain location=164 -228; Score=41.2; E_value=1.6e-09; Accession=PF02519.5; Description =Auxin responsive protein
  Pfam annotation: Domain name=Inhibitor_I29; Domain location=22-79; Score=71.8; E_value=2.3e-18; Accession=PF08246.3; Description =Cathepsin propeptide inhibitor domain (
  Pfam annotation: Domain name=Peptidase_C1; Domain location=78-205; Score=-45.1; E_value=2.1e-08; Accession=PF00112.14; Description =Papain family cysteine protease
  Pfam module annotation: Pfam domain module=Auxin_inducible::Inhibitor_ I29::Peptidase_C1; Domain location=164-228::22-79::78-205
MAFLASQVTCRTLQDASMYERHEEWMSCYGKVYKDPREREKRFRIFKENMNYIETSKNAAIKPYKLVINQFADLNNEDHKKGAVTPVKDQGHCGFCWAFYDVASTEGILALTAGKLISLSEQELVDCDRGQDANYPYKGVDGKCNANEEANPAATITGIPWVSAYMVLLGGLRPKQPHQGLPKGYLAVYVGDKMRREAEEQFGYVHPMGGLAIQCEEDEFLNVTYHLNKL

SEQ ID NO: 133873 - protein, 51 aa, Glycine max
  Coding DNA Sequence Number=SeqID_42188
MKASRQSNHEEKSRALNTLKTTWPLFCYRKVVAAIASHSNVRPVYKRKAHS

SEQ ID NO: 133874 - protein, 68 aa, Glycine max
  Coding DNA Sequence Number=SeqID_42189
MTSYGGLEQLGASYGQSGRQWRSNCVSWFRSLSEEQPTYLQGGKEMEFLELKQGSMTVAEYAARFENL

SEQ ID NO: 133875 - protein, 76 aa, Glycine max
  Coding DNA Sequence Number=SeqID_42190
  Gene Ontology: Mol. function=catalytic activity; Biological process =auxin mediated signaling pathway
  Homolog annotation: Hit_ID=P33080; Match level="QueryCoverage=100%, HitCoverage=82%, E-value=5e-30, Identity=80%"; Hit description=Auxin- induced protein X10A
  Pfam annotation: Domain name=Auxin_inducible; Domain location=1-76; Score=123.7; E_value=5.5e-34; Accession=PF02519.5; Description=Auxin responsive protein
MGFRLPGTRKASFAANQASSEVADVPKGYLAVFVGEKMKRLVIPISYLNQPSFQDLLNQAEEEFGYDHPMGSLTIP

SEQ ID NO: 133876 - protein, 273 aa, Glycine max
  Coding DNA Sequence Number=SeqID_42191
MVHDSRIILEPTCISRLSQAEEEFGYDHPTGGLMMDNILRIRDRRGLREESDKAREINICMISRNPSRSLVYGYSSWAEADDLHGLHRGSYQYSCLENAPCPQGGKVCYLVDGAMMRLEEGAVENIMDFRGRGKGQSFEVNPVTNLVRDVMALARGEKIPEFLTCRKLVVNCFDLRRPGNIGCHACGGMDGHIIAPFCKGKLGACNGEEFAPKLSNEDGITVRDEAAGKTVEFAYHIKEESGNLMGGISWLQGAKVSPFGEMIDHDKDSGVAM

SEQ ID NO: 133877 - protein, 238 aa, Glycine max
  Coding DNA Sequence Number=SeqID_42192
  Homolog annotation: Hit_ID=Q4A3R5; Match level="QueryCoverage=21%, HitCoverage=76%, E-value=3e-07, Identity=58%"; Hit description =Capsule O-acetyl transferase
MERKSGFDGFVFGGVLTLTKKAIESVRTKLRCSRINVNHNGYKCLFSSGKIFISKDVIFNENQSPYPALFSSSTSSSTPTEFISTTLTVIDSVCHPPLNSNPSSSSSIEGPHSSPSVKASRIHPSLFLVHTEPKLVKEALQESKWFAAMTCGSNAFQDYFDDAKESRVKQIPKFQDTRFKNQVSRIKFQESRFKIQDSRIKFQESSFKIQDQDSRLKIQESREASIKISTKNVFQNIE

SEQ ID NO: 133878 - protein, 169 aa, Glycine max
  Coding DNA Sequence Number=SeqID_42193
MASRKRQASLQRQLVTYIKTILSEKQIDIALVKEFYSNIYDPEDGAPKYCKRGTFGILLVLAHIPRPPSDCGNLMHTRKRVLPECRRGPMESMEGSYYTRSNMEHGHGHGLGQLHFPMLITALSDAQGVVSDTLTYESLSPIIKMAYIKKNYCNPVFDGRQVHRIAHVV

SEQ ID NO: 133879 - protein, 212 aa, Glycine max
  Coding DNA Sequence Number=SeqID_42194
MDRAKLVYGLVTHMDMNIGTLISGQISSIAQSNSSRLDFPALITALCRVKGVTFDSLTYESLSPAINLAYIKKNCWNVDDLISMQVVASPGTILTVEQFIEKVAWPGTQPSLLRKGGDPSAQVPQQVGVTQVRQEAATPKRSPQISPDPPSSVVDQSSPQQLADPPSPVHEMPINPSTPFLEILEDPTTLVLGLTTTPPATLVLHFTDEEGT

SEQ ID NO: 133880 - protein, 121 aa, Glycine max
  Coding DNA Sequence Number=SeqID_42195
MKKQLNQRLVLEELRRSDFLTTIEEYVGARETPLLSSLVTDAWGANTFPVRKYNSRTFHLKFVDHAFSGFFRCFPRINVGGDSAHFPSLEDAPVSLASPSRQRVGCDTKKAQTKKSFDFLF

SEQ ID NO: 133881 - protein, 199 aa, Glycine max
  Coding DNA Sequence Number=SeqID_42196
  Subcellular localization annotation: CTP_CleavageSite=26; ConfidenceScore=5.09e-01
MAESSKKRKDSTSTTTIAGQRRHDTSGDSTAPPNPSISSPHSLTLFSSDEQCQSQGVPLKGTLVDDWKHIYSNHDARKMVCNKNTDMIVRLLADDEPIVMVKHSFGIGAAIVAFFGYQNDMDGQWVWKHDLPPTVPDECTPSPPPQRDSSSSLLHDVLSELQDPRAFVGDRFDAMDSCITRLEDDMSFIHRCFDPPVDS

SEQ ID NO: 133882 - protein, 299 aa, Glycine max
  Coding DNA Sequence Number=SeqID_42197
MIKDWSFLKERRVQLVEGEYAEFQAEVAKRHWTQLTDPMAKYDPEIVMEFYANVWPTEEGLMDKCSWVWGQWIPYDEDAINQFLGHPLILEEGQHCEYVERRNQVSSFDEEAIGQLLCSPGHDFARSVAGRQVQIIRTSMTTLTQIWMTLLLSNILPSDHNSDLPLPKCQLVYPILTQISVHVAQLISDAIYQFVGIAPPRHPVDPGKSNMALGFLALITSLCQFYGVLVTPTKLIRPPINSARTPTLTRGLLPSSSEPLLHSLRTGLIFRGAGPTEAQEDEDKAEEDGDMANVMDFFL

SEQ ID NO: 133883 - protein, 246 aa, Glycine max
  Coding DNA Sequence Number=SeqID_42198
  Gene Ontology: Mol. function=serine carboxypeptidase activity; Cellular component=extracellular region; Biological process =proteolysis
  Homolog annotation: Hit_ID=A7R4B7; Match level="QueryCoverage=30%, HitCoverage=16%, E-value=1e-30, Identity=79%"; Hit description =Chromosome undetermined scaffold_645, whole genome shotgun sequence
  Pfam annotation: Domain name=ArfGap; Domain location=5-118; Score= -36.0; E_value=0.032; Accession=PF01412.9; Description=Putative GTPase activating protein for Arf
MAAVLRRLRDLQSSAGNKICVDWSQKNPQWASVSYGVFIVGEVQVDEGYLHTIAAGGVSREQGGILHAEDGGERVAAGGAAALTGREGIGKLSLVAASAANVVQAGTKEFTSKEATVDLPYVAFAVRPNLGVWEFHYARYVAVNETNGRALFYWFYEAMTKPQDNPLVLWLNGGLGCSSVGYGATQDIGPFLVDTDGRGLKFNNFSWNKGSKIEVMMTMVMRWNDGDDGGGGGGENVMMTVTMVVG

SEQ ID NO: 133884 - protein, 90 aa, Glycine max
  Coding DNA Sequence Number=SeqID_42199
  Subcellular localization annotation: CTP_CleavageSite=34; ConfidenceScore=5.12e-01
MASFSQMQSQLQSQMQSQGLALPPEPEVSPSAARVSTKGSCVDPSPTDQETGDSDKCGLYIEENPSRLVALRRVYEGSIAVHNIPLLHGQ

SEQ ID NO: 133885 - protein, 282 aa, Glycine max
  Coding DNA Sequence Number=SeqID_42200
  Gene Ontology: Mol. function=protein binding; Cellular component =integral to membrane; Biological process=xylan catabolic process
  Homolog annotation: Hit_ID=A7PBE2; Match level="QueryCoverage=80%, HitCoverage=98%, E-value=3e-51, Identity=41%"; Hit description =Chromosome chr16 scaffold_10, whole genome shotgun sequence
  Pfam annotation: Domain name=LRR_1; Domain location=122-143; Score =12.6; E_value=1.4; Accession=PF00560.24; Description=Leucine Rich Repeat
  Pfam annotation: Domain name=LRR_1; Domain location=50-72; Score =10.2; E_value=3.9; Accession=PF00560.24; Description=Leucine Rich Repeat
  Pfam annotation: Domain name=LRR_1; Domain location=74-96; Score =16.4; E_value=0.11; Accession=PF00560.24; Description=Leucine Rich Repeat
  Pfam annotation: Domain name=LRR_1; Domain location=98-120; Score =14.8; E_value=0.33; Accession=PF00560.24; Description=Leucine Rich Repeat
  Pfam module annotation: Pfam domain module=LRR_1::LRR_1::LRR_1::LRR _1; Domain location=122-143::50-72::74-96::98-120
MAQKTCSRDYQGHWYFVNTTGFKGNWSYDLNALLMWKGSEQMFGDNGLSLLKSIDLSSNHFSEEIPMEIENLFGLVSLNLSRNHLTRKIPSNIGKLTSLDFLDLSRNQLVDSIPSSLTKIDRLSVLDLSHNKVSGEIPIGTQLQSFDASSYEDNIDLCGPPLQKLCINGDPEQDPIVKLYEDKLLFTSEFYISISSIGFVMSFWGVFGKILIKHSWRHAYFMFLSNLSNAIYVMTAVKVFKYAIEDSRENLDYSCQLVDGERCKEPLLKVTRHLSQLDLERE

SEQ ID NO: 133886 - protein, 293 aa, Glycine max
  Coding DNA Sequence Number=SeqID_42201
  Homolog annotation: Hit_ID=Q1RU80; Match level="QueryCoverage=40%, HitCoverage=100%, E-value=2e-10, Identity=32%"; Hit description =Putative uncharacterized protein
MVKFERPTPKIEGLVAASGLKVTITLNDVVSLLHLPIVGAFLSFEQLHVDDIIDILVELLDVSAAEARAKTIQCHGSYSGTYAWGAAALVHVYDNLNEVSKSMARQLAGYITMLQCWIYKHFLFVSSTLAAKDDNKRRLHACRWTSGKALPVSIEFEIISLFSGHLKWGPLMVIHRSERFGDYIAPIGQICVVPDQCSLDYMEWLYMILHPFMTLAPPGDPPRVPPQPVATTTPDEADVDVHRPGHAVDGYVVIADKLERLLNLRILTEGTEVYTVAEEYLSIARSYIGQLTV

SEQ ID NO: 133887 - protein, 22 aa, Glycine max
  Coding DNA Sequence Number=SeqID_42202
MKSPKAYGSSNLKNFANVIMEL

SEQ ID NO: 133888 - protein, 74 aa, Glycine max
  Coding DNA Sequence Number=SeqID_42203
MAEEDALSLDNIKGGVCAEYTNADVYGRRNSGSNKEAFEMGERRLHLSWTHSERNYGTLLNPSIWQKMPQVTNS

SEQ ID NO: 133889 - protein, 167 aa, Glycine max
  Coding DNA Sequence Number=SeqID_42204
  Gene Ontology: Mol. function=catalytic activity; Biological process =metabolic process
  Homolog annotation: Hit_ID=Q9SMK7; Match level="QueryCoverage=53%, HitCoverage=33%, E-value=1e-19, Identity=58%"; Hit description =Putative enoyl CoA hydratase
MVFFFVQSKLEYPIPGTLLLFILKGYNFTPWIWVPTNPRGAERLPPGIVNAESNLFLRRLWGLPMSHKLFLIIGATKARELSLLATPLTAEAAERLCFANHIVEEAQLLKKSREVADAIVKINQDLVLRYKAVINDGLKLDLGRTLSLEKAHHNNDVCLCHNMLNGA

SEQ ID NO: 133890 - protein, 107 aa, Glycine max
  Coding DNA Sequence Number=SeqID_42205
MFFYKNKYGFQCRCKESNVEGLHEGISVSVGDDDAFRSNRKEGGEGAMEGGDGGLEGATKKKEGWRRGMTRGGEDGRWQKRVKKEGRGKLAEEKERKWGGRRGEPRK

SEQ ID NO: 133891 - protein, 407 aa, Glycine max
  Coding DNA Sequence Number=SeqID_42206
MAKGQGELRLWRLSRGGVHLECWPVTANTHHLCCKGASSWGHPVLFLLFFGLNFFNVYGGSLEHLLDDSLERDIVKAFEDDSCPASLYIGRTINVEAPPGSYWISNSEKFYRLGHHLSYEFRLSQNLLDGVVHFGYQLMTLEIESWCFLSSCMRAELMALLATKRYKSRGTPNLESFGRNLDRDASYHSVSRLLGSEKLSSAYPESIFFRVDANAILAEFPKDFFQAEGHDLVAEIVIFSDECCFFLVWSVHPDLVLSGDVDYTPVLKVGEVPTLLGFRFELQLDELFDGQGFDWRPFVYAHDLSTFNSCGVRLGRLPGGRIGCYLQALYIALSCLLLICPDGYNLPDLTSGPYSLACKAKEWTGMRVDSVWGDLKPLENNHGVVLVDGVDTLEVLIRESDRRETSL

SEQ ID NO: 133892 - protein, 84 aa, Glycine max
  Coding DNA Sequence Number=SeqID_42207
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
MPFKHAYLSHGSSVDENESLFLDVRRQSRPAGMQAWHWPSFYNVVTGKTLALPNLIALQHIPLSPAGVIAKRPAPIALPNSCAA

SEQ ID NO: 133893 - protein, 233 aa, Glycine max
  Coding DNA Sequence Number=SeqID_42208
  Homolog annotation: Hit_ID=A5B589; Match level="QueryCoverage=43%, HitCoverage=28%, E-value=2e-09, Identity=38%"; Hit description =Putative uncharacterized protein
  Pfam annotation: Domain name=Retrotrans_gag; Domain location=16-76; Score=-0.9; E_value=0.065; Accession=PF03732.8; Description =Retrotransposon gag protein
MAEDQPHRVTLEDYSSSTAKRWLHLFKGNSLKTWDEFPDESLSEALERFCSLLRKTPTHGFSEPIQLNIFIDGLRPQSKQLLDVSAEGKIKLKTPEEAIELIENMAASDHAILRDRTHIPTKRSLLQIALFVVELTNLAVVFLLKTQHVKRTHPGNQFNKDHGGPSNRPAQQGPNLYERTTKLEETLTQFMEVSMSNHKSTESAIKNLEIQAVMTRGRRAILVEDEGRLVAEN

SEQ ID NO: 133894 - protein, 310 aa, Glycine max
  Coding DNA Sequence Number=SeqID_42209
  Gene Ontology: Mol. function=DNA binding; Cellular component=nucleus; Biological process=regulation of transcription
  Homolog annotation: Hit_ID=Q0PJD4; Match level="QueryCoverage=52%, HitCoverage=80%, E-value=2e-45, Identity=60%"; Hit description=MYB transcription factor MYB64
MARTKKNGQMTSEAAKEIAEKIDSLKEQASQGSFVPHGREDVLAAAIGLPEHPGHVRAARAGVTIKQYFGLAPQTFRTSFSMAPEELEQLEESITEKGLTLPPKPKVRPSAACVSTKGSCVDPSSTDPDTGLQRCGKTCRLMWINYLMPNLKIGTFSKEEENVIIELHAVLGNSAPRSIDMDVLFFLLLRWPQIAALRPGRTDNEINNLWNSCLKKKLRQRGIHPVTHNPLSKVENRDEGKTRRQELSHELNLLNSESFNSDEGSYEQRPSSIAPKAYDMEGCCISKINNTKNDTNLMPNCSNKDMFLDS

SEQ ID NO: 133895 - protein, 70 aa, Glycine max
  Coding DNA Sequence Number=SeqID_42210
MECNIYGVKIKSDSPAEKGAGKIDVDAGGTDIIGAGAEEGGTSEDGGASDLFPLALRYPLKVTERSSRFQ

SEQ ID NO: 133896 - protein, 55 aa, Glycine max
  Coding DNA Sequence Number=SeqID_42211
MACTKKTGQMTSEAAKEIVEKIDLLTAAIGRPEHLGRERAAGVGVTIKQYFGLAP

SEQ ID NO: 133897 - protein, 692 aa, Glycine max
  Coding DNA Sequence Number=SeqID_42212
  Gene Ontology: Mol. function=mannitol-1-phosphate 5-dehydrogenase activity; Cellular component=integral to membrane; Biological process=metabolic process
  Homolog annotation: Hit_ID=A7ZTE9; Match level="QueryCoverage=52%, HitCoverage=95%, E-value=1e-170, Identity=82%"; Hit description =Mannitol-1-phosphate 5-dehydrogenase
  Pfam annotation: Domain name=Mannitol_dh; Domain location=282-404; Score=126.5; E_value=7.6e-35; Accession=PF01232.14; Description =Mannitol dehydrogenase
  Pfam annotation: Domain name=Mannitol_dh_C; Domain location=429-655; Score=368.8; E_value=8.7e-108; Accession=PF08125.4; Description =Mannitol dehydrogenase C-terminal domai
  Pfam annotation: Domain name=PTS_EIIA_2; Domain location=192-324; Score=146.9; E_value=5.5e-41; Accession=PF00359.13; Description =Phosphoenolpyruvate-dependent sugar phosphotransferase system, EIIA 2
  Pfam annotation: Domain name=PTS_IIB; Domain location=77-165; Score =63.9; E_value=5.4e-16; Accession=PF02302.8; Description=PTS system, LactoseCellobiose specific IIB subunit
  Pfam module annotation: Pfam domain module=Mannitol_dh::Mannitol_dh _C::PTS_EIIA_2::PTS_IIB; Domain location=282-404::429-655::192 -324::77-165
MTPKGAYFANIAAIVAAFAVSFVVSSILLKTSKVKEEDDIEATQRMKDMKAQSKGQAVAGSPVVADASSVDVSHVRKIIVACDAGMGSSAMGAGVLRKKVQDAGLSNISVTNSAINSLPGDVDLVITHRDLTERAMRQAPQAQHISLNNFLDSALYTNLTERLVAANRSEAHRETVQTALADSYDDGSAHLFKLGADNVFLGLSASNKEQAIRFAGEQLVKGGYVQPEYVEAMLAREQLTPTYLGESIAVPHGTVEAKDRVLKTGVVFCQYPAGVQFGDEPDEVARLVIGNIGRGFIGKLLADAGIELVFADVNQVVLDALNARHEYPVHVVGEQAQVEIVTGVSAVNSTSDDIVTLIAEVDIVTTAVGPQILERIAGSVAQGLAKRSDNGNVRPLNIIACENMVRGTSQLKQHVLKALPQQYHAWVEEHVGFVDSAVDRIVPPSEAGSTDPLEVTVETFSEWIVDKTQFKGALPDIPGMELTDNLMAFVERKLFTLNTGHAITAYLGQLAGHATIREAILDQKVRAVVQGAMQESGAVLIKRYGFDAEKHAAYIQKILTRFENPYLKDDVERVGRQPLRKLSAGDRLIKPTLGTLEYQLPHASLVQGIAAAMHYRSEADPQAQELASLIAQKGPQAALAEISGLDANSEVVSSVAIMEEKQAFENRVLERLNAGRSVRSFLIAAVELLAEA

SEQ ID NO: 133898 - protein, 92 aa, Glycine max
  Coding DNA Sequence Number=SeqID_42213
MTPVNRKAGTGERTREPPGGNAGIFIVLSGFATTDLSVRFRDACQGGGAYGKTALPRPSHFPVKYLPGIFQEISAPFVSHFRSPAVSTPMPA

SEQ ID NO: 133899 - protein, 83 aa, Glycine max
  Coding DNA Sequence Number=SeqID_42214
MGLDDTPQPKSKAGARWIVVKTKIKGITEFGYYVMHWMSMIILGTFRNNWETYFNDVRPLEAERLKAFHIQWAQYYLKVRDLT

SEQ ID NO: 133900 - protein, 17 aa, Glycine max
  Coding DNA Sequence Number=SeqID_42215
ENVGKTGKDEIYDLFIE

SEQ ID NO: 133901 - protein, 290 aa, Glycine max
  Coding DNA Sequence Number=SeqID_42216
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPHRFPIYDFSSRIVEATTFDAVVIEKFGVEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 133902 - protein, 172 aa, Glycine max
  Coding DNA Sequence Number=SeqID_42217
WSADPEGQYSTRSAYDLIGEEARDSSEEECFEKLWRIKAADKTKLAEKTDTGHKFTLSSLQNPTRGCIPSFLSLQQSSKAEPNKRLGIMISRGNILNIQQKLNEVENLASHQILSDQELKDRNSLQQELWNASNRNYSDHYPIIMKSKRIDWGPKPFKVIDTWLNNKEYQKV

SEQ ID NO: 133903 - protein, 141 aa, Glycine max
  Coding DNA Sequence Number=SeqID_42218
ELSYPNFVRGPLLDDMRPFFGPCEAHLGPPGPLGPSRIFLQKAVASGGSNLARLGELGGNHLPYFAINRGGSEEEKGSAPLALLSSFEFAWKNCFCEENLSPRRFPKRFRNVFREEFRKGFDRFFDVSSFRFFIGLRIFQR

SEQ ID NO: 133904 - protein, 189 aa, Glycine max
  Coding DNA Sequence Number=SeqID_42219
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAANPPHEGHPTARAFGGPRPPTA

SEQ ID NO: 133905 - protein, 83 aa, Glycine max
  Coding DNA Sequence Number=SeqID_42220
MVLGASSPLVLVKVQHLKHGNDHVREGLFPSQNARVLVVGETKGPPKCLAWVPPTACPPVAYPRQGSKSARLWWGISCVSPTI

SEQ ID NO: 133906 - protein, 71 aa, Glycine max
  Coding DNA Sequence Number=SeqID_42221
MEWNLLAHSRHLVKDPNGQIVEKCLVKLQTKLREDPTVNEYGEAFLPRQLHVASSRSFIKRLLQEASPWLL

SEQ ID NO: 133907 - protein, 169 aa, Glycine max
  Coding DNA Sequence Number=SeqID_42222
MKFTTGSHLPIQLLCTVGRTPDGIINLLERTMSRIHDAILYYNGKWNMPLQNKFVGCAFTGKNPKKFQIPSTCIIDELKNLIKQVAPKGIPPLGIHESQMVRRLFFRQPARFEYSNTVIKYEINELITNEELLKVLVQSNYWKKYVPIEILAVFTKYVEDKVSGTSLNN

SEQ ID NO: 133908 - protein, 179 aa, Glycine max
  Coding DNA Sequence Number=SeqID_42223
KGEESSEEIYPQEEGQPLIVKEECKEVSVSSKRLAKKESHFEIKAIIKENYPLRQPPHFPLCKKTLVSIATPLRLEFIPQVKKLLDEGLLVPKIGIIRHQIPKIGGMMNVLSGATLYCQITRAPNIFMICVHRDSLGSDQGVPMNPKRIKVIPEWPTPPTPLIELVLIKKAQSFKKLRI

SEQ ID NO: 133909 - protein, 218 aa, Glycine max
  Coding DNA Sequence Number=SeqID_42224
MPKCQLVYAILTRMSIHVAQLIADPIYIFAGMAPTRHPLDPDKSNRALGFPALITGLCQSFGVPVAPTKRQAQGDAPQAAGAPPPPHQAGQVGAFDIEQYLRHLVRQQAANHRAHVRTHDCLYQMSLSMQSQGFASFSCPTPDQFRAEVAWPGDCPRPKQERHPRKLPAMEKKPTRMRRWPICLTSWEGVEIRDWEIPRFMFSFIFLLSFLFYVIVLT

SEQ ID NO: 133910 - protein, 111 aa, Glycine max
  Coding DNA Sequence Number=SeqID_42225
  Subcellular localization annotation: CTP_CleavageSite=27; ConfidenceScore=5.60e-01
MVHDIFVKVKLEVTGTSTALNVFGSRRSSNVTRSIFCPNFCKMVTSILQLDSMNLFVKARAWFNPITQGMATLIANTSSTFHRDERLGNTHAMHGKCNYEIETPEETSFLS

SEQ ID NO: 133911 - protein, 179 aa, Glycine max
  Coding DNA Sequence Number=SeqID_42226
MINDAFETLHRDIMCYMGIVKDLYQQRTMRLGVYEQFKQRDPCWSFIQLLDYLKLALLDEPKELMSLFQSHRLSLKTLFLFSPFYHRRIYFFRGGGYVCGLLDHGRFPLIGQLHRVRGSEHPTTAGYATETGDVGHLGRQGVNFGCNSLPKCGRGILPRNNLIALICKRRPAWALSGDI

SEQ ID NO: 133912 - protein, 58 aa, Glycine max
  Coding DNA Sequence Number=SeqID_42227
GQDHLELPSGVETKLEQQKPIKVHRDGCKWGWGHDRPIVAPFLRQTSRERHARQPSIL

SEQ ID NO: 133913 - protein, 188 aa, Glycine max
  Coding DNA Sequence Number=SeqID_42228
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MRKEKIPHQAPFAIQAAQLLGRAIGAGLFAITPAGERGMCCKAIKLGNARRFNIQFRVSRYRTGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133914 - protein, 163 aa, Glycine max
  Coding DNA Sequence Number=SeqID_42229
ALGFPALITGLCQSFGVPIAPSKVIRPPITRAFIEKYCTPRQAQGDASQAADAPPPPHQADPAGSFGMERYLQHLVRQQAANHRGHVQTHECLYQLSLSLQSQGFAPFPCPTPDHFRAEVAWPEDWLEDQTEKAPAEAPGDPEDARMDEEMTDLLGFLGRIGA

SEQ ID NO: 133915 - protein, 277 aa, Glycine max
  Coding DNA Sequence Number=SeqID_42230
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIIPRYMLKSDNPIKVDPNKLLKSNIQFLDEKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133916 - protein, 31 aa, Glycine max
  Coding DNA Sequence Number=SeqID_42231
MEFSGRQRYLVVIRTFSQSRLTLETFKPDDA

SEQ ID NO: 133917 - protein, 72 aa, Glycine max
  Coding DNA Sequence Number=SeqID_42232
DDVPKGKLYKVPEFQQNYRQMKKALTQQSKQNLRMPPDSWVTVTKGGVVDKSRAFAPTYPQFVMRNSDLRSS

SEQ ID NO: 133918 - protein, 102 aa, Glycine max
  Coding DNA Sequence Number=SeqID_42233
MVTCTFCQPGANEPVDAQRRTSSPAPFVVLTREDYLVVTHTFRQPGANEPVDAKKLTLSSTLFAIQGHRVRCQAEIPYGHPRLSSTEGNDFDGIRMILVVRC

SEQ ID NO: 133919 - protein, 101 aa, Glycine max
  Coding DNA Sequence Number=SeqID_42234
  Subcellular localization annotation: CTP_CleavageSite=54; ConfidenceScore=5.16e-01
MILHKIRRPNSLKIIPSGVANCRNLPFGGRATRDSRDASSKKGIRAEFPPTFIRGKRRKNRKRHGLRTLSVKGSGVVFTHGEGCFPCSYVFLNCGKEIRPT

SEQ ID NO: 133920 - protein, 257 aa, Glycine max
  Coding DNA Sequence Number=SeqID_42235
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYQLYIGCISALIVLDQFCIGYRSVVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133921 - protein, 70 aa, Glycine max
  Coding DNA Sequence Number=SeqID_42236
MSLHGRTRYSLRHIISSKGIQGFICALSRILAKWPFHWTPAETIPHKSLLNGCSGGGDLLTSPYFSSAMT

SEQ ID NO: 133922 - protein, 85 aa, Glycine max
  Coding DNA Sequence Number=SeqID_42237
MTKARQKGVRKVNEMKIQVRETSGDHQRKMREELATQLTQNLTDYVIIHFLAFRMLQNLMDCVTMLPFDFRHVTEPHGLCNNASF

SEQ ID NO: 133923 - protein, 97 aa, Glycine max
  Coding DNA Sequence Number=SeqID_42238
  Homolog annotation: Hit_ID=A7QD25; Match level="QueryCoverage=34%, HitCoverage=6%, E-value=9e-12, Identity=96%"; Hit description =Chromosome undetermined scaffold_79, whole genome shotgun sequence
MAGNNPYGLVGIIRIKVQSTCWVKDFFVAKCYGLNAELLTLLVRMGVHPKVFPDRMHTYRLSSARAEECPHEFVEVSTQVRKTLFYILSRVRIAPPK

SEQ ID NO: 133924 - protein, 134 aa, Glycine max
  Coding DNA Sequence Number=SeqID_42239
MKREKHVSYSSHNSCKSLSEELRDYYEGRHRSHLRPHSHRRENERKPQEVNIKLPYFHGKDNVEANLDWEIRVEQQLKRKSTSKSYGSHSYPKKDQGQGILGVRPSKPKDDKCHTLISSGDLCSMTCDHSLVLV

SEQ ID NO: 133925 - protein, 278 aa, Glycine max
  Coding DNA Sequence Number=SeqID_42240
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMIKFSSSSDSFGFIPAAGSSSNNSFGSVASALIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133926 - protein, 294 aa, Glycine max
  Coding DNA Sequence Number=SeqID_42241
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIRTPWHFSAASLWGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133927 - protein, 74 aa, Glycine max
  Coding DNA Sequence Number=SeqID_42242
MGSEIYPKVHENPRAFFSSSSPIFLEPLAHGSSDWSLPREDCIIPLKVVLTPYSSGRESILPKMEPNPITLIKN

SEQ ID NO: 133928 - protein, 149 aa, Glycine max
  Coding DNA Sequence Number=SeqID_42243
MGDPISRLSFPGRRIVVTQIICCSKSVGIFVSLLKACLHFSGENTETFSSLTSYPELRRSEFLIGGYVGARASLLSTIPPFVAMTQELVARGDSLRLSAPRHSVTPSVIDKQRPSLVILHPRYAEIPYGYLHPFARQTQLCPMASRDQV

SEQ ID NO: 133929 - protein, 135 aa, Glycine max
  Coding DNA Sequence Number=SeqID_42244
  Subcellular localization annotation: CTP_CleavageSite=38; ConfidenceScore=5.14e-01
MPISPCESIGWSVPSQHRGRAHKTTSGSGGAQQGPGVSSSGYGPLLVLQGARPPQQGIAPARHPVDPKKSNRVLELPALITGLYQFYGVSVAPSKHCAPRQAQGETPQQPGDGRQRATDAPPPPLEFTSAHPQKG

SEQ ID NO: 133930 - protein, 80 aa, Glycine max
  Coding DNA Sequence Number=SeqID_42245
MTKACQKGVRKENRGGVCNPARPGCFLQKQPPSGGTSSKAQVGLNLMDCVTMLPFDFWHVTELHVLCNKGCQIPRSGQTK

SEQ ID NO: 133931 - protein, 216 aa, Glycine max
  Coding DNA Sequence Number=SeqID_42246
  Homolog annotation: Hit_ID=UPI00016621D1; Match level="QueryCoverage =89%, HitCoverage=41%, E-value=8e-14, Identity=32%"; Hit description =UPI00016621D1 related cluster
MRGTVHEPQVNIGADQKGLHVLANRGLHALTLRGLCVLTFRGLHVLTFRGLHALAIKGLRVLTFRGLHALAIRGLHVLTFRGLHALAIRGLHVLTFVGLHSLTFRGLHVLANRGLHALTLRGLHVLANVGLHALTFRGLHVLANRGLHALTFRGLHILTFRGLHVLTLRGLHVLALRGLHVLALRGLHVLTIRGLHALTSRGLHVLALRGLPALAL

SEQ ID NO: 133932 - protein, 77 aa, Glycine max
  Coding DNA Sequence Number=SeqID_42247
MCVCFLISEVVIIKKGEIVEAKLHGESKMIQRCFDDNNDDDKGDDKKLKDQSKNNSSESKINQRTTQVNQEQFKSSR

SEQ ID NO: 133933 - protein, 156 aa, Glycine max
  Coding DNA Sequence Number=SeqID_42248
  Homolog annotation: Hit_ID=A2PD64; Match level="QueryCoverage=84%, HitCoverage=95%, E-value=7e-32, Identity=55%"; Hit description =Putative uncharacterized protein
  Subcellular localization annotation: CTP_CleavageSite=76; ConfidenceScore=5.35e-01
MARSPGFGFCFTPLAGVLFAFPSRYWFTIGQSGVFSLGGWSPHVQTGYHVSRPTRRTHSSCIFVYGAVTRSWAAPRSLAATGGISVDFFSSGYLDVSVPPVRLVNLCIQLTIMHKCIGFPHSDIDGCSGSYHLTVAFRRLARPSSPLTARASTVYA

SEQ ID NO: 133934 - protein, 226 aa, Glycine max
  Coding DNA Sequence Number=SeqID_42249
LQDVPSVGELMNLDVVFLLKNTPLMKSITWEISPETTFNAGGFSGFQHGQQYNQQHGQWRNHPRNHFNRYQGGPSTRPQQQGPSLYDRTTKLEETLAQFMQVSMSNQKSTESTIKNLEVQVGQLAKQLADRSSSNFTANIEKNPKEECKAVMTRSRMAIQGDDSEAEKKMEEHKQQLAPKPTLEPISDFVELEKINEETKDDKEEETPIKEKEKERTKEEKEKEKK

SEQ ID NO: 133935 - protein, 170 aa, Glycine max
  Coding DNA Sequence Number=SeqID_42250
  Gene Ontology: Mol. function=nucleic acid binding; Biological process= DNA integration
  Homolog annotation: Hit_ID=A5B3J2; Match level="QueryCoverage=94%, HitCoverage=31%, E-value=8e-15, Identity=37%"; Hit description =Putative uncharacterized protein
MQRRSFVDDLTPIDLDINATCRRHNQERIRNFLQDLEVAAIREEKPQSSEASSSFPIAEHSHLDHSEDYIMAEKPRRVTLEDYSSSNVPQFFTSIAQPEVQAQTITYPPSLIQNNLFHGLPNEEPFPHLATYIEICNTIRLAGVPKDAIRLSLFSFSLSGEAKRWLHSFK

SEQ ID NO: 133936 - protein, 140 aa, Glycine max
  Coding DNA Sequence Number=SeqID_42251
LGFDGELKKPPTDALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPKGMPPAFILNQDRTLHEIPSCITYSFP

SEQ ID NO: 133937 - protein, 93 aa, Glycine max
  Coding DNA Sequence Number=SeqID_42252
MTFIAQSNTSRLGFPALITALFRARGVVFDSLTFECLSPVINLANIKKNCCNPEDLTVSIQGAKRARERPAELPSTSAAPTPASTSAAPFVPA

SEQ ID NO: 133938 - protein, 193 aa, Glycine max
  Coding DNA Sequence Number=SeqID_42253
MASNSQQFSARNDAIVLRGVHEVATDSSSSTENKKLEGKLDALVNLVTQLAMNQKSAFAPVARSQQRQQATEAPPQPSLEELVRQMTIQNMQFQQETTFIQSLTNQMGQMATQLNQAQSQNSGKLPSQTVQNPKNVSAITLRSGNQIQVPSPVAAPALKPFKLHSTLEKEDEIVSQKRKLPDQGPSSSSSNLQ

SEQ ID NO: 133939 - protein, 79 aa, Glycine max
  Coding DNA Sequence Number=SeqID_42254
MPNIVNLMYFNFNFNEACALSENHALSEALSPLSELGESGVESEKHLRAQRVISSLNEVFISSCAKRTQLTQQIFTNSR

SEQ ID NO: 133940 - protein, 373 aa, Glycine max
  Coding DNA Sequence Number=SeqID_42255
  Homolog annotation: Hit_ID=Q84VI1; Match level="QueryCoverage=89%, HitCoverage=53%, E-value=1e-160, Identity=82%"; Hit description =Envelope-like protein
SRRSKVAIPSKKRKEISSSDSDKDVELDVSTSKKAKTSGKKVPGNVPDAPLDNISFHSIGNVEKWKYVYQRRLAVERELGRDALDCKEIMDLIKAAGLLKTVSKLGDCYEGLVREFIVNIPSDISNRKSDEYQKVFVRGKCVKFSPAVINKYLGRPTDGVIDIDVSEHQIAKEITAKRVQHWPKKGKLSAGKLSVKYAILHRIGAANWVPTNHTSTVATESFAIKLHIAFPTVLCGIMLSQHPNMLNYTDSVMKRESPLSVHYKLFEGTHVPDIVSTSVSTSGKAAASGAVSKDALIAELKDTCKVLEATIKATTEKKMQLELLIKRLSESGIDDEEAAEEEGEAAEEEEEAAEEEEDAAEETESDDDSEATP

SEQ ID NO: 133941 - protein, 279 aa, Glycine max
  Coding DNA Sequence Number=SeqID_42256
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIILLMACIDLSHSMMQSIVYLVFNAMDSEPWHLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133942 - protein, 151 aa, Glycine max
  Coding DNA Sequence Number=SeqID_42257
  Subcellular localization annotation: CTP_CleavageSite=61; ConfidenceScore=5.36e-01
MVKVGTSYVPINVSFSPKVGPGLPGINSWTLRGALFIAHSSGMKLGLSAHNSHTSIPSRTSAASVKPGSDAELTTTPAALIALPLRLPAFQALKAECAYGDYMLGNCARVFQSNALANWSSTVGRAAALELVDPHGAGIRSDFRDREVYTQ

SEQ ID NO: 133943 - protein, 159 aa, Glycine max
  Coding DNA Sequence Number=SeqID_42258
  Gene Ontology: Mol. function=aspartic-type endopeptidase activity; Cellular component=small subunit processome; Biological process=DNA integration
  Homolog annotation: Hit_ID=A5BHJ1; Match level="QueryCoverage=93%, HitCoverage=12%, E-value=4e-17, Identity=32%"; Hit description =Putative uncharacterized protein
FRFHSNDKRSEWEKLDYQLCAAQEIFANDIQSLFDATMKVTALKQTSHDMIAHVGKARAAVEELRKFLVADSLEEVNRKLDKFYMVLILRSLHSDFDYVRDQVLARDQVPSMDSFITRLLRVPHLLKDENLADGVETSAMVASRGRGDSHNNRGGRSGR

SEQ ID NO: 133944 - protein, 143 aa, Glycine max
  Coding DNA Sequence Number=SeqID_42259
MAAQFIHERVEMECLEGVWETLEGNARCRFRGTIRLTATSLVHPEEPTCTLQRTVEWILPTPTPYLLVEPVQVIEVTSSEEDPEEDPEELPPEPAVDALDFLEGDEDPLPEVDSPEDVMSAFEAGSMEESGPRGIATSGGSSS

SEQ ID NO: 133945 - protein, 107 aa, Glycine max
  Coding DNA Sequence Number=SeqID_42260
MVRMTKGIEDDVSLPASTGSFAPGLRKVSITIRTTKGAEDDLVRRQKVQKTMLVSARQRGRLPLVRTKGADNHKVTPHVSLTSQVRTTKGGEDDVSLWASFGSFAHG

SEQ ID NO: 133946 - protein, 61 aa, Glycine max
  Coding DNA Sequence Number=SeqID_42261
MTIPKTPKSLRIGDSVFQRLYELQNKERETYGSTRAIKGINSRTHQQESSKAIVQAINGAK

SEQ ID NO: 133947 - protein, 131 aa, Glycine max
  Coding DNA Sequence Number=SeqID_42262
MYYGTQSDIRVKSYCRLNLLRASTFNSERLDILRDSFRHPSKRLLSFELALRFRIQFRASQRLRDSIRHPSKKLLSFELAQSFRINFERIDVLRDSIRHPSKTLLSFEFAQSFRIPFRSSRYITGLNQISE

SEQ ID NO: 133948 - protein, 163 aa, Glycine max
  Coding DNA Sequence Number=SeqID_42263
MQQPILRCPSQPLNIHDITLKDKQDENWGQLFAPMISQWNNRADFRVNGYPRQEDLLSFNSDYMVWLKLRRHYIDDLMSYVEKIAILSEEQERITEPLAHGPTSEHQFPAQEFHILQPSVETQGIGRRKMVVEAEEYSQQMTERVHGMYYTPPTFSQYLTQMY

SEQ ID NO: 133949 - protein, 51 aa, Glycine max
  Coding DNA Sequence Number=SeqID_42264
MGFIGSIVIVNTEKIFGGSPLSKCGWVGGPGNDRRFFSPIITTRKVRLSLC

SEQ ID NO: 133950 - protein, 196 aa, Glycine max
  Coding DNA Sequence Number=SeqID_42265
  Homolog annotation: Hit_ID=A5C4I3; Match level="QueryCoverage=26%, HitCoverage=20%, E-value=4e-11, Identity=67%"; Hit description =Putative uncharacterized protein
MAARALGVPRHLRAPGVGLWAPHSARLETRTKESDMCASQRASKPHTCRDPKDGELCLSGAKPEETLVEARSDTDVQIDSWSPRARSIGPRHGIESSKWAIFGKQNWRCGMNPEAGQQDGGHGSRNPLRRRGGRCKTQGASPGGAVVGADLGGTGEARLIALCARTPKGNRPAHPGNGSAGGRVQRLEEHRTSRGV

SEQ ID NO: 133951 - protein, 86 aa, Glycine max
  Coding DNA Sequence Number=SeqID_42266
MVNVLATLASMFQLTPHGDFPYIEFRCHGKPTHCCLIEDEQDDKEYPREASENDKRTLRRLVMFALRDTTCLCGCEIYRQVHQIVK

SEQ ID NO: 133952 - protein, 268 aa, Glycine max
  Coding DNA Sequence Number=SeqID_42267
  Homolog annotation: Hit_ID=Q6WAY6; Match level="QueryCoverage=35%, HitCoverage=15%, E-value=6e-10, Identity=41%"; Hit description =Putative uncharacterized protein
MKQTRNDVVGLPRKYLEGKARDMASQEKWGPFADTLALLIFGVVFFPNMDGLVDLAAIDAFLAYHHSKESPVMAILADLFDTFDRRCEKNSVRIVCCLPALWTKGCINYNPALAIRQLGHPMRGAPTEESLSPFLVKDLGAQSLKVIQRVHKAWRSPLRKDKELRGIRNGVIGGYHGWLKVHTRGLDWLSKLKVINEENFEAPEEDEEVQALKLELGKARLAKEKFKSAATHIRKECTELQEENAATARALEQETKRARKEEHGRDKF

SEQ ID NO: 133953 - protein, 381 aa, Glycine max
  Coding DNA Sequence Number=SeqID_42268
  Homolog annotation: Hit_ID=A8U7M1; Match level="QueryCoverage=65%, HitCoverage=52%, E-value=5e-14, Identity=25%"; Hit description =Putative uncharacterized protein
  Subcellular localization annotation: CTP_CleavageSite=47; ConfidenceScore=5.46e-01
GVAAFAPTAALAVATTFGTASTGTAIATLSGAAATNAALAWLGGGALAAGGGGMSAGSALLALAGPIGWGIGAVGIAGGTLLARRKNGKIIDEAQQEERQVRAKTSELRVMERGAQELKMLTSEHYHVGDQLIGSAVNAINQTRIDSELLKLSQQDRAFELAGEQMQKVRDFIASPGNILGSMSTKHGEIAEQVEVGVRNARQAIEERVQDASDLSATFVGVGRTAPADYMIDGVDVQSKFINGVNNNLNHVLQHMETYPNFTQGESFYHIPKDSWQTIQDVIDGKPVEGLSEKTIQAIRDKVAEIESTTGRSFNDVVRPGVSDYKDVQWGKIDETLDKHDQELAEQNEAKKSEIIDDHQPSLSEGMRATAMGAAFGGTLL

SEQ ID NO: 133954 - protein, 88 aa, Glycine max
  Coding DNA Sequence Number=SeqID_42269
MERYLQHLVRQQAANHHGQVQIHECLYRFSLSQQGQGSAPFACLTPEQFGAEVAWPGDWPEAQAGEEPARSPSEEEEARMDEDMTDCS

SEQ ID NO: 133955 - protein, 419 aa, Glycine max
  Coding DNA Sequence Number=SeqID_42270
  Homolog annotation: Hit_ID=Q6WAY6; Match level="QueryCoverage=84%, HitCoverage=60%, E-value=3e-28, Identity=28%"; Hit description =Putative uncharacterized protein
MKQTRNGVVGQPRKYLDGKARDMASQEKWVPFADILALLIFGVVLFPNVDGLVDLAAIDAFLAYHHSKESPVVAILADLFDTFDRRCEKNNARIVCCLPALCVWLVLHLFQQDIRHLCPLQSYRSCVEKSRVDWDQHLVGIGGNAINWFPRWKEGKEGVLFSCGDYPNVPLIGTRGCINYNPALAIRQLGYPMRGAPTEESLSPFLVRDFGAQSLKVIQRVHKAWRSPLRKDKELRGIRNGVIGGYHGWLRVHTRGLDWLPKLKVINEENFEAPEEDEEVQALKLELGKARLAKEKFKSAATNIQKECTELREENAATARALEQETKRARKEEHGRDKFRGALWGSNNELKLRREERDHSRVHGMILKEELAACARSKRSLAQHLEATEQSMLAIIGQYKEELNQSVTHEQKLVEDFAY

SEQ ID NO: 133956 - protein, 89 aa, Glycine max
  Coding DNA Sequence Number=SeqID_42271
MTEARQKGVRKLSKKLTDCAKTPPFDLRHITEFHGSRRYMFQGSEVEGVERTKKEEEERRGNKTEVLSDHDCDQSLHCSSFSVLRATVG

SEQ ID NO: 133957 - protein, 103 aa, Glycine max
  Coding DNA Sequence Number=SeqID_42272
MKRYMMRPRNKPERVYSVLLIQEPNGKDPKVIHCGDRDYQRQCITKRGKLQMRLHCYQANRRPSMTADRPPLLMPHIDPGIGPDISTCVQSCRCHVCIEQKYF

SEQ ID NO: 133958 - protein, 15 aa, Glycine max
  Coding DNA Sequence Number=SeqID_42273
EDVSPLMVRTYSPLK

SEQ ID NO: 133959 - protein, 30 aa, Glycine max
  Coding DNA Sequence Number=SeqID_42274
MGENFLIDPYVSLEAHARCPSLPPVREPIA

SEQ ID NO: 133960 - protein, 136 aa, Glycine max
  Coding DNA Sequence Number=SeqID_42275
MGKKKLELGFEDQKIDFDLFVEDKPAPEHNVFLQVMGEGQKVLKVRTKMNLLYNLNIGAYQPPFECPFAKRLLLAKRIIVHVLSHEIQPLSAQPWHMRLINSTKLAKLSDRLIAERWLPLAKRDLVSPSVIHYGQN

SEQ ID NO: 133961 - protein, 92 aa, Glycine max
  Coding DNA Sequence Number=SeqID_42276
MALARDFCKETTHGGFWFRIGSKIPLAIYTLGMIAKYLDVLEIPRCAHVQFLVPQMLGVCMYVNLAKEMCVMNGTEEACLKEVQEGQGGRRN

SEQ ID NO: 133962 - protein, 77 aa, Glycine max
  Coding DNA Sequence Number=SeqID_42277
MSLHVLYLYVFSGFPPGIPRLLGMIILSYLLGQRQNMDSRNQSRYLGTDASGDGVTTDRSLPLLCAKQAENVVQGSP

SEQ ID NO: 133963 - protein, 231 aa, Glycine max
  Coding DNA Sequence Number=SeqID_42278
HALRRPYRTRARARVMGEAEEVQEKMKADMEAMKEKMATMMEAMMSVKKIMEANAVAIAATSVVAKVNPTSPSGINQMNHPTSDMVGKDLGSTGGPHDVQIQNEHAFPPYGLPLNYTPPNVAYTPNKNVNNSTPIPIESQQPQTDHAHGKQLVVYPLKTLRKALSITPSYTSAFHNNEDYAFANLKELFIEPNIITPPKFKVLDFDKYRGDYLPQEPSKDVLSEDGGMRKK

SEQ ID NO: 133964 - protein, 237 aa, Glycine max
  Coding DNA Sequence Number=SeqID_42279
VEGCPTCAGTHEPGQCVSQQDTSREVNYMGVPNRGFQGYNQGNSSGFHQGGAGFNHGPPGFNQGRNFTQGSGWRNQGNQYKEQRNQQPYQPPYQHPSQGPNQQDKPTNIEELLLQFIQETRSHQKSTDAAIRNLEVQMGQLAQDKAERPTRTFGANTEKNPKEECKAVLTRGQKKAQEEGKVEEEDQTEEDRTETQEERTEEEEEKVAPPPTTKSQKAREAKKEEPPALPQDLRYPV

SEQ ID NO: 133965 - protein, 47 aa, Glycine max
  Coding DNA Sequence Number=SeqID_42280
MTRQTLASQVTLTRLKVVLKPGDPKAYTPKSPSGPLPPDSGPTQKIF

SEQ ID NO: 133966 - protein, 88 aa, Glycine max
  Coding DNA Sequence Number=SeqID_42281
MLQVDLEDPLCERAIILYIACLDSRDCHHQKGGDCRQRIKLNVLMMPKDHMFLKALFKTKKLKIFKMDDKDSLQSLRKGILNRKGIPN

SEQ ID NO: 133967 - protein, 131 aa, Glycine max
  Coding DNA Sequence Number=SeqID_42282
MAPTRHPLDQDKSNRALGFPALITGLCQSFRVPVTPSKVIRPPITRAFIEKYCTQRQVQGDAPQAADAPPPYQAGPAGSFDTEQAEVAWPGDWPEAQAGEAPAEAPDEADEAHEDEEMIDLLYFLGGSGAT

SEQ ID NO: 133968 - protein, 88 aa, Glycine max
  Coding DNA Sequence Number=SeqID_42283
LRASVLNFELLDTLRDTIGHPSKKLLSFDTAQSFYSKFKRLDILRDTIRHPSKKLSSVEFAQSFRFQIRASRYITGFIRTSVLKVIVV

SEQ ID NO: 133969 - protein, 104 aa, Glycine max
  Coding DNA Sequence Number=SeqID_42284
  Homolog annotation: Hit_ID=A0PAV3; Match level="QueryCoverage=36%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGRRPHSPFRLRNCWEGRSVRASSLLRQLGERGMCCKAIKLGNARVFPVTTL

SEQ ID NO: 133970 - protein, 63 aa, Glycine max
  Coding DNA Sequence Number=SeqID_42285
MVKVGTSYVPINVSFSPKVGPGLPAVPPVQLLTGWCVTAKAPPDISAGKCSGHPARNHHTRRA

SEQ ID NO: 133971 - protein, 79 aa, Glycine max
  Coding DNA Sequence Number=SeqID_42286
MARLARISGFWLSASLLAQLGGCRRCAYSSFFQSLLCAHPADVALSGLLAQCVKRLSESINFALHQSCPFYLKLKWNDH

SEQ ID NO: 133972 - protein, 152 aa, Glycine max
  Coding DNA Sequence Number=SeqID_42287
MAPTRHPLDPDKFNRALGFPALITGLCQSFGVPVTPSKAIRPPITRAFIEKYCTQRLVRPDHLTRSSICGIWFTSRRPTTGHILQSQGFTSFSCPTPDQFRAEVAWPGDWLEAEAGEAPAGAPAEAPDEADEAREDEEMTDLLDFLGGSGAT

SEQ ID NO: 133973 - protein, 58 aa, Glycine max
  Coding DNA Sequence Number=SeqID_42288
MRGQDIYSSQDEVTTSPSSSESEEAKEEESSEEIYLQEEGGGDLLMIVVHVAIVAAQD

SEQ ID NO: 133974 - protein, 124 aa, Glycine max
  Coding DNA Sequence Number=SeqID_42289
GYTPSPWVLVTLTVERAARPHLQRTTRPRLRGLHALNSRGLHVLALRGLHVLTLGLHVLTLRGLHVLTIRGLHALTSRGLHVLALRGLHALTLGTSYPHRQRTTRPRLERTTRPHHQRAARPHL

SEQ ID NO: 133975 - protein, 213 aa, Glycine max
  Coding DNA Sequence Number=SeqID_42290
MGEAEEVQEKMKADMEAMKEQMATMMEAMMSMKKIMEANAVIVAATSAVAKVNLMLPSGLKQMNHPTSNMVGKYLGSTDDPMMCKFKTSTPSRHMACLPNYTPPNVAYIPNEDVNNSTPILIKSQQPQSDHAHVSRPMEETHEIPHHNLADFEPWLRYATEGQAVGGIPFENTLEGPQFRPQPQPSRSTVVKNPHDYGRNGKVGSSRGKAQGH

SEQ ID NO: 133976 - protein, 160 aa, Glycine max
  Coding DNA Sequence Number=SeqID_42291
MKKRGTGHQSVSLENKTGDSTVLKIEDSAKVVIKQDMKGRRHKYGFNNNKREKPEKIMGSPLASPPPPPPPPPTLSDASTSPSAVKRTRKASRLRSLSTRPPSVERPVVHVDPATDKVDGPHRKKLRTYLGIVAHDKVDVTYENWKEVPTAQKDLIWEDI

SEQ ID NO: 133977 - protein, 278 aa, Glycine max
  Coding DNA Sequence Number=SeqID_42292
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKSWPRAFRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLNSMPFLVDRSTILRPLLDLACLLAPASISTLAAAWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133978 - protein, 146 aa, Glycine max
  Coding DNA Sequence Number=SeqID_42293
  Homolog annotation: Hit_ID=A5AZG1; Match level="QueryCoverage=61%, HitCoverage=30%, E-value=3e-07, Identity=34%"; Hit description =Putative uncharacterized protein
  Pfam annotation: Domain name=zf-CCHC; Domain location=88-105; Score =22.6; E_value=0.00058; Accession=PF00098.14; Description=Zinc knuckle
MRENERKPQEANINLPYFHGKDNVEAYLDWEIRIEQKLKRKSTLKSYGSHSYPKKDQGLGILGAAPSKRKTIEKQPPKASMQEKTSYIKCFKCLGRGHITSQCPTTKTMIMRDQDIYSSQDKATTSPSSSESEKAKGEESSEEIYP

SEQ ID NO: 133979 - protein, 153 aa, Glycine max
  Coding DNA Sequence Number=SeqID_42294
  Homolog annotation: Hit_ID=A7PHZ5; Match level="QueryCoverage=35%, HitCoverage=22%, E-value=2e-07, Identity=50%"; Hit description =Chromosome chr13 scaffold_17, whole genome shotgun sequence
  Pfam annotation: Domain name=DUF1635; Domain location=9-152; Score= -59.9; E_value=7e-05; Accession=PF07795.2; Description=Protein of unknown function (DUF1635)
MKKEFVLMHGLEDLGHSLLYTTLLLDATIASAKEDITRRECELIHVNDLLSRVIKERHEAQPKCQKLMLEKLELQQKQQLEQHQFVQTHQRDTISQSEEEQQEGFSEKNSASSDCEENSSMPSPGGSWTTASGTSLSRTSPTVATPSSTTQTA

SEQ ID NO: 133980 - protein, 340 aa, Glycine max
  Coding DNA Sequence Number=SeqID_42295
MGNETHVDGGVGFVCELLAFYIALLTSVIAKTMLTKARWHFYFTSRTRSKTLPSLFSLSSSCLKSLFSFSSRLKSAGNRFLDTHIVLARTHRTPYTVGKPTLSSLEPTEPPTLFLEVWLKENPTYTVATRVLKHSWVLKAQSFLREVRRSTSCMLSFRGCSCFIDDNNTSSVAILLIEVRGKLKVSCHFVRSHCHCHCLGSRLLGAPVEITSDKDPVIVASGLCKVSYVGTPSVWPCFVQIDPCSSKVATGNFVVCAMPEFVCFMAKLLHRLMLCSSSVTSFVRHPMALLNTIFYASLKLVNAKKKNFKKAYDDLLTHPSLLCMFPHDPTSRLSSSSCTM

SEQ ID NO: 133981 - protein, 253 aa, Glycine max
  Coding DNA Sequence Number=SeqID_42296
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVDAICVEIHCALQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133982 - protein, 83 aa, Glycine max
  Coding DNA Sequence Number=SeqID_42297
  Homolog annotation: Hit_ID=A7VSA3; Match level="QueryCoverage=65%, HitCoverage=47%, E-value=2e-07, Identity=56%"; Hit description =Putative uncharacterized protein
  Subcellular localization annotation: CTP_CleavageSite=56; ConfidenceScore=5.15e-01
MQHLYESQYHPVKDWFCCSYVKGWPPSIPLSFGLATVLPRRSVSRVSWAPDPRRPRANTHRLRHGLPGYLIPFAPHAFALQRR

SEQ ID NO: 133983 - protein, 70 aa, Glycine max
  Coding DNA Sequence Number=SeqID_42298
MLPYYFQIPLGAILAIVDPVVIGIVEKPEVIAVLKLIKSGLAVIAGKSIVLKPRTQNYLIYTHQLLLSTT

SEQ ID NO: 133984 - protein, 272 aa, Glycine max
  Coding DNA Sequence Number=SeqID_42299
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDIHLKEFCGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133985 - protein, 55 aa, Glycine max
  Coding DNA Sequence Number=SeqID_42300
MTCPLGPEVHRADFRAINSLQPYGNLEPVSPFVALEFQEWAFTFSGSISIPFWLT

SEQ ID NO: 133986 - protein, 94 aa, Glycine max
  Coding DNA Sequence Number=SeqID_42301
MVEKFLKKYFLESKTVERKTPTHGFSEPVQLNIFIDGLQPHSKQLHDVSTGGKIKLKTLEEAMELIENMAASDHAILCDRAYMPTKKSLLELTS

SEQ ID NO: 133987 - protein, 172 aa, Glycine max
  Coding DNA Sequence Number=SeqID_42302
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=100%, E-value=1e-10, Identity=31%"; Hit description= UPI00006A17C9 related cluster
  Subcellular localization annotation: CTP_CleavageSite=13; ConfidenceScore=5.38e-01
VMLVRMIRTRLFAAARVKSCPGMHSSCVIASLSGCARTVGRPPISRGGPGTVRMWSTLKMRTRSPLKVRACSPLKARTCSPLEVRACSPLMVRTCSPLKVRACSPTKVRTCSPLMARACSPLKVRTCSPLKVRACSPTKVIGYKYPRVHPYEKARDRLIERAGHPKSTRFGH

SEQ ID NO: 133988 - protein, 41 aa, Glycine max
  Coding DNA Sequence Number=SeqID_42303
MEINYEPWGTPRYHFSKGACKNLIKIRCLGPNFGLMSPREK

SEQ ID NO: 133989 - protein, 272 aa, Glycine max
  Coding DNA Sequence Number=SeqID_42304
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLCCIMALVLVVIFFDNSSPWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 133990 - protein, 123 aa, Glycine max
  Coding DNA Sequence Number=SeqID_42305
MDFFSNESFECIQAFENSNLILFMSLKMPVYTELVKAFYSNLEIQEGTLISEVYGIKMVIDQSLFYDLTQLSSEGVPFEVGLHQPSRYDRKASCQFIGFGKPHPSLSHFAYHASKIFKPCTGF

SEQ ID NO: 133991 - protein, 153 aa, Glycine max
  Coding DNA Sequence Number=SeqID_42306
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-25, Identity=55%"; Hit description =Putative uncharacterized protein
MTMITPSSKLTLTKGNKSCYPTEICAVFISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 133992 - protein, 100 aa, Glycine max
  Coding DNA Sequence Number=SeqID_42307
MAEFDAESESEIDIDYMSGDVLPLEIDFLELDRTNHVSGSTHTSDFLYEVQAEKPSLSTIIHPPTPESKPLPSNLKYAYLDDSCHNLISSGDYCLMTCNL

SEQ ID NO: 133993 - protein, 108 aa, Glycine max
  Coding DNA Sequence Number=SeqID_42308
  Subcellular localization annotation: CTP_CleavageSite=50; ConfidenceScore=5.71e-01
MATPPSSPPPPPLLTGVASHSSSTLKQTRKATRLRSLVTRPVGAKRPLVYVDPATGKADGPHRKRLRTYLAIATADKNSVDDTVCEKYDISKEKWAQFCQSRRDPSWE

SEQ ID NO: 133994 - protein, 126 aa, Glycine max
  Coding DNA Sequence Number=SeqID_42309
MASKMWKCLTVGFLPFQISYQCGWSPSSKCDSVVDRIMSDAFGCAESVNLLNSLNTSKVSDFSLIKLTQHPGSGLMLKLLVGHLDLLSNLTFTTDSAFFYFQIGNASTAPLSMIFFMPLKCRCPNL

SEQ ID NO: 133995 - protein, 80 aa, Glycine max
  Coding DNA Sequence Number=SeqID_42310
MAASERGSLVSHQQKLCQRGSDNESCEGNDTEELDVDFEQLVNQAEDGEDEDWGFPSELKRMVEQEDKEVDAILPRKGIG

SEQ ID NO: 133996 - protein, 146 aa, Glycine max
  Coding DNA Sequence Number=SeqID_42311
  Homolog annotation: Hit_ID=Q6WAY4; Match level="QueryCoverage=96%, HitCoverage=25%, E-value=2e-14, Identity=33%"; Hit description =Putative uncharacterized protein
MGHLQMQAFRKAYEKILDLAIAEISIEAVVSLTQYYDQPLRCFMFGDFQLVPTVEEFEEILGCPLGGRKPYLFSGFLPSLSKIADVVRDSARGLDRVKQTRNAVVGLPQKYLEGKARDMENQEEWVPFMDVLALLIFGVVLFPNMD

SEQ ID NO: 133997 - protein, 30 aa, Glycine max
  Coding DNA Sequence Number=SeqID_42312
MNSRNQPKVLRNEGNWGWGHDRLIVAPSLR

SEQ ID NO: 133998 - protein, 113 aa, Glycine max
  Coding DNA Sequence Number=SeqID_42313
YCTTRQAQGGDAQALDAPPPPPQADPAGSFDTERYLRHLVRQQAANHRAHSQGFPSFPCPTPDQFREEVAWPGDWPEAQAGEAPAEAPGDADKARMDKEMTNLLDFLGGSGAT

SEQ ID NO: 133999 - protein, 122 aa, Glycine max
  Coding DNA Sequence Number=SeqID_42314
GAAPTDYDWTAVDSFSKLHFPSGREEGASPYLSEGKRIKAILLYFTRLATELTQLKEAGKERASRQLRQQKLELRNTEEKRIQLNLSLRAVQRRESKASSPVSAESMDSPGTSLPQLGTFKE

SEQ ID NO: 134000 - protein, 129 aa, Glycine max
  Coding DNA Sequence Number=SeqID_42315
MTFLLSNILPSDRNANLPLQKYQLVCVVPTWGSHPQRHPVDLKKSNRALGFPALVTGLCRPYRAPVPPSKFMSSWHRECLSCVALTTDAPPSPLEFTSAHPQKGLSIAYTTWPTNRRPSPKPKDAPSCS

SEQ ID NO: 134001 - protein, 189 aa, Glycine max
  Coding DNA Sequence Number=SeqID_42316
MKANKTRNELKVSDSKNYPLKNEERMKNDGKPSRIRSRKRLGSVTEAPRLGFSSWKLGYDTWEGYIDIVVPRKILPERNVVIYHTEFDEFKEQLERRKWDEELTSFDGGSIDVPLFALLRLDPQELAAKLCIPGRGFELNVDGLPLKILKKNLATLDQTWSVLSFSNLIPTSHTSDITLDGAKLIYGIT

SEQ ID NO: 134002 - protein, 106 aa, Glycine max
  Coding DNA Sequence Number=SeqID_42317
MIPTQEGDQPRHAPAPDHAEYMQPAIPQVSVAFDPSPHAVDVYEGYEAIAERLERVLNLRMVTAGTELHDIMQDCLTIARGVPVQMEVSGLDRDGAQSIDYCFYVL

SEQ ID NO: 134003 - protein, 163 aa, Glycine max
  Coding DNA Sequence Number=SeqID_42318
MAPTRHPLDPDKSNRALGFPALITGLCQSFGVPVAPSKVIRPPITRAFIEKYYTQRPAQGDEPQAADALPPHQAGPNWAANHRAHVQTHGCLYQLSLSLQSQGFTSFPCPTPDQFRAEVAWPRDWPEAQAGEAPVEAPGEADEAREDEEMIDLLDFLGGSGAT

SEQ ID NO: 134004 - protein, 62 aa, Glycine max
  Coding DNA Sequence Number=SeqID_42319
VMFVMEVRKTDFVGVLGMAFVDNWVVGKEKVGYWLSNDIVGLVGNLATRFDPSAGEDQIRKA

SEQ ID NO: 134005 - protein, 295 aa, Glycine max
  Coding DNA Sequence Number=SeqID_42320
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIVHSADRCATMLSPRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134006 - protein, 281 aa, Glycine max
  Coding DNA Sequence Number=SeqID_42321
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.07e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSITATVHPMAVTTVETGQLTRDISRRNEMPLQHIMEVEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134007 - protein, 208 aa, Glycine max
  Coding DNA Sequence Number=SeqID_42322
  Homolog annotation: Hit_ID=A5C365; Match level="QueryCoverage=56%, HitCoverage=13%, E-value=3e-07, Identity=29%"; Hit description =Putative uncharacterized protein
MVKEECKEVSVSSKRLAKKERHFEIKTNIKEISLLRQPPHFLLCKKTLVSIATSLRLEFIPQVKELLDEGLVRKSLNPCALLVPKIGIIRHQIPKIGGMMNALGGATLICKITRAPNIFMICVHRDSLGRNNQHENTEKGVPMNPKRIKVIPEWPAPPSVRKIWGFHDLTNFYKSTTHRVGEELCSFMGRCPKNEFSDLTLLQHTEHH

SEQ ID NO: 134008 - protein, 259 aa, Glycine max
  Coding DNA Sequence Number=SeqID_42323
  Homolog annotation: Hit_ID=Q2HW90; Match level="QueryCoverage=67%, HitCoverage=32%, E-value=7e-18, Identity=35%"; Hit description =Putative uncharacterized protein
LFLNVDRLVDLAAIDAFLAYHNHKESPVVAMLADLYDTFDRRCEKSNTRIVCCTPALYVWLVSHLFRQEVRHACPLESHRSCTEKGGPNWDQLLASKEGASVNLFPRWKEGRTGVLISCGGFPNVPLMGTRGCISYNLVLAIRQLGYPMRGAPLEDELAPVISRGFNKTNMETLQKEVEAPEEDEEVQALRAELEQAQIVKERFKSAALKIRKENTELRDVNVATTKALERETKRACREEHGRNKFRGALWGSNSELKL

SEQ ID NO: 134009 - protein, 119 aa, Glycine max
  Coding DNA Sequence Number=SeqID_42324
  Gene Ontology: Mol. function=phosphoprotein phosphatase activity
  Homolog annotation: Hit_ID=A5C0F5; Match level="QueryCoverage=73%, HitCoverage=13%, E-value=2e-17, Identity=41%"; Hit description =Putative uncharacterized protein
MEAGNTYVSHEMRRVYYHSTRRLCVVRWLRRGNQHIDNDDVKVFRRKFDIMKRHEFVWEPYPSTVMSFLPPVCLVGSLAWYAVVPLICFQVIEWHQPDRVLRQFGMQQPVPESPSQGIL

SEQ ID NO: 134010 - protein, 190 aa, Glycine max
  Coding DNA Sequence Number=SeqID_42325
MGLSQKPSFKKRFYQVKIKSLEVTSLRELGQLMGQLQRQAFRKAYEFLKSPNLGAGIRPPKASRKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 134011 - protein, 100 aa, Glycine max
  Coding DNA Sequence Number=SeqID_42326
  Subcellular localization annotation: CTP_CleavageSite=37; ConfidenceScore=5.56e-01
MRGYPMVTRSFGQLGANEPVGARRFTSSSTPFSVLTRANAHVDARRLTLFAAPFVVLTREVNGYAGLPYGYPHLWSTRGKRARWRAETNIIFYTFCRPDP

SEQ ID NO: 134012 - protein, 78 aa, Glycine max
  Coding DNA Sequence Number=SeqID_42327
MASDFHVQKLCNSCLGTGNRLHTLIAMAAQLIHDRVVMESLEGVWETLEGNERFRFRGTIRLTATSLVHPEEPSRTLQ

SEQ ID NO: 134013 - protein, 151 aa, Glycine max
  Coding DNA Sequence Number=SeqID_42328
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=3e-24, Identity=54%"; Hit description =Putative uncharacterized protein
  Subcellular localization annotation: CTP_CleavageSite=25; ConfidenceScore=5.38e-01
MTMITPSSKLTLTKGNKSWYRAPPRGASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134014 - protein, 125 aa, Glycine max
  Coding DNA Sequence Number=SeqID_42329
  Homolog annotation: Hit_ID=Q8TGM5; Match level="QueryCoverage=31%, HitCoverage=58%, E-value=7e-08, Identity=74%"; Hit description =Uncharacterized protein ART3
MNPDFNQPRGGCSRGGRRALGLMASGATCVQRLDGSRDSAIHTKYRISLRSSSMQEPRYPLPRVIVCKCCVVTTPAGHRLRAPGVALNRFEFLGGTKRRGFVFVARTRRPGARAPWSSPSLPDGR

SEQ ID NO: 134015 - protein, 124 aa, Glycine max
  Coding DNA Sequence Number=SeqID_42330
MSGFTRNSPQISASPHQLDLAPYASEPYHAQWNAPGLLRDKHTLRSSRILEEMEVDEPWLGLWLPLNYQVDMGSSLAYDNRIWGEPYKLFAAKFLFVGGLRHWKCGRQTLVDLGMAFVDNWVVG

SEQ ID NO: 134016 - protein, 216 aa, Glycine max
  Coding DNA Sequence Number=SeqID_42331
  Gene Ontology: Biological process=transposition, DNA-mediated
  Homolog annotation: Hit_ID=Q1J7G7; Match level="QueryCoverage=18%, HitCoverage=71%, E-value=5e-12, Identity=74%"; Hit description =Transposase
MVKVGNSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLHFHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 134017 - protein, 68 aa, Glycine max
  Coding DNA Sequence Number=SeqID_42332
MDGEEGQSRLRPRSEVETKLTAEINQGTDAILPRKGPITRTMSKRLQEDWARAAEEGPRVLMNLRVDF

SEQ ID NO: 134018 - protein, 230 aa, Glycine max
  Coding DNA Sequence Number=SeqID_42333
  Gene Ontology: Cellular component=viral envelope
  Homolog annotation: Hit_ID=Q84VI1; Match level="QueryCoverage=82%, HitCoverage=27%, E-value=2e-91, Identity=89%"; Hit description =Envelope-like protein
EITAKRVQHWPRKGKLSAGKLSVKYAILHRIGAANWVPTNHTSTVATGLGKFLYAVGTKSKFNFGNYIFDQTVKHSESFAVKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 134019 - protein, 136 aa, Glycine max
  Coding DNA Sequence Number=SeqID_42334
MLVPKLWFFPVGGLQKTIISIATPLGLEFIPQVKELLDGGLVRKSLNPCALLVPKIGIIRYQIPKIGGMMNVLSGATLFCKITRAPNNFMICVHRDSLGSDQGVPMNPKRIKVIPEWPTPPSVEEKSPEFQDPQDL

SEQ ID NO: 134020 - protein, 80 aa, Glycine max
  Coding DNA Sequence Number=SeqID_42335
MKPTKEEVMILHEIRRPNSRKTVPSGVANCRNLPFGGRATRGSRVRLPREEGCFPRSYVSSIAMRKSDLCSSLKSGKVTC

SEQ ID NO: 134021 - protein, 83 aa, Glycine max
  Coding DNA Sequence Number=SeqID_42336
MDKVDIFVPHPLTNACLLIQLSSECGCKPLVCLLKRPALLSVDFQDCSIRDYSSCTLVGLPKFVFLEKRVVKNRMLDKWPQLP

SEQ ID NO: 134022 - protein, 97 aa, Glycine max
  Coding DNA Sequence Number=SeqID_42337
MGSEQSDLIPIDLEINATCRRRNQERIRKILQDLEAAATPEEEPQSSEASSSFPIAEHSHLDPTEDYIMAEEPRRATLEDYSSSNVPQFFTSIAQPK

SEQ ID NO: 134023 - protein, 178 aa, Glycine max
  Coding DNA Sequence Number=SeqID_42338
MEAQPEREAITQLLCIPGQDFTRAVAKRRGSRPQDTQWTRRRPTGPWVSSSGYGPLSVLQGARTLPARSCHPNIGIAPAGHPVDPKKSNRVLGFPTLITGLCQFYGMPVTPNKVIRPRINRAFIKKYCAPWQAQGETTQQHGDGWQRAIDAPPPPLEFTSAHPQKGLCVAYDTGPTNR

SEQ ID NO: 134024 - protein, 145 aa, Glycine max
  Coding DNA Sequence Number=SeqID_42339
MQGLDWLTSFRTTKREEVEAPEEDEEVQALRAELEQAQTVKERFKSVALKIQKENTELRDVNVATIKALERETKRACREEHGRNKFGGALWVSNCELKLQREERDQSRVDSLILKDELKACSRSKRSLSQRLCETETNMLAIITK

SEQ ID NO: 134025 - protein, 79 aa, Glycine max
  Coding DNA Sequence Number=SeqID_42340
MQKCPRCGVSWYKVKDDDKGSNDENSKKGPPTKWMYPPLELIHKRCTLSCSQSNPSRCTLYLYHKGCTLQRVKTKISGG

SEQ ID NO: 134026 - protein, 15 aa, Glycine max
  Coding DNA Sequence Number=SeqID_42341
MTVFATNRIPNDKTV

SEQ ID NO: 134027 - protein, 199 aa, Glycine max
  Coding DNA Sequence Number=SeqID_42342
MPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGVPPPPHQAGQAGAFDIEQYLRHLVRQQAANHRAHHAEPGLRSFFMPYSRPVQGRRLHGPGRLARGPSRRGTPQKLPAMEKKAHEDEEMADLLDFLGGSGDT

SEQ ID NO: 134028 - protein, 29 aa, Glycine max
  Coding DNA Sequence Number=SeqID_42343
LEALNSVRCSFTTRILDEDEALLSSIKAR

SEQ ID NO: 134029 - protein, 112 aa, Glycine max
  Coding DNA Sequence Number=SeqID_42344
MTKLGLCVPTDTTVSEWQRGADNRKVSPRIIMTKLGLCVPTDTTVSEWQRGADNRKVSPRIIMTKLGLCVPTDTTVSEWQRGADNRKNDQTWSLRATDTTVSEWQRGADNRK

SEQ ID NO: 134030 - protein, 136 aa, Glycine max
  Coding DNA Sequence Number=SeqID_42345
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MGSCGLFMQGHDLNSCSPGGSIVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134031 - protein, 137 aa, Glycine max
  Coding DNA Sequence Number=SeqID_42346
  Subcellular localization annotation: CTP_CleavageSite=56; ConfidenceScore=5.47e-01
MHTGARFHPCRCKKTSGRSKSNRALGFPALVTGLYSPTGCSFPGKGSRLQDTQWTRRSPAGSWSCQALITGLCQFYGVPVTSSKGIRPPTNGAFIKKYCVPRQAQGEIPQPPGDGWQRATDAPPSPLEFTSAHPQKG

SEQ ID NO: 134032 - protein, 109 aa, Glycine max
  Coding DNA Sequence Number=SeqID_42347
VPMNPKRIKVIPDWPTPPTPLIELVRNHVPSWEDVHERSVEGKSPEYEEPRDLRSNPFQGGGDNAILSPKALASLGIFSRKLLKELFKEVFSKKLLKEVFSRKLLKEAT

SEQ ID NO: 134033 - protein, 87 aa, Glycine max
  Coding DNA Sequence Number=SeqID_42348
  Homolog annotation: Hit_ID=A0ST23; Match level="QueryCoverage=31%, HitCoverage=55%, E-value=2e-08, Identity=100%"; Hit description =Putative reverse transcriptase
MITIQRCPHQNPWNLGRVTGIKLIDTVDLEGGPVGKPVVPAALMNRPTRGERRFAYWALAECILAYYVGTDEGVSEVLHVAGEKRLH

SEQ ID NO: 134034 - protein, 92 aa, Glycine max
  Coding DNA Sequence Number=SeqID_42349
  Homolog annotation: Hit_ID=Q949K8; Match level="QueryCoverage=70%, HitCoverage=23%, E-value=1e-07, Identity=44%"; Hit description=Gag polyprotein
MAGRGRDHNRDVLDRITAVLETLVQERDVEPIEYRGLMAFCKNHPSKFSGDYDPESARLWLVETEKTFVAMGCLEEHKVPYATFMLQGEAEN

SEQ ID NO: 134035 - protein, 116 aa, Glycine max
  Coding DNA Sequence Number=SeqID_42350
MVICALSGDVSIFRSEILHEVIRYPCISRGGGPDDTRRTLRLSAPFCHQSGPMTSRDKIWSFCTLVSSRGGGPDDTRRYLTVIRTLLSSRGGGPDDKQRPNLVILHPCIIQRRRAR

SEQ ID NO: 134036 - protein, 282 aa, Glycine max
  Coding DNA Sequence Number=SeqID_42351
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPITSHFAKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIESFVHVLELLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134037 - protein, 60 aa, Glycine max
  Coding DNA Sequence Number=SeqID_42352
MSKCPICGTSRYKVKDEEESNSDENSNKGPPVKFCGIFQSFQAKIHDVIYDDIGPKIARK

SEQ ID NO: 134038 - protein, 297 aa, Glycine max
  Coding DNA Sequence Number=SeqID_42353
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDAECSAVCLSKKYDPCLPSAPAESAVVESILDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134039 - protein, 222 aa, Glycine max
  Coding DNA Sequence Number=SeqID_42354
MHEEALRLVASNNKPRSDLKFHITKLASTQSELDKLRQENEKLVSSYKATSCVCASTSLNMDDYKALQIEFEKFKKDHYEERTKLQTKLSYLKDLFRKMNRGKSDLSHLLNVQKHTTDNIGLGYNKQTTFSTKIKFASSKKVNPNKVSKKKNIVHSKPKAKTCHYCMKRAHTSYKCYVRRFDVPRVVLKARNSLWYLDSGYSRHMTGDKSRLTDFVSKEGGY

SEQ ID NO: 134040 - protein, 139 aa, Glycine max
  Coding DNA Sequence Number=SeqID_42355
  Subcellular localization annotation: CTP_CleavageSite=48; ConfidenceScore=5.06e-01
MNRARLVYGLVTHMDMNIGTLISGQISSIAQSNSSRLRFPALITAPCRARAVTSDSLTYESLSPSINVAYIKKNCWNVDDMTVNFRGARKARAWPADVPSSSTPPAPSTSVTPTPTPPGPSVQDFQHFESMIQSLYQGQ

SEQ ID NO: 134041 - protein, 170 aa, Glycine max
  Coding DNA Sequence Number=SeqID_42356
MSGLTRDSLQISAGPYQLDLAPYASEPYNAQWNAPGLLHDKHTLRSSRILGEMEVDEPWLGLWLPLNYQVGMGASFLAAKFISWLAFLNCAKGDVRHWKCGRQTLWLILGMAFVDNWAVGKEKVCYWLSNNIVGLVGNLAILEWQSQHGLLLHPHPLHLPQFSHSSKQDD

SEQ ID NO: 134042 - protein, 59 aa, Glycine max
  Coding DNA Sequence Number=SeqID_42357
MKGIIGAPYRARCDGLTITNVSWLPYTEHRGVRAFQEISSFQGQLRWGPMVVTARPERV

SEQ ID NO: 134043 - protein, 238 aa, Glycine max
  Coding DNA Sequence Number=SeqID_42358
  Homolog annotation: Hit_ID=A6BLN7; Match level="QueryCoverage=86%, HitCoverage=39%, E-value=1e-10, Identity=27%"; Hit description =Putative transposase
  Pfam annotation: Domain name=Rep_fac-A_C; Domain location=72-205; Score=-34.9; E_value=0.00025; Accession=PF08646.1; Description =Replication factor-A C terminal domain
MINDLVLEIQEFRESLLDLGIEVRSIFAPIGQGSSQVSGSSQLSSKDVFLSKTEVKNISEINASSEEFVCVTVAKITTIVMNNYSWCYPACGQCYKKVDMQSVSFTCPCGKENNQHVLRYRVEVMVSHKGEQTKFLIWDCECAQLIGQSADEVNMLKIEDGDVDLNASPQALDRLLGCFLAFKVKVQPRFRNSVVLKYSDEPELINVMLDMIPDSEPCCKIKNSILESTDPTVLESVS

SEQ ID NO: 134044 - protein, 235 aa, Glycine max
  Coding DNA Sequence Number=SeqID_42359
MASRKHKSISSRPTAQYDTRRFSSLDAWTRYTDNVLGRNILPERKVKLYHIEINDFKAELERRNFHKRLTNLVDGSIDLALVKEFYANLYNSEDHPPKQSRVRGHLVKIDADSLNTFLETPVVLAEGETLLAYSRYCRLPTNFREIEAILCIHGRGFILNSEGHPGKILRKDLTTLAQVWSVLSYSNLALTSHTSDLTVDRARLIFGLVSHLDMNIGALISGQMTSIAQSNTSRL

SEQ ID NO: 134045 - protein, 25 aa, Glycine max
  Coding DNA Sequence Number=SeqID_42360
MGALCLVGIGAKPTTHKDSYPDEIR

SEQ ID NO: 134046 - protein, 277 aa, Glycine max
  Coding DNA Sequence Number=SeqID_42361
KDSATEGTSVAPEFDSHRFRSAEHQQRFEAIKGWSFHRERRVQLRDNEYADFQEEIAHRRWTSLVTPMAKFDPDVVLEFYANAWPKEEGVRDMRSWVRGQWIPFDADALSQFLGDPLVLEEGQECEYRFCPDRCREMGADHAHQHDHLDSNVDDVTAQQRMPPTRHPLDPDKSNRALGFPALITSLCQSFRVPVTPSKVIRPPITRAFIEKYCTPRQAQGDAPQAADAPPPPHQADPTGSFGMEWYLQHLVRQQAANHRGQVQIHECLYQLSLSLQS

SEQ ID NO: 134047 - protein, 171 aa, Glycine max
  Coding DNA Sequence Number=SeqID_42362
  Homolog annotation: Hit_ID=A5B939; Match level="QueryCoverage=73%, HitCoverage=82%, E-value=1e-17, Identity=45%"; Hit description =Putative uncharacterized protein
MSRRARRSLQNPGREPGRSGRRCRSWCLPTLETAQPEVGSSGWKSTARRVVSGAPPAALENPEDRVPPTPGRTHNRIRSPRWNSLWSMEQWIGSEGWARGSQSRTRRLSVDCSSCFRGESGSSRAGRGTELGTGPSGPLPRASNSQLRTGYGQGESDCLIKTKHCDGPCGC

SEQ ID NO: 134048 - protein, 72 aa, Glycine max
  Coding DNA Sequence Number=SeqID_42363
  Subcellular localization annotation: CTP_CleavageSite=55; ConfidenceScore=5.11e-01
MGVQIAPRPTWALQKIPPEGCCFWRKQPGSPGRAGRQAPPLFCYNRGRKNFAKVLTVLRRSSFVLHRSSIFN

SEQ ID NO: 134049 - protein, 71 aa, Glycine max
  Coding DNA Sequence Number=SeqID_42364
MGTSGSPLATTAGSGNCNRIGFHYLLHAHHGLHHCGPFALSWPPFSAFIFSCTSSASPITLALARVRERMQ

SEQ ID NO: 134050 - protein, 128 aa, Glycine max
  Coding DNA Sequence Number=SeqID_42365
MPLRGNGSEKAFHEEIKEGSSAAHEFDSHHFRSAEHQQRFEAIKGWSFHRERRVHLREDEYTDFQEEIARRHWTSLVTPMAKFDPEVVLEFYANAWATEEGVRDMRSWVKGQWIPFDADALSQFLGDR

SEQ ID NO: 134051 - protein, 19 aa, Glycine max
  Coding DNA Sequence Number=SeqID_42366
VSNVGNRGSAKGCFPLIGE

SEQ ID NO: 134052 - protein, 133 aa, Glycine max
  Coding DNA Sequence Number=SeqID_42367
KVELYHTELDDFKDELERRNFHKRLTNLVDGSIDLTLGKEFYANLYSYEDRPPKQSKVRGHLVKIDADSLNAFLETHVVLAEGETLPAYSRYCMLPMDFREIEVALCIPSRGFILNSEGHPGKILMKDLTTLA

SEQ ID NO: 134053 - protein, 143 aa, Glycine max
  Coding DNA Sequence Number=SeqID_42368
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=71%, E-value=3e-24, Identity=68%"; Hit description=LacZ protein
  Subcellular localization annotation: CTP_CleavageSite=37; ConfidenceScore=5.05e-01
MKHFTDTLISANIQLLLKSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134054 - protein, 134 aa, Glycine max
  Coding DNA Sequence Number=SeqID_42369
  Homolog annotation: Hit_ID=A5C693; Match level="QueryCoverage=49%, HitCoverage=30%, E-value=7e-09, Identity=43%"; Hit description =Putative uncharacterized protein
MASLDSLSFKSIFRNKLFQDHDEGQVNLCLMTKSDENNKEDSVRKKWYIDSGCSKHMKGDVSKFAIISPKSGHVTYDDNNISKISKEKTRFREEKSSRSFRNASVSDSVEILHRSSSFFTVLHPFFIRSSFFNG

SEQ ID NO: 134055 - protein, 87 aa, Glycine max
  Coding DNA Sequence Number=SeqID_42370
MGSSQAPSLKKRFYQVKVKSLGITSLKELGQLMGQLQILASRGEWASFIDILALLIFGGFHFPNVDGVVDLAAIDAFLAFHDRKESP

SEQ ID NO: 134056 - protein, 89 aa, Glycine max
  Coding DNA Sequence Number=SeqID_42371
  Pfam annotation: Domain name=zf-CCHC; Domain location=48-65; Score =27.8; E_value=3.9e-05; Accession=PF00098.14; Description=Zinc knuckle
MEDSIDLDEDVDHSVFVKRFNKFLWMRGTQRRQNFKPKRRIEESSQTPRCYECNQPGHLRVDCPIFKKRMEKFENKNIREKKANKAYIT

SEQ ID NO: 134057 - protein, 122 aa, Glycine max
  Coding DNA Sequence Number=SeqID_42372
GTKAGTGPPLEVDGIDKLDVVQAKVGGQTKFELAKTSFEVKRENEVGDMVYGMGWYWWHTMKCSVVLGLHKLGVTVKSGGAYGSKVVGHNVTMGWLNGVVRWMEVVNLSSLLMPARRLGDVL

SEQ ID NO: 134058 - protein, 118 aa, Glycine max
  Coding DNA Sequence Number=SeqID_42373
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=41%, E-value=4e-17, Identity=97%"; Hit description=LacZ protein
MSALIPSGRHRGGAPIRPIVSRITIHWPSFYNVVTGENTGVTQLNRLAAHPPFASWRNSEEARTDRPSQQLRSLNGEWDAPCSGALSAAGVVVTRSVTATLASADVRRCFCRYAPPRQ

SEQ ID NO: 134059 - protein, 103 aa, Glycine max
  Coding DNA Sequence Number=SeqID_42374
MAQGWWPQKMHHVPAEVPEHWDPHLFSREKAGFLARTLKHGFKALRVLSRWAWRSWCRSSRSGRSWWSRRRRNISWSSPYLPCPSEVNCQIIHILWKQDYKRF

SEQ ID NO: 134060 - protein, 71 aa, Glycine max
  Coding DNA Sequence Number=SeqID_42375
  Homolog annotation: Hit_ID=A3BRV8; Match level="QueryCoverage=100%, HitCoverage=10%, E-value=2e-08, Identity=38%"; Hit description =Putative uncharacterized protein
MVISDQWSSYKEDDVAKTKFVKDTLLDDKWWDKVDYIVSFTSPIYDVLRRTYTKASSLHLVYEMWDSMIKK

SEQ ID NO: 134061 - protein, 126 aa, Glycine max
  Coding DNA Sequence Number=SeqID_42376
  Subcellular localization annotation: CTP_CleavageSite=41; ConfidenceScore=5.27e-01
FGQIGYGPARINQVFHQRWNGVRGGGGSNIRGVPSRPTKFCATMPPQFPSGELARDKPGRFFEDPSNEGLTIDFDRDISQTINEEEEEDVLSPELERLVAQEEREMKPHQEETELVNLGTTEEKKE

SEQ ID NO: 134062 - protein, 98 aa, Glycine max
  Coding DNA Sequence Number=SeqID_42377
IPLDSEPYVPIKRSFLIGVAVVASFGYRKERDGSWVKKGAQPNDDEGQLPVEGDFSLLQSILDSGHAIRRNELKDHKGEEDVTIILDYLDLPPPPPSV

SEQ ID NO: 134063 - protein, 44 aa, Glycine max
  Coding DNA Sequence Number=SeqID_42378
MEDRVTTDRSSSLPGAGQAENVAARLARLGEMSSPGRATPAPKI

SEQ ID NO: 134064 - protein, 223 aa, Glycine max
  Coding DNA Sequence Number=SeqID_42379
  Gene Ontology: Mol. function=translation release factor activity, codon specific; Cellular component=cytoplasm; Biological process =regulation of translational termination
  Homolog annotation: Hit_ID=A7FMI1; Match level="QueryCoverage=100%, HitCoverage=42%, E-value=1e-102, Identity=83%"; Hit description =Peptide chain release factor 3
  Pfam annotation: Domain name=GTP_EFTU_D2; Domain location=7-74; Score= 48.7; E_value=2e-11; Accession=PF03144.16; Description=Elongation factor Tu domain 2
MDPKHRDRVAFMRVVSGKYEKGMKLRQVRIGKDVVISDALTFMAGDRSHVEEAYPGDIIGLHNHGTIQIGDTFTQGEMMKFTGIPNFAPELFRRIRLKDPLKQKQLLKGLVQLSEEGAVQVFRPIANNDLIVGAVGVLQFDVVVARLKSEYNVEAIYESVNVATARWVESTDVKKFEEFKRKNEVQLALDGGDNLTYIAPTMVNLNLTQERYPDVVFRKTREH

SEQ ID NO: 134065 - protein, 133 aa, Glycine max
  Coding DNA Sequence Number=SeqID_42380
ISAYHGCRMTKLGLCLSSDTTVSEWQRGADNRKVSPRIMGISAYHGCRMTKLGLCVPSDTTVSEWQRGADNRKVSPRIMGISAYHGCRMTKLGLCVPSDTTVSEWQRGADNHKGCVITVGISAGTSLSWVQKG

SEQ ID NO: 134066 - protein, 69 aa, Glycine max
  Coding DNA Sequence Number=SeqID_42381
LSLSLQSQGFTSFPCQFRAEVAWPGDWLEAQAGEAPAEALAEAPDEADEAREDEEMADLLDFLGGSRAT

SEQ ID NO: 134067 - protein, 97 aa, Glycine max
  Coding DNA Sequence Number=SeqID_42382
MKIKGHIGSEIVFGTICYHIGMHLSIIPSVHRQKKKIGHLKRVGVCTQVVLSTCRIMPFAWEEFEARLSQARSDAASSVGESQLTLLDPAEEQRLRS

SEQ ID NO: 134068 - protein, 194 aa, Glycine max
  Coding DNA Sequence Number=SeqID_42383
  Gene Ontology: Cellular component=mitochondrion
  Homolog annotation: Hit_ID=A6H595; Match level="QueryCoverage=36%, HitCoverage=80%, E-value=2e-27, Identity=84%"; Hit description =Putative 23S ribosomal RNA
HPETRKGVVSDEMLRGVENKRRSGDSRYRSTFRTAAESTGRQETTCLNRENGVVGELYKCRAARRSSRECCTLDGESPVAESITSLRSDPSSMGHVESRVNHQGPPCKAKYSWVTDSEVVPMSRRLIGSGLVKGNHRSRSEASLHRAIVTAYGPEPGSEPTDVEESADELWLGVKCHSNPELAGSPRNALRRSS

SEQ ID NO: 134069 - protein, 51 aa, Glycine max
  Coding DNA Sequence Number=SeqID_42384
  Homolog annotation: Hit_ID=A4PUT7; Match level="QueryCoverage=70%, HitCoverage=5%, E-value=5e-08, Identity=69%"; Hit description =Polynucleotidyl transferase, Ribonuclease H fold
MILEEGRRSNLSIHPSATKMYQDLKMMFWWPNMKRESVPAITLGRHMKIIE

SEQ ID NO: 134070 - protein, 123 aa, Glycine max
  Coding DNA Sequence Number=SeqID_42385
MSGFTHNSPQISASPHQLDLAPYASEPYHAQWNAPGLLRDKHTLRSSRILRKMEVEEPWLGLFAAKFLFVGVFLVCAKGGVRHWNNDIVGFGGKLGRTGMAVTAWVSPSSSPSLFAPVFSVVL

SEQ ID NO: 134071 - protein, 36 aa, Glycine max
  Coding DNA Sequence Number=SeqID_42386
MSRGSGDLGDVRVMASGNRLPRVGNRLQGLKMKTGD

SEQ ID NO: 134072 - protein, 84 aa, Glycine max
  Coding DNA Sequence Number=SeqID_42387
  Homolog annotation: Hit_ID=A5B1P9; Match level="QueryCoverage=98%, HitCoverage=6%, E-value=8e-07, Identity=33%"; Hit description =Putative uncharacterized protein
MTIEESIHVSFDKSNVISPRKDVLDDVSDFLEEMHTHERDSKRKRDESNENSQDSETKANNDLPKEWKTSRNHPLDNIIGDISK

SEQ ID NO: 134073 - protein, 252 aa, Glycine max
  Coding DNA Sequence Number=SeqID_42388
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPDALNFQQGSLLVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134074 - protein, 168 aa, Glycine max
  Coding DNA Sequence Number=SeqID_42389
MAQLISDAIHYLQGSRPQDTQWTRRSPTGLWGFQLWLRASISPTGCPSPPARSCHRDIGIAPARHPVDPENSNRVLGFPALITGLFQFYGVPIAPNKVIKPPTNRAFIKKYCAPRQAQGETPQQSGDGRQRATDALPPPLKPLISSTKAGALPTTRGRLAGDQVQSQR

SEQ ID NO: 134075 - protein, 156 aa, Glycine max
  Coding DNA Sequence Number=SeqID_42390
MTKARQKGVRKEKEGEACHPPRPGELGCFLQKAPPSRELPGRPKWAWLLLHPLFTKYAPLPFFCRFFFRNVTETYELRNDTYFPPVMLWNLTDYVIIPFLPFGMLRNFTDYVIISFLPSGMLRNFTNCLKMGAKYLKVVKRGLHPNNGWSPDEIRV

SEQ ID NO: 134076 - protein, 109 aa, Glycine max
  Coding DNA Sequence Number=SeqID_42391
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=66%, HitCoverage=24%, E-value=4e-29, Identity=70%"; Hit description=NADH dehydrogenase subunit B
MFQFMFLSTIWDIPRKDVRSNEATTKYLLMGGASSSILVHGFSWLYGSSGGEIELQEIVNGIGFKLSPAPSHQWTPDVYEGVRCYIVGSHPSETTSIIGASVNKRITLR

SEQ ID NO: 134077 - protein, 172 aa, Glycine max
  Coding DNA Sequence Number=SeqID_42392
MVLFTLRLPSQGAPFEGTIVDDWKFDYSSHDARRMIDWAHLVRYRMHKALRANAPLPYPQLVTIFLCHFQIPLDDEPFVQVKRSFAIGAGAVTSFGYRKDRDGQWLKKDVLPPQDEHTPSPSPQRDDSSALMNEVLSELRGLHTYVGMDTRIMQLEEDVTYLRRCFDLPPPS

SEQ ID NO: 134078 - protein, 272 aa, Glycine max
  Coding DNA Sequence Number=SeqID_42393
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSINRKVQQNKPKIEGEAIQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134079 - protein, 241 aa, Glycine max
  Coding DNA Sequence Number=SeqID_42394
MVIVRLLSSRGGGPDDMRRQIMVIPHTFSPFQTQSCPMARRDKLWSFCAFCHLEAIVPDDTQRKIMVIRMLLLSVRLDKSSESSDKRVKTKTNYGHYALFVIQEQRVESSESSDKRVKTNYGHSAPFVIQEQLVESSESSDKRAETNYGHSAPFVIQEQQVESSESTKWWAETNYGHSAHLFAIQRRSCPMARRDKLWSFCAFPSRPDRVRWRAETNYGHSAPCVTQEEQIRQYQDDVGRT

SEQ ID NO: 134080 - protein, 25 aa, Glycine max
  Coding DNA Sequence Number=SeqID_42395
TFTGEAEVLLKEAIPEQMDSFSPGT

SEQ ID NO: 134081 - protein, 162 aa, Glycine max
  Coding DNA Sequence Number=SeqID_42396
MEEKDSFKKIVKKENHFATKGDIKRALLKQFFYLLLSRETSLSTAIPLELEVFPEVKELLDEGIIRHQIPMIGGMMNLLSGATLFCKITHAPNIFMICVHRDSLGSDQRLPMDPKRIKVILEWPTPPSVEERIHEFQEPLDLRSNPFQGGGNDAILPPEDIG

SEQ ID NO: 134082 - protein, 180 aa, Glycine max
  Coding DNA Sequence Number=SeqID_42397
  Gene Ontology: Mol. function=chitin binding; Cellular component =extracellular region; Biological process=chitin metabolic process
  Homolog annotation: Hit_ID=UPI000069F178; Match level="QueryCoverage =98%, HitCoverage=71%, E-value=1e-16, Identity=31%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=19; ConfidenceScore=5.23e-01
MARTCSPLKVRTCSPLKVRACSPTKVKAHDPLTARTCSPLKLKARTYSPLEVRACSPLVVRTCSPLKARTCSPLTVRVRACSPLMVRTCSPLKARTCSPLTVRVRACSPLMVRTCSPLKARTFSRLNGEGRVVLSRRGRVVLSTVRARTCSPLEVRACSPLMVRTCSPLKARTCSPLNGE

SEQ ID NO: 134083 - protein, 207 aa, Glycine max
  Coding DNA Sequence Number=SeqID_42398
MTKNERRTTKNGWKSSRNHPRKRYGSTLAWIFFTETIFFSIILSDPEIPDGLNPFLFHSSPYLLENRGRACHPARPGEPGCFLQKQPPSGGTSWKAQVGLKLTKVTEPHGLRNNVDLQPVGGDAARFPPLEDTPVSLASPSCRRFLEPFRFFRKSLYSQDTRNALKWQFKFGIIKAKKGEIVRDRGSNMKTKLWSLKKFCLFTCPTL

SEQ ID NO: 134084 - protein, 276 aa, Glycine max
  Coding DNA Sequence Number=SeqID_42399
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIFCLGGWKDSGDDDGDGGTTVNVLNATEPVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134085 - protein, 97 aa, Glycine max
  Coding DNA Sequence Number=SeqID_42400
MDEFDIFVPRPLTNTSLLIQTFIGMRLALLSLDFQDRSIRNYSCYTFGEGAVKRQGQIRSSHPIGSLLRKTTIGTSKPYTGAMRGIVHEPQVNLGAN

SEQ ID NO: 134086 - protein, 123 aa, Glycine max
  Coding DNA Sequence Number=SeqID_42401
  Homolog annotation: Hit_ID=A0ST23; Match level="QueryCoverage=20%, HitCoverage=51%, E-value=3e-07, Identity=100%"; Hit description =Putative reverse transcriptase
MVDPIKDYNEHQDIQDLNAKKSLLAKLLSLQSDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 134087 - protein, 201 aa, Glycine max
  Coding DNA Sequence Number=SeqID_42402
MKREKHASYSSHNSCKSLSEELRDYYEGRHRSHLRPHSHRREKERKPQEANIKLSYFHGKDNVGANLDWEIRVEQQLKKKSTSKSYGSHSYPKKDQGQGILGVTLSKPKDDKGKTIEKQAPKAKAKWEESSEEIDPQEEGQPLMVKECKEILVSIATPLGLEFIPQVKELLDEDLVRKSLNPCALLVPKIGIVRHQIPKIG

SEQ ID NO: 134088 - protein, 47 aa, Glycine max
  Coding DNA Sequence Number=SeqID_42403
MMQKILIFQLKYRDITISQTGLRNLIRLAMPKLMEADVQFAVFTGRV

SEQ ID NO: 134089 - protein, 182 aa, Glycine max
  Coding DNA Sequence Number=SeqID_42404
GTLVDDWKFDYSSHDARRMVCNDQADMTGKLLVGALTFDCRIMHYIIVLVRIDWAHLIRYRMHKALRANAPLPYPHLVTLFLHHFKIALEDEPFVQVKRSFAIGVGAVILFGYRKDDDGQWVRKQDLPQPIHDEPFVGDRFDAMDTPLDAMDAHFDGMDTRITRLEDNMSFIRRCFDPPANP

SEQ ID NO: 134090 - protein, 268 aa, Glycine max
  Coding DNA Sequence Number=SeqID_42405
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDNLTKYYALAQSTPVNLNSPGSIEQSKGGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134091 - protein, 31 aa, Glycine max
  Coding DNA Sequence Number=SeqID_42406
KESIDEEDPRPTSSNGACNTIVVKLICYYVE

SEQ ID NO: 134092 - protein, 114 aa, Glycine max
  Coding DNA Sequence Number=SeqID_42407
FIGGPTRRIGTNLCLFLLYQLNIFRFTFAFVNYTVIYKTKVERKDIELVDEEEAQIGADRSSATSNKSEIYNEEAWNAAQKHKPNRVESVNADAEAFGDHWKILIALCILKLKH

SEQ ID NO: 134093 - protein, 186 aa, Glycine max
  Coding DNA Sequence Number=SeqID_42408
MVEASGNRLPACVIDYTVEWVTGNRLPAQLIHDRVEMECLEGAWETLEGNTKCRFRGTIRFTATSLVHPDEPARTLQRTVEWILPTPTPYRLVEPVQVIEVTSSEEDPEDDLEELPPEPAVDALDFLEVDEDPVLEVDSPEEVMSASEADSTEDSGPGGDGNQRRLFIIVDSSMGLVLYTFEGGCI

SEQ ID NO: 134094 - protein, 99 aa, Glycine max
  Coding DNA Sequence Number=SeqID_42409
YQALNESPIGHNQSPKVTSEVVAIAKDINDIKAKDSIIKDVDVIDGLRNMSENLCAVVVNAGNEGTSLKKQVQALTLRNSTLEDRVTHLDSALKECVRQ

SEQ ID NO: 134095 - protein, 45 aa, Glycine max
  Coding DNA Sequence Number=SeqID_42410
MARKGVFRPYRVEERIHEFQEPLDLRSNPFQGGGNDAILPPKGIG

SEQ ID NO: 134096 - protein, 160 aa, Glycine max
  Coding DNA Sequence Number=SeqID_42411
MGNGNLEISNDNQKITFNIFEAIKCRGEDRRCFKVEVDKEDIGILQTTQTSLNKVMINVVDCLPSEKEKDLRSCLKDQNHEGNIPAEGTNSTSTGHTSLAGIRVSPTGYGQSDAPVHLLGPTNHSLGSSSTVPSPKDGPTTNDPRDLHPVGCLARRTTLN

SEQ ID NO: 134097 - protein, 28 aa, Glycine max
  Coding DNA Sequence Number=SeqID_42412
MEILHRSSPFFIPSLSFFSLQPFSFLPL

SEQ ID NO: 134098 - protein, 151 aa, Glycine max
  Coding DNA Sequence Number=SeqID_42413
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=8e-24, Identity=54%"; Hit description =Putative uncharacterized protein
  Subcellular localization annotation: CTP_CleavageSite=45; ConfidenceScore=5.61e-01
MTMITPSSKLTLTKGNKSCKSTGNQNKSNSCSPGDPLVLERPPPRWSSNSPYSESYYNSLAVVLQRRDWENPGVTQLNRLAAHPPFASWRNSEEARTDRPFQQLRSLNGEWDAPCSGALSAAGVVVTRSVTATLASADVRRCFCRYAPPRQ

SEQ ID NO: 134099 - protein, 157 aa, Glycine max
  Coding DNA Sequence Number=SeqID_42414
HLTPSLLGRHLSQQATVSPAKPPDRPDHEVDDPLYLMTLTIPQLFLKPLQVMWDATVFNEDFPLYIKHEDLHEIAHGGQCLSISVIQLWILHLTETSMRAGNFDVYGFLEPQSIQRSGQSQFESKSYMKSWMQSSKCDVYLGAYLNWPDNYLKGIIN

SEQ ID NO: 134100 - protein, 274 aa, Glycine max
  Coding DNA Sequence Number=SeqID_42415
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSILGSSDFPASAFQSAGIAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134101 - protein, 98 aa, Glycine max
  Coding DNA Sequence Number=SeqID_42416
MATVGYVVGKDKGRLELSVEDHKIYFDLFEAMKHSNIGDACFEEEEVEQEIALSASTMVLQFPLEKEPGYVVDCLVCDEELDVTPSTPHIYTNKGIQI

SEQ ID NO: 134102 - protein, 135 aa, Glycine max
  Coding DNA Sequence Number=SeqID_42417
MALLLSNILPSDRNANLPLQKYQLICVVPTWGSHPQDTQWTRKSPTGPWGFQLWLRASISPTGCPYPPGKGSHLQDTQWTRRSPTGSWSCQALITGLCQFYGVPVTSSKGIRPPTNRAFIKRYCAPRQTQGETPQ

SEQ ID NO: 134103 - protein, 217 aa, Glycine max
  Coding DNA Sequence Number=SeqID_42418
MASRKRKSIGSRPTTQYDTRRFHSLDAWNRYIDNVLGRNILPERKVEIYHTEFDDFKAKLERLNLHKCLTNLVGSIDLALVKEFYANLYNSEGPSPKQARVRGHRVNIDANSLNTFLETPVVLVEGETLPTYSRYCRLPTGYREIEVALCILGRGFILNTEGHPGRILWKDLTTLAQVWSVLSYSNLAPTSHTSDLTVDRARLIFGLVSRMDMNMNI

SEQ ID NO: 134104 - protein, 74 aa, Glycine max
  Coding DNA Sequence Number=SeqID_42419
  Homolog annotation: Hit_ID=A5C6K4; Match level="QueryCoverage=63%, HitCoverage=5%, E-value=2e-07, Identity=53%"; Hit description =Putative uncharacterized protein
APVSLAFARPQKGTLRQRFIKDSSKVALPLSNLLQKEAPDWRTPFKLMCDTSNYALGVILAQKISLLHLTSFPP

SEQ ID NO: 134105 - protein, 107 aa, Glycine max
  Coding DNA Sequence Number=SeqID_42420
MGLIILYPYPYPTFGYRGKLVPEPIPDQLGYYPSKSRRIRAGTYGDGPFLCVKPVRSDRCNRDPVANCPSLDRSSRVNCMTDPIVKLVRLDHRVTVESNQVSQLCLQ

SEQ ID NO: 134106 - protein, 17 aa, Glycine max
  Coding DNA Sequence Number=SeqID_42421
MGLGDIGSLGEYEWCWV

SEQ ID NO: 134107 - protein, 173 aa, Glycine max
  Coding DNA Sequence Number=SeqID_42422
PPNLSQKNNDLGLVHRWIVVKFEYHVRNPILNILTVGNFKIISELRGKPFALEKKESHEDSTSEGFNLFSVSLTFGNSIGAVGGITEGISGNRYRCYYRWLKTRESAQRVHPLGDCYTKNKRRYISCGSVQVEGTSTWVFKENKGGYIPCGCLAYKGFYKIERNLKNCRSLGD

SEQ ID NO: 134108 - protein, 101 aa, Glycine max
  Coding DNA Sequence Number=SeqID_42423
MCTGAESRGDINGDPVISKVGGGDYEDRMRTIELEGGGEERACNCGTFVQGLLQGIHHHLTALNLPTLSASEVDYVHVKGGKRRDIYADNFLGAMISGSFS

SEQ ID NO: 134109 - protein, 451 aa, Glycine max
  Coding DNA Sequence Number=SeqID_42424
  Gene Ontology: Cellular component=ribosome
  Homolog annotation: Hit_ID=A2Q6B4; Match level="QueryCoverage=33%, HitCoverage=62%, E-value=5e-15, Identity=32%"; Hit description =Ribosomal protein L33; Nucleic acid-binding, OB-fold
  Pfam annotation: Domain name=DUF223; Domain location=40-135; Score =4.6; E_value=0.0011; Accession=PF02721.5; Description=Domain of unknown function DUF223
MARIPDKIKSIDGSRKTLKLDMRIMDLWFVGTPNKSEQAEMVIVDSEGDQIHAVCKADQLKSWKVDLKENSTYVMHNFKVVKNDGQFRVCEHEYKLVFTEVTVVRESDLHQLPFKEFRFVEFGNVIGGNFEAGLLVDIIGVVDQFLAYLNERGNDGSIVIILTHARVKDAQGSYPASVSNSLKASKLLIKEPVLEIQEFRERLLDLGVEVSPVLAPSDQGSSQLSGPSQLSSKDAFLSKAEAKTIFKINGISEVVLKIDIETGPFTCGCGKDNDQPILRVEVMISQNNDSSKFLLWDHECAELIGQTAYEVNRVKIEDGDVDLNASPQALDRLLGYVLAFKVRIQSKFRNVVVLRYSNELDLINVLLNMLADTEACSKIDASNVDCNDATHVECQSLSVTADHDPVAGFPLTPKKRLSSDEVDDELGSSQISPAQLSSNKLTRHSDKSEFS

SEQ ID NO: 134110 - protein, 266 aa, Glycine max
  Coding DNA Sequence Number=SeqID_42425
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=P50158; Match level="QueryCoverage=82%, HitCoverage=100%, E-value=1e-99, Identity=86%"; Hit description=TATA- box-binding protein 1
  Pfam annotation: Domain name=TBP; Domain location=130-216; Score =151.5; E_value=2.3e-42; Accession=PF00352.12; Description =Transcription factor TFIID (or TATA-binding protein, TBP)
  Pfam annotation: Domain name=TBP; Domain location=20-125; Score =101.2; E_value=3.1e-27; Accession=PF00352.12; Description =Transcription factor TFIID (or TATA-binding protein, TBP)
  Pfam module annotation: Pfam domain module=TBP::TBP; Domain location =130-216::20-125
MADQGLEGSQPVDLQKHPSGIVPTLQNIVSTVNLDCKLDLKTIALQARNAEYNPKAIAYPAFWIVFCSFLDQRSVRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQWYEFVFTYLTFSVHSTYRYCCFKKEQEQWSGRKVRGTVNIKTKEII

SEQ ID NO: 134111 - protein, 71 aa, Glycine max
  Coding DNA Sequence Number=SeqID_42426
MKGRCALCDLHATLNAFGHQASDIKEELIGRITQWEAWKMVEEIEQLAMRVNNGSTRGANMEIRLSAHLAT

SEQ ID NO: 134112 - protein, 30 aa, Glycine max
  Coding DNA Sequence Number=SeqID_42427
MDLATKDDQQIWLIGPKKLYLPMNLSLNLN

SEQ ID NO: 134113 - protein, 255 aa, Glycine max
  Coding DNA Sequence Number=SeqID_42428
  Homolog annotation: Hit_ID=A3AHS0; Match level="QueryCoverage=71%, HitCoverage=38%, E-value=8e-19, Identity=35%"; Hit description =Putative uncharacterized protein
  Pfam annotation: Domain name=DUF827; Domain location=55-253; Score= -48.0; E_value=7e-07; Accession=PF05701.2; Description=Plant protein of unknown function (DUF827)
MGSRETKSEAKGVRMGGEMDGGRGIGNYKTGKSNIYAYDKKYLRANQIQVSSNLGAIGKQATPHHAEELDPEKLEEQAVVLEKDLILKERETLDVLKSWKVQKEESEANLNVQTSVCENISSVEEDERKDKENRVSNVVQDSKEGCIPYPSSSSGLILMELKPAKFNLNRTTSDIADVRASVESLSKKLEKERLSLEKTRERLAQNSSKICSLEEELNQTKLKLLVAKDAGSDNHSDITRELQRLSFEQTMSEIE

SEQ ID NO: 134114 - protein, 665 aa, Glycine max
  Coding DNA Sequence Number=SeqID_42429
  Gene Ontology: Mol. function=nucleotide binding; Cellular component =intrinsic to membrane; Biological process=defense response
  Homolog annotation: Hit_ID=Q2YE87; Match level="QueryCoverage=100%, HitCoverage=53%, E-value=0.0, Identity=85%"; Hit description=NBS-LRR type disease resistance protein Rps1-k-2
  Pfam annotation: Domain name=LRR_1; Domain location=13-34; Score =18.5; E_value=0.025; Accession=PF00560.24; Description=Leucine Rich Repeat
  Pfam annotation: Domain name=LRR_1; Domain location=195-216; Score =10.5; E_value=3.5; Accession=PF00560.24; Description=Leucine Rich Repeat
  Pfam annotation: Domain name=LRR_1; Domain location=218-240; Score =5.0; E_value=36; Accession=PF00560.24; Description=Leucine Rich Repeat
  Pfam annotation: Domain name=LRR_1; Domain location=276-299; Score =12.8; E_value=1.3; Accession=PF00560.24; Description=Leucine Rich Repeat
  Pfam annotation: Domain name=LRR_1; Domain location=36-58; Score =14.5; E_value=0.41; Accession=PF00560.24; Description=Leucine Rich Repeat
  Pfam annotation: Domain name=LRR_1; Domain location=410-434; Score =3.9; E_value=57; Accession=PF00560.24; Description=Leucine Rich Repeat
  Pfam annotation: Domain name=LRR_1; Domain location=458-486; Score =5.8; E_value=26; Accession=PF00560.24; Description=Leucine Rich Repeat
  Pfam annotation: Domain name=LRR_1; Domain location=506-526; Score =5.3; E_value=32; Accession=PF00560.24; Description=Leucine Rich Repeat
  Pfam annotation: Domain name=LRR_1; Domain location=529-553; Score =0.9; E_value=2e+02; Accession=PF00560.24; Description=Leucine Rich Repeat
  Pfam annotation: Domain name=LRR_1; Domain location=577-600; Score =3.8; E_value=62; Accession=PF00560.24; Description=Leucine Rich Repeat
  Pfam annotation: Domain name=LRR_1; Domain location=60-81; Score=7.6; E_value=12; Accession=PF00560.24; Description=Leucine Rich Repeat
  Pfam annotation: Domain name=LRR_1; Domain location=602-629; Score =6.7; E_value=18; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=13-34::195-216::218-240::276-299::36-58::410-434::458 -486::506-526::529-553::...
  Pfam module annotation: Domain location=577-600::60-81::602-629
MDSLPDSIGKLIHLRYLDLSHSSIETLPKSLCNLYNLQTLKLYGCIKLTKLPSDMSNLVNLRHLGIAYTPIKEMPRGMSKLNHLQYLDFFVVGKHEENGIKELGGLSNLHGQLEIRNLENVSQSDEALEARIMDKKYINSLRLEWSGCNNNSTNFQLEIDVLCKLQPHYNIELLEIKGYKGTRFPDWMGNSSYCNMTHLNLSDCDNCSMLPSLGQLPSLNVLDISKLNRLKTIDEGFYKNEDCRSGTPFPSLEFLSIYDMPCWEVWSSFNSEAFPVLKSLKIRDCPKLEGSLPNHLPALKTFDISNCELLVSSLPTAPAIQRLEISKSNKVALHAFPLLVETITVEGSPMVESMIEAITNNQPTCLLSLKLRDCSSAVSFPGGRLPESLKTLRIKDIKKLEFPTQHKHELLETLSIESSCDSLTSLPLVTFPNLRDLEIRNCENMEYLLVSGAESFESLCSLDINQCPNFVSFWREGLPAPNLIAFSVSGSDKFSLPDEMSSLLPKLEYLVISNCPEIEWFPEGGMPPNLRTVWIDNCEKLLSGLAWPSMGMLTDLTVSGRCDGIKSFPKEGLLPTSLTYLWLYDLSNLEMLDCTGLLHLTCLQILEIYECPKLENMAGESLPVSLVKLTIRGCPLLEKRCRMKHPQIWPKISHIPGIQVDDIWI

SEQ ID NO: 134115 - protein, 220 aa, Glycine max
  Coding DNA Sequence Number=SeqID_42430
  Gene Ontology: Mol. function=protein serine/threonine kinase activity; Cellular component=cytoplasm; Biological process=protein amino acid phosphorylation
  Homolog annotation: Hit_ID=A7QFL3; Match level="QueryCoverage=69%, HitCoverage=66%, E-value=1e-26, Identity=51%"; Hit description =Chromosome chr8 scaffold_88, whole genome shotgun sequence
  Pfam annotation: Domain name=Pkinase; Domain location=79-196; Score= -82.6; E_value=0.0012; Accession=PF00069.16; Description=Protein kinase domain
MCLTVKNSFTEANEFVPPSELSLFNLDDIGCLVHCPYLFFARATEVPRNLSHCAISKHNDCEDVFLEMEQKGGVLMQRYELGRLLGQGTFAKVYHARNIITGMSVAIKITDKDKILKVGMSDEANQASTCGGELFNKVSKGKLKQDDARRYFQQLISAFKFLNWIAPDLRRLLSKILDPNPKTRISMAKIMESSWFKRGLEKPTITRNEDQELAPLDALL

SEQ ID NO: 134116 - protein, 74 aa, Glycine max
  Coding DNA Sequence Number=SeqID_42431
  Subcellular localization annotation: CTP_CleavageSite=37; ConfidenceScore=5.24e-01
MHNYQHAKRSNSAKVRINRKRIMQQKRHPQAQSFIVSDSSESVNSESTQASGSNFLTAYEDCQSPTNQLVINTE

SEQ ID NO: 134117 - protein, 82 aa, Glycine max
  Coding DNA Sequence Number=SeqID_42432
MTISDSFPSIFTVGNFDITSELREIPLTFCARFDRWDLGDNVRGGRKRNHMKIVQMEALILSPFLSRLGTLPEQSEEKLEKF

SEQ ID NO: 134118 - protein, 387 aa, Glycine max
  Coding DNA Sequence Number=SeqID_42433
  Gene Ontology: Mol. function=oxidoreductase activity; Cellular component=extracellular region; Biological process=response to oxidative stress
  Homolog annotation: Hit_ID=A0SWU6; Match level="QueryCoverage=82%, HitCoverage=98%, E-value=1e-140, Identity=77%"; Hit description =Peroxidase 1
  Pfam annotation: Domain name=peroxidase; Domain location=43-285; Score=442.8; E_value=4.6e-130; Accession=PF00141.14; Description =Peroxidase
  Subcellular localization annotation: CTP_CleavageSite=47; ConfidenceScore=5.23e-01
MASRGYFFVLLHAFVFATLATSAFSKLSPNYYDFSCPKALSTIKSVVEATVKKERRMGASLLRLHFHDCFVNGCDGSVLLDSTSSIDSEKKATPNFKSARGFEVIDDIKKAVDEACGKPVVSCADIVAVAARDSVVALGGPTWKVELGRRDSTTASRKAANANIPAPTFNLSQLITNFKNHGLDEKDLVVLSGGHSIGFARCIFFRNHIYNDSNNIDPKFAKRLKHICPKKGGDSNLAPLDKTGPNHFEIGYYSNLVQKKGLLHSDQELFNGGYTDALVRQYSYGHVAFFEDFANSMIKMGNTRPLTGNQGEIRVNCRKAQPNTGAKRASGAKRAKKTGAKRGVELEDAESVTRAKPQLCAKRAIQQKHRLSLQGALSVRSERAKRE

SEQ ID NO: 134119 - protein, 191 aa, Glycine max
  Coding DNA Sequence Number=SeqID_42434
  Gene Ontology: Mol. function=helicase activity; Biological process =viral genome replication
  Homolog annotation: Hit_ID=Q8RV60; Match level="QueryCoverage=97%, HitCoverage=18%, E-value=3e-27, Identity=29%"; Hit description =Putative uncharacterized protein At2g05640
MMLGSCKGPTSSEDTRTVANIQYATYREACFVMGFLQDDREYVEAIKEAKDWGTTNYLRKLFVLILLTGAMSKPEEVWNQCWHWLADDIAYRHSKSTMNSDEQKTICNRIIQAVNNNEGEMFFLYGFGGTRKIFIWRTLASSLRAGNQIVIIVASSGIASLLLLGGRSAHSRFKILVPIFEDSTCNIHQGT

SEQ ID NO: 134120 - protein, 125 aa, Glycine max
  Coding DNA Sequence Number=SeqID_42435
  Homolog annotation: Hit_ID=A5B3W1; Match level="QueryCoverage=68%, HitCoverage=10%, E-value=6e-07, Identity=35%"; Hit description =Putative uncharacterized protein
  Pfam annotation: Domain name=Chromo; Domain location=68-118; Score =16.8; E_value=0.0047; Accession=PF00385.15; Description='chromo' (CHRromatin Organisation MOdi
MVVIRNTFHQLTIAGHIGVTKNFHRLQQNFDWPRILEDELFRLSGTKLRMSTAYHSQMDDQTENHPVIEPLHILDWKWDSSSCPPTKLVLVQWDGLAQEDTTWEPLDTLLRSYNLGDKVGLVEGG

SEQ ID NO: 134121 - protein, 339 aa, Glycine max
  Coding DNA Sequence Number=SeqID_42436
MADTKLSIACVDRLEAAMAKLTAIQTFIAADQTSITSKLDAIIRILNTMVPKQPSPSSASAKSPPMPPLLPKTINSTSSSAKPPPTAETTLSPLPMATFHLPVNKHHTLSFESIPVASHRSHTKSSSRGILPSDIHFSLSVVCAATVRDTNLNHPFLLLIFVILVAAKGFCLHNHLQALILTPIFIWDPGSVFYTQPLEDKGSSTYNFMLQQHLLCCIVVIVIEVTLVVSSHRHKQHVHRHELAELEGEGGGSPLRQGFDIVRMRHAAEEEERRVRRSWRHKSSRETWSFFDNVAKMLNEAFGVTEHEDFVVGVGKMKRGGKRREKKRVGELGFLEKSI

SEQ ID NO: 134122 - protein, 304 aa, Glycine max
  Coding DNA Sequence Number=SeqID_42437
MGFQGRFGGFWRHSSGGVELVKELVGDCANYSRLVEENVKATLISVGKSISKQKLPLLVLGAGFAVAGFEGMLAVALRIIPWPLEIHLALKVIRSTITTKVIPGSQGLWRQNSLSSALARSAKTAAGKIVGRSEVMGWSCMSVEGGGGGVVAGGGGGGSVVAGGGGGGGVVAGGGGTVMNAATAEGAMELTAVASEMAEVAAESVAEVRVIGGEGHPAAMEVSYGEWQPWKLRMVVAEIKEGLSRDRTSLATVGGYSQNQSQGIELDVQREERCATTKHQMLGAGFAVAGFEGPAPLEEEEKKS

SEQ ID NO: 134123 - protein, 79 aa, Glycine max
  Coding DNA Sequence Number=SeqID_42438
MTETIKDGKEFTALRLVHNPVHMILSIPKSIGQEDTKKEVTLSKKGNRNEEKERVMKQAQPNTGAKRTPGAKRATKCRR

SEQ ID NO: 134124 - protein, 397 aa, Glycine max
  Coding DNA Sequence Number=SeqID_42439
  Gene Ontology: Mol. function=binding; Biological process=translation
  Homolog annotation: Hit_ID=A7QWW8; Match level="QueryCoverage=78%, HitCoverage=23%, E-value=3e-85, Identity=58%"; Hit description =Chromosome chr13 scaffold_210, whole genome shotgun sequence
MRHLRCQLPSEDLNALVSITSDEDLAKPHRGIRSRFIAEIIHFKHLISHHRRDAVRAENALTLLYGNEPIGMQRDWNEELQSCREFPHTSPQERILRDRALYKVTSYFVDAAINGAIGVISGCIPPINPTDPECFHMYVHNNIFFSFAIDADLEKLSKKLVDANSKSWSSSSLQSSSDKDSIPVHGESQVPNGGCVVNYEARTLQSLAVSGVPHASVSVSDTDTIPVLRSIFWTLQSDLPGILQGDKSDSLSCTALLTMERKFAGFSFQGVRGCQKCLHLKEHLVLDGSGNLFKLAAPVECKGIVGRDDRHYLLDLLRVTPRDANYTGPGSRFCILRLELITVYCQAQVAETLKSKEKNFQEADNLAIESQNGQNFSMLKKCFFAIGKLIQMGSIFS

SEQ ID NO: 134125 - protein, 352 aa, Glycine max
  Coding DNA Sequence Number=SeqID_42440
  Gene Ontology: Mol. function=oxidoreductase activity; Cellular component=extracellular region; Biological process=response to oxidative stress
  Homolog annotation: Hit_ID=A7NY36; Match level="QueryCoverage=70%, HitCoverage=99%, E-value=7e-82, Identity=58%"; Hit description =Chromosome chr6 scaffold_3, whole genome shotgun sequence
  Pfam annotation: Domain name=peroxidase; Domain location=86-316; Score=293.6; E_value=3.8e-85; Accession=PF00141.14; Description =Peroxidase
MAVFDNPSNGSMPPQLEQQPNKYAFTKPLSLAGPTDADLQRNNELDKVLHRLDRVFYFFDLAFLHIVEDCEKMTEAVDAPTYTDQMVEDANDVIFTFGSYRLGGCDASVLLKDTANFTGEQSVIPDVDSTNGTDIILIEKIKARLEKLCPDVVSCADIIAVAAKDSVVALGGPTWNVLLGRRDSTTANLSAVLTDFPTTFMNLTELLATFGKKNFTAQEMVAFTGAHTTGRIKCLFFRTRIYNESNINPSYARSLQAKCPFVGGDDNLAPLDRTTPILFDNAYYKNLLKQKGLLHSDQQLYNNGSTDTIVEFYAKNPLGFRTDFAKVMTKMGNLSPLTGTNGQIRKQCSKVN

SEQ ID NO: 134126 - protein, 133 aa, Glycine max
  Coding DNA Sequence Number=SeqID_42441
  Gene Ontology: Mol. function=lipid binding; Cellular component =cellular_component; Biological process=lipid transport
  Homolog annotation: Hit_ID=Q8W539; Match level="QueryCoverage=65%, HitCoverage=79%, E-value=1e-16, Identity=48%"; Hit description=Non -specific lipid-transfer protein
  Pfam annotation: Domain name=Tryp_alpha_amyl; Domain location=29-100; Score=13.0; E_value=0.016; Accession=PF00234.13; Description=Protease inhibitorseed storageLTP f
MASFTKLAWVVLVCMVVMGAHNTVQGITCGQVQGNLAPCLGFLHNGGAVTRGCCNGVRSIVSNARTTADRRGSTLTMLRLSPGNVGSTYPTKSAPPPTVTASGEGQKDLDRFGRDELCIWYYVYVLGKRNKGR

SEQ ID NO: 134127 - protein, 149 aa, Glycine max
  Coding DNA Sequence Number=SeqID_42442
  Gene Ontology: Mol. function=lipid binding; Cellular component =extracellular region; Biological process=lipid transport
  Homolog annotation: Hit_ID=O23758; Match level="QueryCoverage=63%, HitCoverage=81%, E-value=9e-28, Identity=64%"; Hit description=Non -specific lipid-transfer protein precursor
  Pfam annotation: Domain name=Tryp_alpha_amyl; Domain location=33-118; Score=104.2; E_value=4.1e-28; Accession=PF00234.13; Description =Protease inhibitorseed storageLTP f
  Subcellular localization annotation: CTP_CleavageSite=67; ConfidenceScore=5.02e-01
MVVIMASLKVAFVVAVLYMVVVSAHMAHARINCGRVAVAVSPCLGYLRRGGRPQARCCNGVRNLHALAKTTVDRRTACNCLKTFARGLGRGVNANNAAALPRKCRVNIPYKISISTNCNTYVKLIITHFKCFHFLTFSFTNSYSNFTNT

SEQ ID NO: 134128 - protein, 269 aa, Glycine max
  Coding DNA Sequence Number=SeqID_42443
MARPARDLNALSARKLHLVSEHYSQYFKPKKPTMYNELQELSMQRNLFQSFGVAAAAVFSSSRLRCRDPEALVSSKSPGCLHKGRSVGDFNCHERRPRKGVASVPPLGSVIELNDSDTDEDEDHDLDNAIANAVNGASSSVESPSKKQWTSEAEEVVLPVVFVTPLPPTPVPPPTLMLSLLAMEYASNSAASRTNASKSLSLNSSKQFWKAGDYDGAPLGGSTADLNETMEDLARDKRLTNVENGDSNSRGILGLTDIEQTPTSNISGK

SEQ ID NO: 134129 - protein, 144 aa, Glycine max
  Coding DNA Sequence Number=SeqID_42444
  Gene Ontology: Mol. function=transcription regulator activity; Cellular component=nucleus; Biological process=regulation of transcription
  Homolog annotation: Hit_ID=A7QFK2; Match level="QueryCoverage=97%, HitCoverage=94%, E-value=3e-46, Identity=68%"; Hit description =Chromosome chr8 scaffold_88, whole genome shotgun sequence
MDSRRRSKKAAMQRKLQQLRSVNKASIIVDATRYIEELKQKVDGLNSELGTAESSISQDELPMVTVETLERGFLINVFSERNCPGMLAAILDAFEELGLDVLDARVSCEDTFQLEAVGGESQENESIDAQVVKQAVLQAIQNMD

SEQ ID NO: 134130 - protein, 52 aa, Glycine max
  Coding DNA Sequence Number=SeqID_42445
MGKIVNSSTESSLAESSSSVADSAVRKDPRVEVVTAINGIEEFHDNHRVGVE

SEQ ID NO: 134131 - protein, 86 aa, Glycine max
  Coding DNA Sequence Number=SeqID_42446
MVIGAKDPPILEVWEKEANLEITGKLGGQSLSEIGDGVVKVENSGVLQLLGLVGYGLHHIMVTVPAAHPSNPSELPFPLLVEQHAV

SEQ ID NO: 134132 - protein, 118 aa, Glycine max
  Coding DNA Sequence Number=SeqID_42447
MAKGDQDFKVQANLLVKEIQGNIQSKNRLNQFVDIIKSVIYISTSSRRLGGSPTESHPCTLLLSFRFHEQGSRSSQMQCGMYRIQYQGNSPKRVYTTPHLGNHAVFVEVTQSYTVTPP

SEQ ID NO: 134133 - protein, 39 aa, Glycine max
  Coding DNA Sequence Number=SeqID_42448
MIFYLDLGFPSNDGDYLIADDIKDGEEDINHDVEGTKVP

SEQ ID NO: 134134 - protein, 83 aa, Glycine max
  Coding DNA Sequence Number=SeqID_42449
  Subcellular localization annotation: CTP_CleavageSite=18; ConfidenceScore=5.22e-01
MYSSFFSRQPKGVTFVVVASHFSSSCLLRVSPLGDARHFSPLRLWCKEAWKMIEELEQLAKRVNNGSAGEANLEVRLNTHLAT

SEQ ID NO: 134135 - protein, 137 aa, Glycine max
  Coding DNA Sequence Number=SeqID_42450
MSMTSSTTSTRMKYPIIRPPSIMQFKAAFHNDQSSKIYVQAFIEIPSFYHQQWAPNYPESVQLRYNGATYQIQLQQHRGRFFLADGLTDFRTDLEIYESIIINFFAYDHNSIFDVHFTPSLDQQTCARPLLHSRQHI

SEQ ID NO: 134136 - protein, 169 aa, Glycine max
  Coding DNA Sequence Number=SeqID_42451
MPGLSLKIETLIKAQTQVPITTPSFLTYDKCGIMHGLGECIIDDKLVAVMDEINFVEGRDNFSNQYPSNFNQGQGFRIEQPMKKLKKKEKATPTPKREALTEESQEKNKEDEKVMQSYPARALDREDSNEALASLGIFSRKLLKELLKEVFSKKLLKEVFSRKLLKEAT

SEQ ID NO: 134137 - protein, 218 aa, Glycine max
  Coding DNA Sequence Number=SeqID_42452
MDRFALTLNGSQELPRLLAKAKAMADTYSAPKEIHGLLGYCQHMMGDQEETHEQMKADMSALKEQMASIMEAMLAMRQLMEKNMATAAAVSSAAEVDPTLLATAHHPPPNAVGREGSTLGHNSNPHLGYNRVAYPYGLPPNYTPPVMHDDAGHVSSPILEGEPPRQPDEVHEDHREYAQGDVDFYPLILVEGPTPNTLPQHNLTAQPIFLSTEGPPPV

SEQ ID NO: 134138 - protein, 61 aa, Glycine max
  Coding DNA Sequence Number=SeqID_42453
SCHHQKGGEVLNHEDLRFRTRSREWVVLWVQIKKGSKRKENHQVGLMDVEARTLVSSKKEM

SEQ ID NO: 134139 - protein, 293 aa, Glycine max
  Coding DNA Sequence Number=SeqID_42454
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMPVDDNNVIRKDYFTKRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134140 - protein, 73 aa, Glycine max
  Coding DNA Sequence Number=SeqID_42455
VVFVIGSAVDRLCGRFRDGLCGYLGGGYCWVGGKLGRTGMAVTAWTHIDPFTGKDQILKALKLPSLSIFGRVL

SEQ ID NO: 134141 - protein, 333 aa, Glycine max
  Coding DNA Sequence Number=SeqID_42456
  Homolog annotation: Hit_ID=Q2HW90; Match level="QueryCoverage=59%, HitCoverage=39%, E-value=4e-20, Identity=34%"; Hit description =Putative uncharacterized protein
MGTNQTGKRFYQVKVKSLDTTSIKELGRLMEPLQMQAFRKTYGKILELTIADVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMANQGNWVPFMDVLALLIFGVVLFPNVDGFDRPSSNRRFSLPYHHSKESPVVAVLADLFDTFDRRYPNIPLVGTRGCINYNPALAIRQLGYPMRGAPTEESMSLFLVRDFGARNSKTIQRIHKAWETPLRKDQELRGIRNGIIGGYHEWLKVHIRGLDWLAQVKVVSEENFEHRKKTKKSKLSKAS

SEQ ID NO: 134142 - protein, 119 aa, Glycine max
  Coding DNA Sequence Number=SeqID_42457
DYDEDSSRACRWIATKKTVKSIHTPAYREHLDRLRIPDVCWIPYEEHRPTIPALPVDSWVSYDNIHDRWMHYSNHMILAGEATETDIPHVPKPGAPSTSARLAVEEPRHAVEVCYGIAE

SEQ ID NO: 134143 - protein, 87 aa, Glycine max
  Coding DNA Sequence Number=SeqID_42458
MIESFEQQEMSVIELCVEVDVAGASAINFTDEDEDIDEISDTDDEAARLIEPLTVVQSGEVRLYFEILLLTIVILIGVILTKKIFAV

SEQ ID NO: 134144 - protein, 96 aa, Glycine max
  Coding DNA Sequence Number=SeqID_42459
MGLRIKSGEWRIGEQSYAITSRGSRLEALGNDINGSPNKSGEWRIGGQHYAITSRGSRLEGGGHMNSARKLHSWVSEKKWRRENWRTGLRNNFARL

SEQ ID NO: 134145 - protein, 83 aa, Glycine max
  Coding DNA Sequence Number=SeqID_42460
NLVPLDLEIEATLRRNIAERRRKLLQDWTVASILEEEAQSSDPTSSYSPSSRESTTYSSEATVMADEHQHRVTLEDYSSSSML

SEQ ID NO: 134146 - protein, 74 aa, Glycine max
  Coding DNA Sequence Number=SeqID_42461
  Subcellular localization annotation: CTP_CleavageSite=34; ConfidenceScore=5.18e-01
TLNQNVSEVPSSPPHPTEVAPPPLLTYQRRRQTVGSTVPEASPHDSHPSSITPQAMDPATSHSSDSDWPIAIRK

SEQ ID NO: 134147 - protein, 284 aa, Glycine max
  Coding DNA Sequence Number=SeqID_42462
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPLTTDALLPTHSSTPPFKLPECRKGVPRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134148 - protein, 135 aa, Glycine max
  Coding DNA Sequence Number=SeqID_42463
  Homolog annotation: Hit_ID=O69421; Match level="QueryCoverage=20%, HitCoverage=28%, E-value=1e-07, Identity=100%"; Hit description=InsA protein
  Pfam annotation: Domain name=Ins_element1; Domain location=28-84; Score=-17.7; E_value=0.0068; Accession=PF03811.4; Description =Insertion element protein
  Subcellular localization annotation: CTP_CleavageSite=57; ConfidenceScore=5.69e-01
MVKVGTSYVPINVSFSPKVGPGLPGAPVASVSISCPSCSATDGVVRNGKSTRRTSALASVAVPLRVTTTPAALNAPLQGASHSPFRLRNCWEGRSVRASSLLRQLAKGGCAARRLSWVTPGFSQSRRCKTTASEL

SEQ ID NO: 134149 - protein, 142 aa, Glycine max
  Coding DNA Sequence Number=SeqID_42464
  Homolog annotation: Hit_ID=Q8S6U7; Match level="QueryCoverage=66%, HitCoverage=12%, E-value=1e-07, Identity=32%"; Hit description =Putative retrotransposable elements TNP2
MPSIIEQDEVDDVHAIRNNHHKGLWENIPTVMGTPPRSPPHSDAREKIPIVHSNWKDVSESLKDLVWDDILAKFDIPEASNAKKKVMSMMATRWRQFKSSLTTKFVYADNNNEQKQDPSIKYGMDQQTWDEFAASRKTPTRQ

SEQ ID NO: 134150 - protein, 64 aa, Glycine max
  Coding DNA Sequence Number=SeqID_42465
EYVSSVEGGQLGMVGSCLICGKWYLEICRGGQETLGTSGLRNGNRKLKWPLVIDYQGGVIDYRA

SEQ ID NO: 134151 - protein, 127 aa, Glycine max
  Coding DNA Sequence Number=SeqID_42466
MTRGNPSDLQPFDPEIDRTFHRLVRHHFIPFDHSEHSITGESVHSVIGDFEHPDLEHYNFEHSDSEHSDFSHSENMAQPPPRERTLREMDAPNFTYESLCIQYPDEDVPYVLKTGLIHLLPKFHGLA

SEQ ID NO: 134152 - protein, 136 aa, Glycine max
  Coding DNA Sequence Number=SeqID_42467
MAIDDAGHDKASILKVKALEAVDKSLGIAGKASMGSRINRKISVFPLFLLKLLKPWSLLLNPWQKLPPSTEISLNACGHHMIVLRRFSPPLQWPLETLNPGIAPKAIAQPWYDFLAESDFDHGDEVSFYYRRFDKV

SEQ ID NO: 134153 - protein, 49 aa, Glycine max
  Coding DNA Sequence Number=SeqID_42468
MHLHDQGSLLNNKEKNKMKDCKNTSGEDVSFNSRISQSLTNSSQALKPA

SEQ ID NO: 134154 - protein, 133 aa, Glycine max
  Coding DNA Sequence Number=SeqID_42469
METISNRFEELDVYGKFTLKSKLWELAYPNQNSMCPPPAKVNTRGAPKKSMNRNQRSTKCDPSYWEYVDYLHFVQNRNSSVKCSASSSDQPIQERSCQCLDQFHPFIQDLMTTLWMSKLTVTMDIDRLPIYYV

SEQ ID NO: 134155 - protein, 96 aa, Glycine max
  Coding DNA Sequence Number=SeqID_42470
  Subcellular localization annotation: CTP_CleavageSite=54; ConfidenceScore=5.49e-01
MVKVGTSYVPINVSFSPKVGPGLPGAPVASGFYQLSPPCFSLLTGVGRVPFAIQAAQLLGRAIGAGLFAITPAGERGMCCKAIKLGNARVFPVTTL

SEQ ID NO: 134156 - protein, 117 aa, Glycine max
  Coding DNA Sequence Number=SeqID_42471
  Subcellular localization annotation: CTP_CleavageSite=42; ConfidenceScore=5.16e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMSVSIYYGTQSDIR

SEQ ID NO: 134157 - protein, 232 aa, Glycine max
  Coding DNA Sequence Number=SeqID_42472
MVFLRERRVQLRDDEYTDFQEEIVRRRWASLVTPMAKFDPDIVLKFTPMLATEEGVRDMRSGCYRPAPGISFSAGRGPGINILPSDHNSDLPLPKCQLVYAILTRMSIHVAQLIADAIYIFAGMAPTRHPLDPDKSNKALGFPALITGLCQSFGVPVAPSMVIRPPITRAFIEKYCTQRQVQGDAPQAADALPPHQAGPAGSFDTEQYLRHLVRQQAANHRAHVQTHDCLTR

SEQ ID NO: 134158 - protein, 50 aa, Glycine max
  Coding DNA Sequence Number=SeqID_42473
  Homolog annotation: Hit_ID=A5BMX7; Match level="QueryCoverage=84%, HitCoverage=5%, E-value=2e-08, Identity=54%"; Hit description =Putative uncharacterized protein
MDSLKQSWYIDSGCSKHMAGDASKFIHISPKNSEHVTYGDNKKGGEIDKR

SEQ ID NO: 134159 - protein, 192 aa, Glycine max
  Coding DNA Sequence Number=SeqID_42474
  Gene Ontology: Mol. function=aspartic-type endopeptidase activity; Biological process=RNA-dependent DNA replication
  Homolog annotation: Hit_ID=A5C647; Match level="QueryCoverage=54%, HitCoverage=5%, E-value=1e-10, Identity=33%"; Hit description =Putative uncharacterized protein
  Subcellular localization annotation: CTP_CleavageSite=32; ConfidenceScore=5.17e-01
PYIPPPIQQQQQPQKQPTVKAPPQPSLEELVRQMTMQNMQFQQETRASIQSLTDQMGQLATQLNQQQSGKQCQGPQPVAPSSSANEPAKLHSTPEKGDDKNLPNNFCAGESSSTSNSDLQKQHIPPLPFPPRAVNIPLLDAIKQIPRYAKFLKELCTNKRKLKGSERISMGRNVSALIGKSVPQIPEKCKDP

SEQ ID NO: 134160 - protein, 311 aa, Glycine max
  Coding DNA Sequence Number=SeqID_42475
  Gene Ontology: Mol. function=transferase activity; Biological process= biosynthetic process
  Homolog annotation: Hit_ID=Q7CSS2; Match level="QueryCoverage=98%, HitCoverage=76%, E-value=1e-145, Identity=78%"; Hit description =Glycosyltransferase
MRILQVTSLFSPDRVGGAEIFVEDLARGLAGKGHTIAVAAISRERQTAELRDGFAIHRLGHTTPFFIGDWERQSEWKRKYYKVAVQIDPRLVQRLARVIEDFRPDVVNTHSLSELTPLIWPMIGRRGIPLVHSLHDFTSMCTNGSLFHEGHICDGRSKKCRAFSCLHRRCQGAVDAVTGVGSDILKRHLEAGFFTHVPENRRAIIWNAIAQPESLNPRKARVAGEPLVFGYLGRIEEPKGADLLIDAMRLLPPQGWRMTMAGRAPGGIETYKRKASGLPVDFPGYVEADSFFAGIDCLVVPPLWPELSAER

SEQ ID NO: 134161 - protein, 114 aa, Glycine max
  Coding DNA Sequence Number=SeqID_42476
MYVRDGGIRKDEELLIHSFLEKSTGVAVTWMQLQNICKKGDGSFKEHAQKVEGSSGPSGTPNDGKGDDDRERIDTLMERCGAAIALPNFALFASERIEPDVPIRHQPNESSNLR

SEQ ID NO: 134162 - protein, 77 aa, Glycine max
  Coding DNA Sequence Number=SeqID_42477
MTPVNRKAGTGERTREPPGGNAGIFIVLSGFATTDLSVRFRDACQGGGAYGKTALPRPSHFPVKYLPGIFQEISARS

SEQ ID NO: 134163 - protein, 280 aa, Glycine max
  Coding DNA Sequence Number=SeqID_42478
  Homolog annotation: Hit_ID=A5APQ3; Match level="QueryCoverage=38%, HitCoverage=8%, E-value=2e-13, Identity=35%"; Hit description =Putative uncharacterized protein
  Pfam annotation: Domain name=DUF1723; Domain location=43-92; Score =38.1; E_value=3.1e-08; Accession=PF08330.1; Description=Protein of unknown function (DUF1723)
ERPELKLASHGKKVEKFGRPAPKIEGLVTAIGLTPLIACLVDTGDLGVISAFVERWHKETSSFHLPVEELAITLDDVASLLHLPIISAFHSFEPLHVDEAVIMLMELEESGSYAWGAAALVHMYDQLNDASKSTGRQLAGYITLLQCWIYKHFPNVHESMTDERYDETSQRAYRWLTMKAYMKELTASSYRTRIDALVIPDDIDDRWMHYSDHLAVAGQICLVSGQCSANYMDWFFGISHPFITPTRAVDQPRHPLVPQHEAYVEPDIPEVPVAPEAGPS

SEQ ID NO: 134164 - protein, 116 aa, Glycine max
  Coding DNA Sequence Number=SeqID_42479
MAPKKLSTKRSRRDATGEGSSAASEFDSHHFRSAEHQRRFEAIRGWSFHRERRVQLREDEYTDFQEEIAHRRWTPLVTPMAKFDPEIVLEFYASAWPTKEGVRDMYSWGKGSVDSL

SEQ ID NO: 134165 - protein, 57 aa, Glycine max
  Coding DNA Sequence Number=SeqID_42480
MRKVKGNVSFGDSSKVQIQGKDFGNKVLAIVNQMKFTLNRENMEACSCGSEKMTFGP

SEQ ID NO: 134166 - protein, 153 aa, Glycine max
  Coding DNA Sequence Number=SeqID_42481
  Homolog annotation: Hit_ID=A5AQM5; Match level="QueryCoverage=80%, HitCoverage=13%, E-value=1e-10, Identity=31%"; Hit description =Putative uncharacterized protein
  Pfam annotation: Domain name=zf-CCHC; Domain location=104-121; Score =22.6; E_value=0.00058; Accession=PF00098.14; Description=Zinc knuckle
IAESRDLTNMSLATLFGKLQELEMELMRLQQHEENDKKRKGITLRASSSSIQEENDKEDLTEIEEDDDFRFFVKRFNKFLRNKRNQRKSNINPKKKGEDSSLAPKCYECDQPGHMRFDCLVFKRRMEKSDKRNFKEKKEKKAYIIWEDNDINS

SEQ ID NO: 134167 - protein, 126 aa, Glycine max
  Coding DNA Sequence Number=SeqID_42482
MPRQAQDDAPQAADTPPPPHQADPAGSLGMERYLQHLVHQQAANHRGLVQIHGCLYLLSLSQQGQGFAPFACPTPDQFRAEVALHGDWPEAQAGGAPAGAPGDAEEARMDEEMTDLLGFLGGSGAT

SEQ ID NO: 134168 - protein, 124 aa, Glycine max
  Coding DNA Sequence Number=SeqID_42483
  Homolog annotation: Hit_ID=A5AWV0; Match level="QueryCoverage=97%, HitCoverage=8%, E-value=7e-09, Identity=32%"; Hit description =Putative uncharacterized protein
MRAKNSDLYGFLELQSIQGSGQSQFETESYIKSWMQSSKHDVYLGDYLNGGHWQMVVIVPKEHLVVWFCSLHNRPDNYLKGIINSALKGLDDAPQPKSKVPTRWIVVKCNRQKGSTECSYYVMH

SEQ ID NO: 134169 - protein, 94 aa, Glycine max
  Coding DNA Sequence Number=SeqID_42484
  Subcellular localization annotation: CTP_CleavageSite=31; ConfidenceScore=5.33e-01
MKENRAKLAVLSSRMSMCGTGTMFATHYGYRATARKPASNCFFTSSFIFKDVSSFILLSFCFTGEHSGFRGNRYCTMSELKPGISWYDQAKMSW

SEQ ID NO: 134170 - protein, 347 aa, Glycine max
  Coding DNA Sequence Number=SeqID_42485
  Homolog annotation: Hit_ID=UPI00006A2D9E; Match level="QueryCoverage =42%, HitCoverage=85%, E-value=6e-14, Identity=16%"; Hit description =UPI00006A2D9E related cluster
  Subcellular localization annotation: CTP_CleavageSite=53; ConfidenceScore=5.36e-01
TTRPRLQRTTRPNLQRTTRPHLQKATCPRLQRTTRLRHQRATRPHLQRTTRPRHQRDKALNFRGLHALTFRGLHVLLFRGLHALTFRGLHVLTFRWLHSLPFRGLHALAFRGLHVLAFRGLQVLTFRGLHALAFKGQHVLAIRGLHVLAIRGLHALPFRGLHALHFRGLHTLTFKGLHVLTIKGLHALNFRGLHALTFRGLHVLAFRGLHAFAFRALHALAFRGGYPPPLMLNQGLRSEAIMQLLCIPGQNFTQTTTGRRVRIMRTTTTPISPCQRIAFVRQLVDPEKSNRVLGFPTLITGLCQFYGAQGETPQHAIGDGTLTPPPPPEPLSSSIKAGALPTTRDRP

SEQ ID NO: 134171 - protein, 36 aa, Glycine max
  Coding DNA Sequence Number=SeqID_42486
MHSGAQCPMCAVKKTRNTEMYTVWQYPQIIIQQRRT

SEQ ID NO: 134172 - protein, 164 aa, Glycine max
  Coding DNA Sequence Number=SeqID_42487
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MWGIPVILEPNQALTCIMSSRSTSFEPKSRITINLDPGKRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134173 - protein, 77 aa, Glycine max
  Coding DNA Sequence Number=SeqID_42488
MSPVESPTVATCPSRASEGEAHGCAFQRRKDARSRHQRLFVENVGKTEGNRSTKAGFLLLRTLLWRGNKTYVVLSHA

SEQ ID NO: 134174 - protein, 289 aa, Glycine max
  Coding DNA Sequence Number=SeqID_42489
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSQWVHPDSNDVDKSVTRPKSKQENTIALPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134175 - protein, 63 aa, Glycine max
  Coding DNA Sequence Number=SeqID_42490
  Homolog annotation: Hit_ID=Q4YXV0; Match level="QueryCoverage=44%, HitCoverage=6%, E-value=9e-07, Identity=89%"; Hit description =Putative uncharacterized protein
MPATGNAVPFAAFRLTQLLGRAIGAGLFAITPAGVKGDGEWSSTAVAAALELVDPPGCRNSIF

SEQ ID NO: 134176 - protein, 17 aa, Glycine max
  Coding DNA Sequence Number=SeqID_42491
MGIKPPAVDLLVFPVTT

SEQ ID NO: 134177 - protein, 178 aa, Glycine max
  Coding DNA Sequence Number=SeqID_42492
  Subcellular localization annotation: CTP_CleavageSite=28; ConfidenceScore=5.03e-01
MTSLFSNILPSDHNANLSLQMYRLGSCPQDAQWARRSPTGPWGFQLWLRASVSPIGCSFPQRGITPTKTPSGPGEVQQGPGGSHLQDTQWTRRSPTGSWSCQALITGLCQFYGVPVTSSKGIRPPTNRAFIKKYCVSRQAQGETPQQPGDGRQRATDAPPSPLEFTSAHQTKRLEHCL

SEQ ID NO: 134178 - protein, 65 aa, Glycine max
  Coding DNA Sequence Number=SeqID_42493
MEEKKKKKVEEAAQFGNTNTVIDPPSPIKRHVKWKMARTKKTEQMTYETTKEIANKIDLLEEQVS

SEQ ID NO: 134179 - protein, 149 aa, Glycine max
  Coding DNA Sequence Number=SeqID_42494
RGLILGLEELDIFISTGKKHFPTSAKGCQVACVKYKLPTCFCTGLVINTRVARLHSVFRDSFKGMMESCPRCGELHLESQRNKSALQHGRLHLKYLRIGDICWTKVEDLIRLKHKFEHVQIEVTAITPLADKCPACPSVFQTDLHPMPL

SEQ ID NO: 134180 - protein, 170 aa, Glycine max
  Coding DNA Sequence Number=SeqID_42495
  Gene Ontology: Biological process=transposition, DNA-mediated
  Homolog annotation: Hit_ID=Q1J7G7; Match level="QueryCoverage=22%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLWMQVGTRTAVIISEPIKLIDTVDLEGGPVGKPVVPAALMNRPTRGERRFAYWALAECILAYYVGTDEGVSEVLHVAGEKRLH

SEQ ID NO: 134181 - protein, 240 aa, Glycine max
  Coding DNA Sequence Number=SeqID_42496
MGINQNGKRFYQVKVKGLDVTSLKELGRLMGTPPKASLPQSVREDSRFGRSGGIYGSCRIPRPILRPAVEVFHVWGLPMVPTIEEFEEILGCPLGGRRPYLFSGFLPSLRKIATVVGDSAKELDRTKQTRNGVVGLPRKYLEDLAAIDAFLAYHHSKESPVVAILADLFDTFDQRCEKNSARIVYCLPALCVWLISHLFQQDTRHPCPLQSYRSCAEKGRVVWDQHLAGIGASVEERQGA

SEQ ID NO: 134182 - protein, 62 aa, Glycine max
  Coding DNA Sequence Number=SeqID_42497
MLLSSNVIYICVRVVMLVRMIRTRLFAAARAIRTLRRFAKVRGSKTKPTHDAYAKGTTRGCT

SEQ ID NO: 134183 - protein, 47 aa, Glycine max
  Coding DNA Sequence Number=SeqID_42498
MFQSLTIHHPCSVRVLRLWIMQFYCIVRPNILNDERSRPFGIQFTRK

SEQ ID NO: 134184 - protein, 110 aa, Glycine max
  Coding DNA Sequence Number=SeqID_42499
MHHRPRTRRHVIRLVQLGSFDTEQYLRHLVRQQAANHPGTSCRARALLLFSCPTPDQFRAEVAWPGDWPEAQAGEAPAGAPAEAPDEADETREDEEMTDLLDFLGGSGAT

SEQ ID NO: 134185 - protein, 83 aa, Glycine max
  Coding DNA Sequence Number=SeqID_42500
MVYRFSLRFADSGTSDIETLEIERQKLSRNSNGHNFSHGGPMPEHHLSRRLKLNSGRYREIQMVITCHTEVRFRRIIYRDARN

SEQ ID NO: 134186 - protein, 125 aa, Glycine max
  Coding DNA Sequence Number=SeqID_42501
MSIRSTSLEPKSHLTINLTLKRKQKGESSRSKNRKKKKKKGKFPIKEWEKANKRKKIPDQGSEENRRNMQKGLWTRQYLNNTELSPSKQEKKGNHDLKWSSPFDCQPKSCASVTCSPHTKQGGIL

SEQ ID NO: 134187 - protein, 99 aa, Glycine max
  Coding DNA Sequence Number=SeqID_42502
MENSDKMNFKEKKEKKGYITWEDNVINYSSDSEKKIISLDIMMKDYENGEEQSRYIDSNFSKHMACIKVYSFFLSKINEYVIYGDSKQRPHFSPRKVNM

SEQ ID NO: 134188 - protein, 510 aa, Glycine max
  Coding DNA Sequence Number=SeqID_42503
  Gene Ontology: Mol. function=motor activity; Cellular component=cell projection
  Homolog annotation: Hit_ID=P15305; Match level="QueryCoverage=86%, HitCoverage=89%, E-value=1e-26, Identity=20%"; Hit description =Dynein heavy chain
MSSPSEDYTSSPSENYTSSPSEDYMSSPSEGYTSSPSEGTTPSPSEGYAPFPSEGYTPSPLEDYTSSPSEGCTPSPAEDYMSLPSADYTSSPSEGCMPSPFRGLHVFAFRGLHGLAFRGLRALAFKGQHILSFRGLHALAFRGGLPVLTFRGLHALAIRGLHVFIFRGLHVFPFRGLHALAFVGLHVLTFRGLHALTIRGLHALNFRGLHVLTLRGLHAFAIGGLHVLPFKGLHVFAFRGLHVVAFRGLDVLAFRGLHALAFRGLHVLTFTFRGVQVLTFIGLHALAFRELHTLTFKGLHVLAFRGLHVLTLRGLHAFAFRGLHVLPFKGLHVLAFRGLHVLAFRGLHVLAFRGLHALAIRGLHVLTFTFRGVQVLTFIGLHAFAFRGLHILRFKGLHVLVFRGLHVLAFTGLHALAFRGLHVLTFTFRGVQDLTFIGLHAFAFRGLHVLPFKGLHVLVFRGLHVVSFRGLHALAFRGLHSLAFRGLHVLAFTFRGVQVLTFIGLHALAF

SEQ ID NO: 134189 - protein, 119 aa, Glycine max
  Coding DNA Sequence Number=SeqID_42504
  Homolog annotation: Hit_ID=A5B4U1; Match level="QueryCoverage=79%, HitCoverage=13%, E-value=3e-31, Identity=69%"; Hit description =Putative uncharacterized protein
MDIDFDIRKDEPPAIIDESNPADVALYEQWERSNRLSVMFIKTKSSARIHDSVDLHEKVRDLLKAIDDQFITSDKTLASTLIMKFSSLRLTSVKGRRKACNGDGWECIADNCLWEEQSN

SEQ ID NO: 134190 - protein, 81 aa, Glycine max
  Coding DNA Sequence Number=SeqID_42505
MENKNNNSGESELRVVVVIFLLKGRSILLGRCRSAVGNCPSPYGHLELPRGALLHAPSIIDGAPIKRVLKLKDCPIHKWFK

SEQ ID NO: 134191 - protein, 68 aa, Glycine max
  Coding DNA Sequence Number=SeqID_42506
  Subcellular localization annotation: CTP_CleavageSite=55; ConfidenceScore=5.12e-01
MHMTQMQFTNTGAREIVPFLDTMFGRHGTQRMFLRRRHGPSVGFAKVRGSRQNPCAMHMRKAQHGGCT

SEQ ID NO: 134192 - protein, 158 aa, Glycine max
  Coding DNA Sequence Number=SeqID_42507
MDLIENMAVSDIFILRDRAHIPTKKSLLELTSQDALLILGCTICSRAHDSGYCIPSEEPIVHEVNYMGNQPRNTFNAEGFTGFQNGQQYQQQRQWQNHPGNQFNRDQGGPSNRPQQQGPSLFERTTKLEETLAQFMQVSMSNQKSTESTIKNLEVQVG

SEQ ID NO: 134193 - protein, 109 aa, Glycine max
  Coding DNA Sequence Number=SeqID_42508
  Homolog annotation: Hit_ID=A7QIF4; Match level="QueryCoverage=55%, HitCoverage=9%, E-value=2e-10, Identity=53%"; Hit description =Chromosome chr12 scaffold_103, whole genome shotgun sequence
MTEHLHYRALLVYLDVVRLLNYLQVTIPLGYHDDCSLYVSFVSFHGADKFLLNTILDIYSTLQEQEQSVERPTMREVVEMLAPAKIYKHIPNAVSPLGGEEPIMEKAPT

SEQ ID NO: 134194 - protein, 183 aa, Glycine max
  Coding DNA Sequence Number=SeqID_42509
  Gene Ontology: Mol. function=protein dimerization activity
  Homolog annotation: Hit_ID=A5C6E9; Match level="QueryCoverage=67%, HitCoverage=16%, E-value=5e-16, Identity=32%"; Hit description =Putative uncharacterized protein
  Pfam annotation: Domain name=zf-BED; Domain location=74-120; Score =47.1; E_value=6.2e-11; Accession=PF02892.6; Description=BED zinc finger
MAENMQIEEPSSHQPTSQSSDHPTPLSSHQPTLVESSTGTVEGPNNEPMQQPPSIEVDDHGVSSTKTGGVRLKSIVWNHFDKIKTVDGQDKAQCKYCKKLLGGASKNGTKHLHAHMEKCIRKRLHDKGKGQTFLIPKLLDTNEGRVAITSDMWTASNQKKGYMDVTAHYIDSSWTLQSRILRY

SEQ ID NO: 134195 - protein, 190 aa, Glycine max
  Coding DNA Sequence Number=SeqID_42510
MLPFDSRHVAELHGLPNDGCQVPRSGHAKVASHQTDGPRTKLGHKADLNLSHPYSLGSFLESFVEVWLGSAHDGPPLLVVHHQVLNCGHSDDYHHRNHISKFVELGELDVFYVVYPGDIAEEVGISASLRPPFVASRVFFVLELHFECPTPLYLFFELELYHDDFDNHWLYGVNDYNGFLCTLGHHSASS

SEQ ID NO: 134196 - protein, 82 aa, Glycine max
  Coding DNA Sequence Number=SeqID_42511
MAYQKGIIELYWIWLGRMLQKARLVAKGSLKMMNIKEYSFTGEVALYGWGSHEEKETSYCVTICKEIRNTILSKLPPMVFEV

SEQ ID NO: 134197 - protein, 334 aa, Glycine max
  Coding DNA Sequence Number=SeqID_42512
MRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLDENYNLHPFEFNHSHFCTMGFVTWWEKYYSTRSVGDTTIMISRLESGFTQPTVENIRSNLQARGKTIMTKKSAETSRADVRPKKPTGVKIQERKQEEKEEEERPLIRKRKFPSTSTKSTEQTEAGNSQAQIPKKKKKVKQDEPEPPVAVEGGEPIKKKKKKTKSSKEQGDNQLVDVQPPSTDVDGTEVEATPSIAEMGNPVEQPNSPQEQPAVEVSSS

SEQ ID NO: 134198 - protein, 170 aa, Glycine max
  Coding DNA Sequence Number=SeqID_42513
  Homolog annotation: Hit_ID=UPI00006A2939; Match level="QueryCoverage =81%, HitCoverage=75%, E-value=2e-10, Identity=31%"; Hit description =UPI00006A2939 related cluster
DGPSGTSTLVFRGLHVLANRGLHALTLRGLCVLTFRGLHVPTFRGLHALAIRGLRVLTFRGLHALAIRGLHVLTFRGLHALAIRGLHVLTFVGLHTLTFRGLHVLANRGLHALTLRGLHVLANVGLHALTFRGLHVLAFRGLHVLTIRGLHALASRGYASSPSEGSTSAP

SEQ ID NO: 134199 - protein, 97 aa, Glycine max
  Coding DNA Sequence Number=SeqID_42514
MEWYLQHLVRQQAANHRGQVQIHECLYQLNLSQQGQGFTPFACPTPDQFMVEVAWPGDWPKAQAGEAPTGAPGDAEEARMDKEMMNLLGFLGGSGAT

SEQ ID NO: 134200 - protein, 114 aa, Glycine max
  Coding DNA Sequence Number=SeqID_42515
MTLIIPQLYLKSLKVMWNATLFGVFNNNFPLYIKHEDLSEIAHGGQCLSISIIQLWILHMTKTSMRAGNADVYGFLEPQSIQRSVQSQFQSESYIKNWMQNSKRDVYLGVYLNG

SEQ ID NO: 134201 - protein, 312 aa, Glycine max
  Coding DNA Sequence Number=SeqID_42516
  Homolog annotation: Hit_ID=Q6WAY6; Match level="QueryCoverage=12%, HitCoverage=6%, E-value=2e-08, Identity=69%"; Hit description =Putative uncharacterized protein
STYMIPLTEDVRRAVRGLFAVLQLFMYGWFHTFFAKRGFPNVPLIRTRGCISYNPVLAIRQLGYPMRGAPLEEELAPVISRGFDKTNVETLQNLRIAKREEVEASEEDEEVQALRVELEQAQTVKERFKSAGLKIRKENAEMRDINIATTKALEEETKRARREEHGRNKFRGALWGSNSELKLQREERDQSRVDSLILKDELKVCSRSKRNLSQRLCETETNMLAIVSKYQEELNLATAHEHKVADEYARVYAEKEDRGRVIDSLHQKATMWMDQFALTLNGSQELPRLLANAKAMADTYFAPEEIHGLLGY

SEQ ID NO: 134202 - protein, 128 aa, Glycine max
  Coding DNA Sequence Number=SeqID_42517
MGEAKEVQEKMKADMEAMKVQMATMMEAMMSMKKIMEANTVIVAATSVVAKVNPMLRSGLNQMNHPTSNMAHISQTMGETHEIPHHNLADFEPCLGYAAEGQAVGGIPLQNTLEGPLSVTHDHNPRSG

SEQ ID NO: 134203 - protein, 37 aa, Glycine max
  Coding DNA Sequence Number=SeqID_42518
SEEKLEESQGTARDAAIAVGRHVSPLRGRDELFTIED

SEQ ID NO: 134204 - protein, 252 aa, Glycine max
  Coding DNA Sequence Number=SeqID_42519
  Homolog annotation: Hit_ID=Q6WAY6; Match level="QueryCoverage=96%, HitCoverage=42%, E-value=4e-14, Identity=26%"; Hit description =Putative uncharacterized protein
KAFRKVYGKILDLTAAEVFTEAVVSLAQYYGQSLSAINWFPRWKEGKEGVLFSCGDYPNVPLIGTRGCINYNPALAIRQLGYPMRGAPTEGSLSPFLVKDLGAQGLKVIQRIHKAWRSPLRKDKELRGIRNGVIGGYHGWLRIHTRGLDWLSKLKVIDEENFEAPEEDEEVRALKLELGKERLAKEKFKSAATHIRKECTELQEENAATARALEQETKRARKEEYGREKFRGALWGSNNELKLRREERDRSR

SEQ ID NO: 134205 - protein, 110 aa, Glycine max
  Coding DNA Sequence Number=SeqID_42520
NFRGLHVLAVKGSCTFTFVRRHALTFRGLHVLAFRGLHVLAIIGLHSLAFKRDRTNKTPSGPGKVQQGPGVSSSSYGPLSVLQGAHTPPARSRHHRDRVCKTPNGPEEVQ

SEQ ID NO: 134206 - protein, 68 aa, Glycine max
  Coding DNA Sequence Number=SeqID_42521
IDLLDDSETSSRVFLFDDTLSLVVPTATTFDIKGDDISRLYNVGKVSYPNFVRGPLLDDMRPFFGPRE

SEQ ID NO: 134207 - protein, 87 aa, Glycine max
  Coding DNA Sequence Number=SeqID_42522
MGESLTEQCRVKVEGLRVMNFFSRRRSNDVRRQIPGLNPGQAVETTKLEYGRGRGNFRWSGEMRRDRKEHQRRKHSAGPTLTLRDES

SEQ ID NO: 134208 - protein, 175 aa, Glycine max
  Coding DNA Sequence Number=SeqID_42523
  Gene Ontology: Mol. function=helicase activity; Biological process =viral genome replication
  Homolog annotation: Hit_ID=Q9LW42; Match level="QueryCoverage=61%, HitCoverage=6%, E-value=1e-24, Identity=55%"; Hit description =Helicase-like protein
MKNCQSNSNELATNIEGYSDLGDQAMQCRHCNAKMRQHVAIQPHIVSALIQMLDDHNVHAKSFRMARDRLTDSQLDNVKLRLIAGREKDGRTNNLPNVFEVAALIVGDFDADSRRDIIVETQNRELQRIHELHSSYLGLQYPLLFPYGENGYRPDILHRSTSSSRKRKRNCLTMR

SEQ ID NO: 134209 - protein, 109 aa, Glycine max
  Coding DNA Sequence Number=SeqID_42524
MNCVFMGSRGSYWMSNSESSMEQATIFLTSSGFLKNLLDGVVRLDYHLMTREVRLESLGQGNEWAELITSSITERYKSKGALGLDRLKDGSVVMVFLKARKACSQVSFH

SEQ ID NO: 134210 - protein, 205 aa, Glycine max
  Coding DNA Sequence Number=SeqID_42525
  Gene Ontology: Cellular component=integral to membrane
  Homolog annotation: Hit_ID=A5BGF1; Match level="QueryCoverage=20%, HitCoverage=50%, E-value=5e-12, Identity=75%"; Hit description =Putative uncharacterized protein
  Pfam annotation: Domain name=DVL; Domain location=180-198; Score =38.8; E_value=1.9e-08; Accession=PF08137.3; Description=DVL family
MAILFLLCSGLGYAAFGDNTPGNILTGFTEPFWLVALGNGFIVIHMIGAYQGVLLISPSALSSSLSQTGLLFRDCNHIVELVFVEFVSATYRLRSKKTTKGKGGKRFWKSIVVGFKPPREAIKVRIDGLGQQPKENHATASSPIFLALLTVYALSSPPNSSSSSTQRKCAFARKCARLVKEQRARFYIMRHCVIMLICWHEYNDS

SEQ ID NO: 134211 - protein, 41 aa, Glycine max
  Coding DNA Sequence Number=SeqID_42526
MPPERDDHDDDAALRAGTGVRHQWQHGGCGDIGGSGSIASF

SEQ ID NO: 134212 - protein, 159 aa, Glycine max
  Coding DNA Sequence Number=SeqID_42527
GLHVLTFDGLPVLAFRGLHGLTFRGLHVLSFKWTTHVCLSEGYTPSPSKADYTSHLLEGYTSFKVHALTFRGLHVLTLQRTTRLAFRGLHASPSKDYTPRLQRATHPHLQRLHVLAFRGLHVLTFEDFPCYRPYLQRTTRPRLQRATRPLLQRTTRPHL

SEQ ID NO: 134213 - protein, 122 aa, Glycine max
  Coding DNA Sequence Number=SeqID_42528
  Gene Ontology: Mol. function=nucleic acid binding
  Homolog annotation: Hit_ID=A5AJR6; Match level="QueryCoverage=86%, HitCoverage=11%, E-value=2e-15, Identity=38%"; Hit description =Putative uncharacterized protein
  Pfam annotation: Domain name=Retrotrans_gag; Domain location=44-118; Score=-0.5; E_value=0.061; Accession=PF03732.8; Description =Retrotransposon gag protein
MAKEQPNQCDLGNHSNPYSHLETYIEICNTVKLVSVPEDAIKLSLFSFSLSGEAKRWLCSFKGNNLKTWDEVVEKFLKEYFLESKTGEGKVSKQLLDAFAGGKIKLKTPEEAMVLLDQVASE

SEQ ID NO: 134214 - protein, 184 aa, Glycine max
  Coding DNA Sequence Number=SeqID_42529
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=47%, HitCoverage=73%, E-value=3e-24, Identity=66%"; Hit description=LacZ protein
  Subcellular localization annotation: CTP_CleavageSite=45; ConfidenceScore=5.25e-01
MKHFTDTLISANIVSQYTLRLAPNTQTASPRALADSLMQLARQTLAFIRSYPNAVKLLLKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134215 - protein, 217 aa, Glycine max
  Coding DNA Sequence Number=SeqID_42530
VQALRTELEQAQTVKERFKSAALKIRKENAELRDINTATTKALEQETKRAHREEHGRNKFRRALWGSNNELKLRREERDQSRVDNFILKDELKACSRSKRSLSQRLCETETNMLAIINKYQEELNLATAHEHRVADEYAQVYVEKEARGRVIDSLHQEATMWMDRFAFTLNESQELPRLLAKAKAMADTYSAPEEIHGLLGYCQHMIDLMAHIIRNR

SEQ ID NO: 134216 - protein, 140 aa, Glycine max
  Coding DNA Sequence Number=SeqID_42531
  Subcellular localization annotation: CTP_CleavageSite=26; ConfidenceScore=5.19e-01
MLLLSNILPSDRRSPTGPWGFQLWLRAFVSPTGDRARKTPSGPGKVQQGPGVSSSDYEPLTVLQGARPHSWDHARKTPSGPGEVQQGPRVSSSDYRPLSSGPPLTELSSRSIAPPGRRRARHHNSLGMADSGLQTHRHHI

SEQ ID NO: 134217 - protein, 142 aa, Glycine max
  Coding DNA Sequence Number=SeqID_42532
  Homolog annotation: Hit_ID=Q53KJ4; Match level="QueryCoverage=35%, HitCoverage=7%, E-value=2e-07, Identity=54%"; Hit description =Transposable element protein, putative
MHRSPTGNLVPLVLEIEATLRRNRAERRRKLLQDRIIAFILEEETHFSNLLSPDSPSSREPPLNYLKSLPWQKSMTKGLPLRITQGNLFQGLPNEDPYAHLATFIEICNTVKISGVPDEAIRLNLFSFSLAAIIKGIRHSIT

SEQ ID NO: 134218 - protein, 153 aa, Glycine max
  Coding DNA Sequence Number=SeqID_42533
VYYEKLVGYMPSSFADLVFAGERIVEGKTMPILLLFRRCKPEPASPSIHQPELLSSHRRPLVQTMHLRDVEFYPPPRGKLAPARCQPNSKHNHPPPDNSKNRRKLSSLRFRDHPTPNEASKYRTSKYKGTTLVPRTTQRMYCRKYHGVPGIPL

SEQ ID NO: 134219 - protein, 199 aa, Glycine max
  Coding DNA Sequence Number=SeqID_42534
MASRKCKSIGARPTAQYDTRRFHSLDAWNRYTDNVLGKNILPERKVEVYHTEFDNFKTKLERRNLHKRLTNLADGTIDLALVKEFYANLYSSEGRGFILNAEGHPGRILKKDLTTLAQVWSVLLYSNLAPTSHTSDLIVDRARLIFGLISHMEMNIGALISGQMTSIAQSNSSRLGFPTLITALCRARGVVLTASLLSA

SEQ ID NO: 134220 - protein, 179 aa, Glycine max
  Coding DNA Sequence Number=SeqID_42535
YPNDDDDQHDVRLEDEDEVDSEECISIDSMIDIRQFDMEEITDEVVRRLDFGDLELAYQFYCWYAKREFQHQIEGCSEKKKKAGVVVKQCFVFMCIFVQDDGHRKMFAFDIMQVENYRKVGIRPPHMHATFANQCGGYDKVWFIRKDIYNEEGRMRKQHTSDGSGALKYLHDLRKKDPM

SEQ ID NO: 134221 - protein, 79 aa, Glycine max
  Coding DNA Sequence Number=SeqID_42536
  Pfam annotation: Domain name=zf-CCHC; Domain location=18-35; Score =22.4; E_value=0.00062; Accession=PF00098.14; Description=Zinc knuckle
MTIEKKPLKASMQKTSSIKCFKCLGRGHINSQCPTKKTMIMRGQDIYSSQEEATTSPSSSESAEAHGEESSEEIYPQEE

SEQ ID NO: 134222 - protein, 139 aa, Glycine max
  Coding DNA Sequence Number=SeqID_42537
MRAENSDIYGFLEPQSIQRSGQSQFEFESYIKTWMQSSKRDVYLGAYLNGGHWQMVVILPKEHLVVWFCSLHNMSDNYLKGIINIALKGLDDTPQPKSKAPARWIVVKYFNDPRPLEPERLKALRIQWTQYYLRVRDQT

SEQ ID NO: 134223 - protein, 85 aa, Glycine max
  Coding DNA Sequence Number=SeqID_42538
  Homolog annotation: Hit_ID=A5ALX4; Match level="QueryCoverage=49%, HitCoverage=2%, E-value=4e-09, Identity=61%"; Hit description =Putative uncharacterized protein
MKSHQEEMKIVNLGVSKERKKVKVGTARYAQFEPQHCTTSIAVESRLFPMARYPEWMANIVLAPKKDGKIKMAPEDMEKTMFVTL

SEQ ID NO: 134224 - protein, 89 aa, Glycine max
  Coding DNA Sequence Number=SeqID_42539
MHIVVVKQGQDHLELPSGVETKHEQQKPIKVHRNGCRWGWGHDRLIVAPFSTLSKRKTSLQGSPVSFVFAVFFYFLFVLKISNQCLTLT

SEQ ID NO: 134225 - protein, 140 aa, Glycine max
  Coding DNA Sequence Number=SeqID_42540
MIPTHDVVLYYNGRWNMPCQNNFVGYTFTGKNPQKFDIPKGCTINELKYLIKQVEPKGNPPHGIHESQLVRRLFFRQPAHLEYSNNVLKFEIIELKSDDDVLKVLVESNYWKQFVPIEILALFSKPVMENEDEVVTPLQD

SEQ ID NO: 134226 - protein, 127 aa, Glycine max
  Coding DNA Sequence Number=SeqID_42541
MNDLVYVMYNLKLKSRQTRKTVALAFEDMESDDEWITEEGDDIFDEDNFQVEQEQPLGESGSGSNVDLVGGSLTDPTLDAFDIDNMVLNDNVEDHFSTEEELEDDGDENDGGGGDIGDDFIRGLMDI

SEQ ID NO: 134227 - protein, 304 aa, Glycine max
  Coding DNA Sequence Number=SeqID_42542
  Subcellular localization annotation: CTP_CleavageSite=34; ConfidenceScore=5.21e-01
MPASQATMILRTVLRSPSTDAGAAAPPLDCDFISCMRRVAASRSSSSFTLEVFQQESGHHEGDGKGCAHRRNVGEVGAFRGHRQHCQDRTRRSRRNQAAVQHRQGEDAGHAPQDHRQQQAWVHQHVREVDFVDATQEVNDCRTAGGLLGAAATEEHVGHQYAHARAWVGFDQEEYRLADFRGLLDTQRREDAVVDGVVQEQDFRRFNEDGRQWQQVVLHHQKLTPAARILDSTSTAGPMPRNARMARIIPMMPAEKLFTSISKPDLILPSTQTSNFLIAQPPRGPAIIAPRNIGISAPTITPMV

SEQ ID NO: 134228 - protein, 84 aa, Glycine max
  Coding DNA Sequence Number=SeqID_42543
MQNSGVTLRAESQHFASVNDANPCVASIPYFGFIDEIWELNYVKFTRQRSPKQMASLGLHTAHVCRQFHHPPPLHSLASHVYCC

SEQ ID NO: 134229 - protein, 56 aa, Glycine max
  Coding DNA Sequence Number=SeqID_42544
  Homolog annotation: Hit_ID=A5BKB9; Match level="QueryCoverage=96%, HitCoverage=4%, E-value=3e-08, Identity=53%"; Hit description =Putative uncharacterized protein
MRFLTIQTISPNEKFIFMGNEVKAPVEIVETYCLKRNTGHRLDLLETPYIPSLSRN

SEQ ID NO: 134230 - protein, 70 aa, Glycine max
  Coding DNA Sequence Number=SeqID_42545
MARCMLASCPYFRDPYGRELKGLLTIIPKVVISLLMVSRGIIPFEEHIAAVGTTSNNMLSKRKTLDEGSL

SEQ ID NO: 134231 - protein, 80 aa, Glycine max
  Coding DNA Sequence Number=SeqID_42546
MAFKHKVQSLIAAGWLTFQEDSPNVRTNPLTSHGGSVVNAVEKWEPWGRKQMRDMLTSRRGITRCGDVPNGGRVAIRDDG

SEQ ID NO: 134232 - protein, 53 aa, Glycine max
  Coding DNA Sequence Number=SeqID_42547
RVSSSIVNDFFLGDPIVPSSEDRDGNSHPGSRFMVDWWFEVLGQKACRIARHD

SEQ ID NO: 134233 - protein, 109 aa, Glycine max
  Coding DNA Sequence Number=SeqID_42548
MLVPKLWFFLVGGLKTKGSQQNTHYPKEKLPKIITRKWKFGNLLEAPNTLPMKGLFVTKLESNEVLLSPIALKVVGPFLLDSNSSRDDTNPSSNSLYGNPQPRKQRDKQ

SEQ ID NO: 134234 - protein, 39 aa, Glycine max
  Coding DNA Sequence Number=SeqID_42549
AVHVSSTIESGAPLSYPNFVRGPLVDDMRPFFGPCGGIL

SEQ ID NO: 134235 - protein, 138 aa, Glycine max
  Coding DNA Sequence Number=SeqID_42550
SHEEVKRFRFKVIPNWDDIVDLCAKDRATGLGAENALDADDIMSKETNEEEKEGMISSMKEVAESLKEFVEVTKKKMEIKEAQEVVHEVVSELDNIPNFNGALRHRAIDWLTENPIKFAIIKALPLDEKEDYILSFMP

SEQ ID NO: 134236 - protein, 76 aa, Glycine max
  Coding DNA Sequence Number=SeqID_42551
MGSFLKYFHEGTLLDVKRMHVAPKPPVELVSLVSVKKSPVLMAIYVPVGTASQTGEFQVAGCFFQMTGQKASCYCH

SEQ ID NO: 134237 - protein, 67 aa, Glycine max
  Coding DNA Sequence Number=SeqID_42552
ETLVNVAMSASQFGGECAYCNSLAVEESEYAFMDVIESNSLEIGSTNVDSDSSEMELDMGDEMTTLS

SEQ ID NO: 134238 - protein, 90 aa, Glycine max
  Coding DNA Sequence Number=SeqID_42553
MVITFHPEVRFGDIIYRRSKFNNEEARPETFTRTSNSERITYRDARKLGKGNSSRNSNGHNFSNSGCPIQGNNFKTLKIETTDALEKFKW

SEQ ID NO: 134239 - protein, 233 aa, Glycine max
  Coding DNA Sequence Number=SeqID_42554
  Homolog annotation: Hit_ID=A2Q4S5; Match level="QueryCoverage=46%, HitCoverage=16%, E-value=3e-16, Identity=44%"; Hit description=IMP dehydrogenase/GMP reductase, putative
CWIYEHFPSVAESTADQDYDEAYPRACRWIATKKTVKSIRTPSYRERLDWLQIPDVYWIPYGEHPEVQDFHVRSCYSGPLCWGPVAVYYRPERVVRQFGYTQTIPAPPVDSWVSYDDIHDRWMHYEDHILPGGEVCVVPGACSSDYIDWFFRISHPFMTPGHAVDPLPHGHAPQPRVVPQAPQTDIPRVPELGASSTSAEEPKYAVEVCDDIVERLERHLSLGVVTSGSSTHE

SEQ ID NO: 134240 - protein, 59 aa, Glycine max
  Coding DNA Sequence Number=SeqID_42555
MVGAGDNGGVYHQLDGSQHLLLDAMTTQMQRLLNRNKEELYRRIVKSSLFTLKPLSLRE

SEQ ID NO: 134241 - protein, 125 aa, Glycine max
  Coding DNA Sequence Number=SeqID_42556
MATMMEVMMSVKRIMEANAVAIAATSVVAKVNPTSPSGLKQMNHPTSNMVGKDSGIPHHNLADFEPCLGYATEGKAVGGIPLQNPLEGPQYHPQLHLLHSAAVKNPHDYGRNGKVGSSRGKTQGH

SEQ ID NO: 134242 - protein, 127 aa, Glycine max
  Coding DNA Sequence Number=SeqID_42557
  Subcellular localization annotation: CTP_CleavageSite=30; ConfidenceScore=5.01e-01
GLHVLALRGTTRPHHQRAARPHHQRTTRPRLEDTPSSWVLVTLTIERTTRPRLERTTRLHVLANRGLHALTSRGLHVLALRGLHALTLGTSYPRLGRTTRPRQQRAARPHLQRTTCPRLERATRPHL

SEQ ID NO: 134243 - protein, 233 aa, Glycine max
  Coding DNA Sequence Number=SeqID_42558
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGIRSERDYHILVRSLVGIVYGQDYDGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134244 - protein, 36 aa, Glycine max
  Coding DNA Sequence Number=SeqID_42559
MRFMLPEDLGNVNPGHEFMLTLLDIPGGGNRVVKEF

SEQ ID NO: 134245 - protein, 160 aa, Glycine max
  Coding DNA Sequence Number=SeqID_42560
  Subcellular localization annotation: CTP_CleavageSite=90; ConfidenceScore=5.01e-01
SKSLAFVDHTAFCYHDPRAGSLRRHLTVIRTSSVIDKRRPIWSSAPFPKMIRRSKSLAFVGRPIIFVILTLRGGGPDDTRRKILTVRTLLSSRGGGPMITRRYLTVIRTLLSSRGGRPDDNAETKFGHSAPLCHPEAAEPDDTQRYLTDYPHPCVIQRRR

SEQ ID NO: 134246 - protein, 298 aa, Glycine max
  Coding DNA Sequence Number=SeqID_42561
  Gene Ontology: Mol. function=motor activity; Cellular component=cell projection
  Homolog annotation: Hit_ID=UPI00016621D1; Match level="QueryCoverage =91%, HitCoverage=41%, E-value=7e-24, Identity=37%"; Hit description =UPI00016621D1 related cluster
GLHVLAFRGLHVLSFRGLHVLVFRGLDVLLFRGLHALSFRGLHVLAFRGLHVLAIRGLHVLAFRGLHLLAFRGLHTLTLEDYASSPSKDCTSSPSQDITGLHVLTFRGLHIPTLRELDVLTIRGLHVLAFRGLHAPTFRGLHALTFRGLHVLTFRVLHALAFRGLLVLTFRGLHALSFRGLDVLAFRGLHVLTFNGLHVLTFRGLDVLAFRGLHVLTFNGLHVLTFRGLDVLAFGGLHALPFRGLHVLAFRGLHVLTFRRLHVLTFRGLDVLTFSGLHALALQRTTRPLLQRTTRPRF

SEQ ID NO: 134247 - protein, 261 aa, Glycine max
  Coding DNA Sequence Number=SeqID_42562
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 134248 - protein, 134 aa, Glycine max
  Coding DNA Sequence Number=SeqID_42563
MDEFDAQVAWTGAHPSPFGGDEASIAQEPESEEPTAAAKGEDKLTPFEPFYFDAGIHMAQEEETSTDQIPEPSAAPIPDDVIPSAPASELEQPISQDSPVAQPLEENERVIVIMNENVSQFARLIVKECIDRIP

SEQ ID NO: 134249 - protein, 148 aa, Glycine max
  Coding DNA Sequence Number=SeqID_42564
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=3e-24, Identity=67%"; Hit description=LacZ protein
  Subcellular localization annotation: CTP_CleavageSite=42; ConfidenceScore=5.05e-01
MKHFTDTLISANIVIRPPRPPKVLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134250 - protein, 87 aa, Glycine max
  Coding DNA Sequence Number=SeqID_42565
MRQRGHNSGMTPVNRKAGTGERTREPPGGNAWYLYSLSGGAEPMEKRLCRGPLTSLLSIFLASSRKSPPVRKPFPLAAVERPSVASQ

SEQ ID NO: 134251 - protein, 95 aa, Glycine max
  Coding DNA Sequence Number=SeqID_42566
  Homolog annotation: Hit_ID=A5BZZ9; Match level="QueryCoverage=96%, HitCoverage=9%, E-value=1e-10, Identity=38%"; Hit description =Putative uncharacterized protein
MSLPTGRSKMVKDNNDKPVMATPFKTKDVNEEITPKDIRSLMEQANYTNKYLQVLGESISKEKVFTKPKDHESSSSPFQMKKPLFKPFKVSKKAK

SEQ ID NO: 134252 - protein, 95 aa, Glycine max
  Coding DNA Sequence Number=SeqID_42567
MVKVGTSYVPINVSFSPKVGPGLPGINRDTRIYFFCEVIFRHSCPSCSATDGVAAQLLGRAIGAGLFAITPAGERGMCCKAIKLGNARVFPVTTL

SEQ ID NO: 134253 - protein, 55 aa, Glycine max
  Coding DNA Sequence Number=SeqID_42568
AFKGYFDDAKEFKNQEKDSREVSSFKFSRIKNNQEQDSRLKIQESRENLIKISMK

SEQ ID NO: 134254 - protein, 177 aa, Glycine max
  Coding DNA Sequence Number=SeqID_42569
MRSWVRGQWIPFDANALSQFLGDPLILEDGQQCEFSQRRNWVDGFDEKAIAQLLCIPGQDFAWTAAGWRVQIMRTSMTTLTQTWKTLLLNNVLPSDHNSDLPLPKCQLVHPLDQNKSNRALGFPALITGLCQSYGVPVTHSKVIRLPITRAFIEKYCTPRQAQGDTHQAAGAPPPPR

SEQ ID NO: 134255 - protein, 101 aa, Glycine max
  Coding DNA Sequence Number=SeqID_42570
MNFPTKRPIEFTLIPVSYADLLPYLLNNAMVAITPSKVPQPPFFRGDNSNATCAYHGGVSGHSIEHYMTMKHKVQVTCTSEFISESVQLEIARSARLVEVP

SEQ ID NO: 134256 - protein, 66 aa, Glycine max
  Coding DNA Sequence Number=SeqID_42571
MTTDQTPILIDAILPARALDKRLQEDWARDAREGPRVLMSLKGSIIWVRYPRNVGFFCPCILGHLD

SEQ ID NO: 134257 - protein, 84 aa, Glycine max
  Coding DNA Sequence Number=SeqID_42572
MASVETSTMARSQILPEGIKIEPVHDAYAKGSVTIVATYPSAGGRRMTRGMRVPRKEYARSRHQRLFEENVGKTGKDAIYELFK

SEQ ID NO: 134258 - protein, 134 aa, Glycine max
  Coding DNA Sequence Number=SeqID_42573
MEATKEQMTAMMEAMMSEKKIMEANAVAIAATSVVAKVNLMSPSGINQMNHPTSDMVGKDLGSRDDPYDVQNQNKHAFPPYGLPPNYTPPNVLYTPNKNVNNSTPIPIESQQPETIMHLSLKRWGRHMKFLTTI

SEQ ID NO: 134259 - protein, 127 aa, Glycine max
  Coding DNA Sequence Number=SeqID_42574
MDISFPTYLGKRMKWDTLATRAPCFNLPHTGDLRTSEFKSQGRPAYCYAIEEERDRGNRGILTSSSIGTRIPTRDFDKDDKDVHEGSFSEDQACLEESEWAQHTTTNLTLLKGDPRAEEDHAVMIIG

SEQ ID NO: 134260 - protein, 301 aa, Glycine max
  Coding DNA Sequence Number=SeqID_42575
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSTTTTIKPTTTTTTTTTTTVEPITTTAEPITTAETATTVETDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134261 - protein, 143 aa, Glycine max
  Coding DNA Sequence Number=SeqID_42576
MCPPPEKVNNKGDQKKSMTKHQRSTKCDPSYWDNSSVKHSASSFDQEIPTRIMPMLDQFHPCIHDSIENIVDVKADGMGEDLWSLVCNHFLKELVKWSDEYINILGGIDRFEELKRSLLVDRLSTICLFKRLLSITTSKFVMV

SEQ ID NO: 134262 - protein, 79 aa, Glycine max
  Coding DNA Sequence Number=SeqID_42577
MGKNLHAMIEMGKLDHLEERLKAIEGGEDYAFANLEELFLVPEHGHSQGTTCPKNHLKMYCRKMGVYAKDEELRIHFFQ

SEQ ID NO: 134263 - protein, 164 aa, Glycine max
  Coding DNA Sequence Number=SeqID_42578
MSFPSAVHVSSTFESGAPRMSLPSAVRQFSILHFYSETHECHCLALFMHLPPTSLEPHECHCLALFANSPFSTFYSETHECHCLASFMCPPLSSAEPLKKKEGVEMRVVITERAGRTKSVSYLCFPLISDERYLAPFVAQYVKSRGVPKIKRKQAYAIRKNSVM

SEQ ID NO: 134264 - protein, 24 aa, Glycine max
  Coding DNA Sequence Number=SeqID_42579
DMISKKMMPNFYVLGSRVEDWVLR

SEQ ID NO: 134265 - protein, 355 aa, Glycine max
  Coding DNA Sequence Number=SeqID_42580
MSPFLVRDFGAQNSKTIQRIHKAWETTLRKDQELRGIRNGIIGGYHKWLKVHIRGLDWLAKLKVVSEESFEAPEEDEEVQALKSELGKAKLAKEKFKLAATHVRKECARLREKNAITARALEQETKRARKEEYGRNKFRGALWGSNSELKLRREERDQSRAHSMVLKEELIACSRSKRSLSQRLCETETNMLAIIAKYQEELGLATAHEHRIADEYAQVYAEKEARGRVIDSLHQEATMWMDRFALTLNGSQELPRLLAKAKAMADTYSTPEEIHGLLGYWKNTITKRAARYPYRTRSKSRTMGDQEETQEQVKADMLALKEQMASMMEAMLSMKQLIEKNAATAAAVSSAAGIL

SEQ ID NO: 134266 - protein, 40 aa, Glycine max
  Coding DNA Sequence Number=SeqID_42581
MAFVDNWVVGKEEEWQSLHGFLPHPHPFHLPQFFSFVQAG

SEQ ID NO: 134267 - protein, 146 aa, Glycine max
  Coding DNA Sequence Number=SeqID_42582
AVVSLEKPPQKPYSEVDDPLYLMTLTIPELFLRPYQVTWDATVFGVFNPYFPLYIKHEDLYEITHGGQCLSISVLQPDNYLKGIINSVSQPTLLQASEARLTGASPKGGKCAESPPMFICGKRQKNRRKLVMKIILDSGVVFMFEE

SEQ ID NO: 134268 - protein, 136 aa, Glycine max
  Coding DNA Sequence Number=SeqID_42583
  Subcellular localization annotation: CTP_CleavageSite=52; ConfidenceScore=5.13e-01
MVVRIYFLWIWLTAILFSASCMRGNSLAEATCRRNNAERRRNFLQERTVQPSLEEAQSSESSSAFPELRESEVGASKAHIMAEDQPWRVTLEDYSSSTVPQFFTSIARPKVQAHNITYPHSLIKLIQGNLFHGLPN

SEQ ID NO: 134269 - protein, 124 aa, Glycine max
  Coding DNA Sequence Number=SeqID_42584
MFLQKAVASGGSNLARLGELGGKLLPYFPINRGRNEGERSSALLPRRFRNVSVGDFAKIFNRSSSFVIRSSSFFGFQPAKINSQSQARPQKITKKDFKVQCLRFSHQVKMDHFKVQRLKRPPSK

SEQ ID NO: 134270 - protein, 136 aa, Glycine max
  Coding DNA Sequence Number=SeqID_42585
  Gene Ontology: Mol. function=oxidoreductase activity; Biological process=aromatic compound metabolic process
  Homolog annotation: Hit_ID=O54177; Match level="QueryCoverage=94%, HitCoverage=32%, E-value=2e-23, Identity=47%"; Hit description =Putative oxidoreductase
  Pfam annotation: Domain name=Pyr_redox; Domain location=4-79; Score =3.6; E_value=0.0022; Accession=PF00070.18; Description=Pyridine nucleotide-disulphide oxidor
MKKQVLISGASFAGLTLAYWLNKYGYEVTVVEIGKGLRKGGSPIDVRGKALDVVQEMGILQKIKDREFIHTDEIVDAKGDTLSRFSINAMEEYLGDIEIHRSDLVELIFDIVPKNEVEFIFGNSIKTLVQHEDRVE

SEQ ID NO: 134271 - protein, 577 aa, Glycine max
  Coding DNA Sequence Number=SeqID_42586
  Gene Ontology: Mol. function=transferase activity, transferring glycosyl groups; Cellular component=cytoplasm; Biological process =nicotinate nucleotide biosynthetic process
  Homolog annotation: Hit_ID=A8GCJ6; Match level="QueryCoverage=40%, HitCoverage=57%, E-value=5e-89, Identity=68%"; Hit description =Nicotinate phosphoribosyltransferase
FGVEDVEAFILHRAHVEEIHRDDHKDIEVIFETETLFVPLHAGFERGHRPVRAVQVAAIDKNFQRHVTAGTSGKAVTQHIEIAGDQRKQVAGFRERILPFHPVTPILVLTARQLVTVGQQVRIASRVGDQGGGEARQHVRAIEIPGDMPEAFGFTLGAERLAGFIQPFQRGVFIRMDFINDGQGKVVRQLADDQCALLFAVVRPRIAIHRQRQQGQRFTVQTQFSLLRAKAFYLTDGGDARGRRIKIKRQVDIGDGVIRRPSLSGLRPGCHAQCVSCAKSLQFINNGTNDPRPVTCNYGVIAVITVLYSCVFMTLLIPGSAPRKRMLKRTMTGHASPILTTLLDTDAYKLHMQQAVYHRYYDVPVTAEFRCRSDEQLGQYADAIRTHITAMQSLALSDDEYRYLSSLPFFQQDYLDWLRQFRFDASQVEVRDDHGHLRIQIRGPWREVILWEVPLLALISEVVHRHRTPESGAEQSVAHLQQKLVHFREQVGDLDMSRFQLMDFGTRRRYSRAVQEAIVSTLKNEFPWLLGTSNYDLARRLQLNPVGTQAHEWFQAHQQISLGTGQQPARGAAIVAG

SEQ ID NO: 134272 - protein, 280 aa, Glycine max
  Coding DNA Sequence Number=SeqID_42587
  Gene Ontology: Mol. function=thioredoxin-disulfide reductase activity; Cellular component=cytoplasm; Biological process=removal of superoxide radicals
  Homolog annotation: Hit_ID=A1JME7; Match level="QueryCoverage=100%, HitCoverage=87%, E-value=1e-130, Identity=82%"; Hit description =Thioredoxin reductase precursor
  Pfam annotation: Domain name=DAO; Domain location=8-206; Score=-58.0; E_value=0.067; Accession=PF01266.15; Description=FAD dependent oxidoreductase
  Pfam annotation: Domain name=Pyr_redox; Domain location=148-244; Score=87.9; E_value=3.2e-23; Accession=PF00070.18; Description =Pyridine nucleotide-disulphide oxidor
  Pfam annotation: Domain name=Pyr_redox_2; Domain location=8-280; Score=143.0; E_value=8.6e-40; Accession=PF07992.5; Description =Pyridine nucleotide-disulphide oxidore
  Pfam module annotation: Pfam domain module=DAO::Pyr_redox::Pyr_redox _2; Domain location=8-206::148-244::8-280
MSTAKHSKLLILGSGPAGYTAAVYAARANLNPVLITGLEKGGQLTTTTEVENWPGDPHDLTGPALMERMQAHAEKFNTEIIFDHIHTVDLQNRPFRLTGDSGEYTADALIIATGASARYLGLPSEEAFKGKGVSACATCDGFFYRNQKVAVIGGGNTAVEEALYLANIASEVHLIHRRDSFRAEKILIDRLMEKVRNGNIVLHTDRTLDEVVGDQMGVTGVQLSSTKGEAPLSLEVAGLFVAIGHSPNTAIFDGQLDLENGYIKVQSGLQGNATQTSVPG

SEQ ID NO: 134273 - protein, 350 aa, Glycine max
  Coding DNA Sequence Number=SeqID_42588
  Gene Ontology: Mol. function=transporter activity; Cellular component= integral to membrane; Biological process=transport
  Homolog annotation: Hit_ID=A8GCG4; Match level="QueryCoverage=88%, HitCoverage=81%, E-value=1e-112, Identity=66%"; Hit description =Major facilitator superfamily MFS_1 precursor
  Pfam annotation: Domain name=MFS_1; Domain location=11-349; Score =35.5; E_value=2e-07; Accession=PF07690.7; Description=Major Facilitator Superfamily
  Pfam annotation: Domain name=Sugar_tr; Domain location=2-331; Score= -168.0; E_value=0.02; Accession=PF00083.15; Description=Sugar (and other) transporter
  Pfam annotation: Domain name=Voltage_CLC; Domain location=54-318; Score=-173.5; E_value=0.024; Accession=PF00654.11; Description =Voltage gated chloride channel
  Pfam module annotation: Pfam domain module=MFS_1::Sugar_tr::Voltage _CLC; Domain location=11-349::2-331::54-318
MSTWSRPVLLLLCGLMLMTVSIAVLNTLVPHPRSTADLAGGMAKLRCLYTGNLLGTLLAGWLINRYGFNRCFYLASVLFALATMGMVLLDGFYSWTLLRFTAGVGCALIWVVVESALLCSGTVRNRGQLLAAYMIIYYLGTVAGQLLVSRVSTELLHVIPWVSALIVCAVLPVVFVQVNAGAATEEASTGRIWSMLRRRSSRLGINGCIISGIVLGSLYGLMPLYLSHQGMSDATVGYWMALLVSAGIVGQWPVGRLADRFGRLMVLRVQVFVVILGAIAMLSGTAMAPALFVLGLAGFTLYPVAMSWACAAVQLYRWQSGRAGDDRDADAELFRSPAVCDDCGGGAGLS

SEQ ID NO: 134274 - protein, 427 aa, Glycine max
  Coding DNA Sequence Number=SeqID_42589
  Gene Ontology: Mol. function=methyltransferase activity; Cellular component=cytoplasm; Biological process=metabolic process
  Homolog annotation: Hit_ID=A7MEU6; Match level="QueryCoverage=58%, HitCoverage=96%, E-value=3e-81, Identity=57%"; Hit description =Putative uncharacterized protein
  Pfam annotation: Domain name=CheR; Domain location=26-165; Score= -101.1; E_value=0.095; Accession=PF01739.9; Description=CheR methyltransferase, SAM binding domain
  Pfam annotation: Domain name=KicB; Domain location=244-427; Score =119.5; E_value=1e-32; Accession=PF03882.5; Description=KicB killing factor
  Pfam annotation: Domain name=MTS; Domain location=31-181; Score= -88.4; E_value=0.038; Accession=PF05175.5; Description=Methyltransfera se small domain
  Pfam annotation: Domain name=Methyltransf_11; Domain location=49-147; Score=67.9; E_value=3.4e-17; Accession=PF08241.3; Description =Methyltransferase domain
  Pfam annotation: Domain name=Methyltransf_12; Domain location=49-145; Score=71.3; E_value=3.3e-18; Accession=PF08242.3; Description =Methyltransferase domain
  Pfam annotation: Domain name=Rsm22; Domain location=12-273; Score= -146.4; E_value=0.017; Accession=PF09243.1; Description=Mitochondrial small ribosomal subunit
  Pfam annotation: Domain name=Ubie_methyltran; Domain location=15-216; Score=-140.6; E_value=0.028; Accession=PF01209.9; Description =ubiECOQ5 methyltransferase family
  Pfam module annotation: Pfam domain module=CheR::KicB::MTS::Methyltran sf_11::Methyltransf_12::Rsm22::Ubie_methyltran; Domain location=26 -165::244-427::31-181::49-147::49-145::12-273::15-216
MQDRNFDDLAEKFSQNIYGTRKGQVRQAIIWDELNAILPTLPAGPLTVLDAGGGVGQISSGLAAQGHQVLLCDLSGEMLKLAAAHAHSAGVSHNMQFKQISAQQVGEHLDKPVDLVLFHAVLEWVADPLAVLQALWHTLKPGGVLSLMFYNAHGLTFRTLTLGNFGYLRANMNKRKKRTLSPDFPRDPDDVQRWLTQCGFITEQRAGIRVFSDYMKPQPGAGKSVEEIIEMERRYCRQEPFLSLGRYIHTVPELVAWARKNDFSLALPVERLAFLLAIATLNGERMDGEMSEGELIDAFRHVSKAFEQTHETVQVRANNAINDMVRQRLLNRFTSELTEGHAIYRLTPLAIGITDYYIRQREFSTLRLSMQLSIVAQELKRAADAAEEDGDEFHWHRNVFAPLKYSVAEIFDSIDMTQRLMDEQQQA

SEQ ID NO: 134275 - protein, 939 aa, Glycine max
  Coding DNA Sequence Number=SeqID_42590
  Gene Ontology: Mol. function=nucleotide binding; Cellular component =cytoplasm; Biological process=mitotic chromosome condensation
  Homolog annotation: Hit_ID=Q1CA55; Match level="QueryCoverage=60%, HitCoverage=40%, E-value=0.0, Identity=78%"; Hit description =Chromosome partition protein mukB
  Pfam annotation: Domain name=PG_binding_1; Domain location=849-913; Score=15.8; E_value=0.0039; Accession=PF01471.9; Description =Putative peptidoglycan binding domain
  Pfam annotation: Domain name=PG_binding_3; Domain location=884-939; Score=-6.0; E_value=0.027; Accession=PF09374.1; Description =Predicted Peptidoglycan domain
  Pfam module annotation: Pfam domain module=PG_binding_1::PG_binding _3; Domain location=849-913::884-939
AKEGVAQLNRMLPCVNLLLTTRWPTAVKRFSDLQQHEQLTCDYQQAQQQQREARQQAFALTEVVQRRAHFSYEDLAGMMTGNSDLNEKLRQRLEQAEGECSRARERLREHQAQLTQYSQVLASLKSSYDAKRDMLKELQQEMQDIGVHADASAEERARCRRDELYTALSHNRARRNQLEKQLTFCEAEMDSLQKKLRKLERDYHLMREQVVSAKAGWCTVLRLVKENGVERRLHRRELAYLSGDELRSMSDKALGALRLAVADNEHLRDVLRMSEDPKRPERKIQFFIAVYQHLRERIRQDIIRTDDPVEAIEQMEIELNRLTEELTAREQTLAISSRSAANIIRKTIQREQNRIRQLNQGLQAVSFGQVRSVRLNVNVRETHAMLLDTLSEEHEQHQDLFTSNRLTFSEALAKLYQRLNPQIDMGQRTAQTIGEELLDYRNYLEMEVEVNRGSDGWLRAESGALSTGEAIGTGMSILVMVVQSWEEESRRLRGKDISPCRLLFLDEAARLDARSIATLFELCERLEMQLVIAAPENISPEKGTTYKLVRKVFNNTEHVHVVGLRGFLRRSDAGETGKSRRRRGCCVFGKKGAGMLLNKKSRVNRAAIALSLSLMAAPLVISQAADVGALPHSTLSVAASQQQIQQAFSPSERPFYLPGLAGIYAARNMAPLWQDRDAVQAFQQQLAEVALSGVQPQFTRWVELLTNPDIKGFARDVVLSDAMLGYLQFVANVPTQGETWLYSNVPYKLTMPSLSAINQWQNAVNGGGSRAFVVSLQPQHPQYAPMHSALKALLTDNRPWPQLRDKGTLRPVRSSDDVPALREILQRTEDADRHAQRDAHASRRCRPDGAAAGESERSAVAASGNISTVTPAASNNVYDNTLVEGVKRFQHWQGLADDGAIGPRTREWLNVSPQMRAALLALNIQRLRLLPDDMHNGIM

SEQ ID NO: 134276 - protein, 299 aa, Glycine max
  Coding DNA Sequence Number=SeqID_42591
  Homolog annotation: Hit_ID=Q6Z8F0; Match level="QueryCoverage=21%, HitCoverage=58%, E-value=4e-21, Identity=79%"; Hit description =Putative uncharacterized protein P0459B01.18
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSRGGQHTPRAATLLHVALGKRCVTPRQACPRPNGFGRNLRSKTRWFTGFCNSHQVSHFATFFIDARAEISVAESHCM

SEQ ID NO: 134277 - protein, 102 aa, Glycine max
  Coding DNA Sequence Number=SeqID_42592
MWTTTAISREREVPKKLTLFFFTPPPIYSKIGEQLATQLAQASKVASSRSNSLLEEGSGRPKWARLLFFLKKLRKLTNCAKTPLFDFRHITEFHGSRKPASF

SEQ ID NO: 134278 - protein, 204 aa, Glycine max
  Coding DNA Sequence Number=SeqID_42593
  Gene Ontology: Biological process=transposition, DNA-mediated
  Homolog annotation: Hit_ID=Q1J7G7; Match level="QueryCoverage=20%, HitCoverage=71%, E-value=5e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIQNGVDHLGDVLPFVVGGYDNYAVALHIKLIDTVDLEGGPVGKPVVPAALMNRPTRGERRFAYWALAECILAYYVGTDE

SEQ ID NO: 134279 - protein, 92 aa, Glycine max
  Coding DNA Sequence Number=SeqID_42594
  Gene Ontology: Mol. function=oxidoreductase activity, acting on CH-OH group of donors; Cellular component=peripheral to membrane of membrane fraction; Biological process=lactate metabolic process
  Homolog annotation: Hit_ID=A8GBH8; Match level="QueryCoverage=56%, HitCoverage=9%, E-value=4e-18, Identity=80%"; Hit description=D -lactate dehydrogenase
  Pfam annotation: Domain name=Lact-deh-memb; Domain location=1-61; Score=-185.3; E_value=0.00044; Accession=PF09330.2; Description=D -lactate dehydrogenase, membrane bind
MPCAEEKMLAILAARGAEYPAEHNVGHLYAAKPQLQAFYRQLDPTNTFNPGIGKTTCKVGIDAAPESTLTFHKRVGSAFMPTPNSPSRSTGV

SEQ ID NO: 134280 - protein, 122 aa, Glycine max
  Coding DNA Sequence Number=SeqID_42595
GAEDDVSLCLLAGFLSYRQQKVYTDSHSGIIVRQRDSKVSMTDLVSAEDDAFRLTDNKKFIRITTRYFRPSAAQKTTISLCVLSGFSCYRQQKGYTDNHSDISASQRDSKVSMTDLVTAEDD

SEQ ID NO: 134281 - protein, 137 aa, Glycine max
  Coding DNA Sequence Number=SeqID_42596
MTSRDQVWSFCTLVSSRGGGPDDTQRYLTVIRTLLSSRGGGPDDKQRPRLVILHPCIIQRRRGPMIRGDTLRVIRTLLSSRGGGPDDKQRPSLVILHPLYHPEAAGPMIRGDTLRLSRTLPEGQLGHPFIIQRRRAR

SEQ ID NO: 134282 - protein, 287 aa, Glycine max
  Coding DNA Sequence Number=SeqID_42597
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSIKKALADVNAVKGTQSIGELTKAFTTSHTLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134283 - protein, 123 aa, Glycine max
  Coding DNA Sequence Number=SeqID_42598
  Subcellular localization annotation: CTP_CleavageSite=50; ConfidenceScore=5.08e-01
MRNRQQLFTFYTVQQLHTRSFTNPQFLKIGLTHKNSPQWSRQLSQRALLRASEGEAHGCAFPKEERCAESPPTFICGKRRKNRRKPVKMKILSSGVVFTFEEGRQKRGFCSYVPSIEEEIRPT

SEQ ID NO: 134284 - protein, 150 aa, Glycine max
  Coding DNA Sequence Number=SeqID_42599
  Homolog annotation: Hit_ID=Q6UUU1; Match level="QueryCoverage=67%, HitCoverage=90%, E-value=7e-20, Identity=47%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKDYKDTKAFPPGGSLVRLSCSLPFGLPGVIPLLMGRVCLIPRLTLSS

SEQ ID NO: 134285 - protein, 98 aa, Glycine max
  Coding DNA Sequence Number=SeqID_42600
  Homolog annotation: Hit_ID=Q6UUU1; Match level="QueryCoverage=81%, HitCoverage=54%, E-value=8e-31, Identity=81%"; Hit description =Putative uncharacterized protein
MAYERGGDFLEDARKILNREVRGPRQNRFSIGSAPLTSITKSDAHISGGETRQDYKDTRRFPLAAPSCALLFLPFGLPESFRCYGRVCLIPRLTLSSR

SEQ ID NO: 134286 - protein, 194 aa, Glycine max
  Coding DNA Sequence Number=SeqID_42601
  Gene Ontology: Mol. function=gluconate transmembrane transporter activity; Cellular component=integral to membrane; Biological process=gluconate transport
  Homolog annotation: Hit_ID=P08555; Match level="QueryCoverage=100%, HitCoverage=43%, E-value=3e-62, Identity=65%"; Hit description=DsdX permease
  Pfam annotation: Domain name=GntP_permease; Domain location=1-193; Score=3.9; E_value=6.5e-15; Accession=PF02447.7; Description=GntP family permease
MAKEGSLYTLLEFIGNPITAMFIAVFVAYYLLGIRQHMSMGAMLTHTEHGFGSIANILLIIGAGGAFNAILKTSGLADSLAHILSNLHMHPILLAWLVALVLHAAVGSATVAMMGATAIVAPMLPLYPNVSPEIITIAIGSGAIGCTIVTDSLFWLVKQYCGATLNETFKYYTTATFIASVLALGGTFLLSFII

SEQ ID NO: 134287 - protein, 162 aa, Glycine max
  Coding DNA Sequence Number=SeqID_42602
MTTAEALERKTKKAQKEEWSRNKFRWALWGSSNELKLRKAERDKSRMESMVLEDKLKSCQRSKRSLTEQLSKIEENMLIIIYQYKEKIEKEAREGVIELLHKEAMKWMNRFALTLNESQELPRLLARAKAVADTYSAPDELHGLFDYCQHMVELMTYIIRNR

SEQ ID NO: 134288 - protein, 194 aa, Glycine max
  Coding DNA Sequence Number=SeqID_42603
ASCMRGNSSAGYLAPLDLEIEATCRRNNAERRRKTLQERTVQPSVEGTHSSESFPANLRESKVGASEFHIMVDEQPQRVTLEDYSSSTVPQFFTSIVQPESKKLLDAFFGGKIKLKTPEEAMELIENMVASDHAILHDRTHVPTKRSLLELSSQDALLAQNKQLAKQLELLIDTLSKLPTQLQAAQPSHSVVMQ

SEQ ID NO: 134289 - protein, 74 aa, Glycine max
  Coding DNA Sequence Number=SeqID_42604
MTRGNPGDLQPFDLEIDRAFHRLVRHSVHPCLSVHFEHSEHSVEGDSEYSDFEHSTTNFHTKNMAQPLPRESDS

SEQ ID NO: 134290 - protein, 183 aa, Glycine max
  Coding DNA Sequence Number=SeqID_42605
  Gene Ontology: Biological process=transposition, DNA-mediated
  Homolog annotation: Hit_ID=Q1J7G7; Match level="QueryCoverage=22%, HitCoverage=71%, E-value=8e-12, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLAKASPQSHDGVMGIVYGLGTLFRGARYQLLFPLVRVNFELGVIMVIAVSFGKPVVPAALMNRPTRGERRFAYWALAECILAYYVGTDEGVSEVLHVAGEKRLH

SEQ ID NO: 134291 - protein, 69 aa, Glycine max
  Coding DNA Sequence Number=SeqID_42606
MAYLFLSAVPPVQLLTGIVIRSQFGKSIHAGHQSEKKGCTGSAEYVNTTHYSASSLTDSYARSSCGERN

SEQ ID NO: 134292 - protein, 43 aa, Glycine max
  Coding DNA Sequence Number=SeqID_42607
MGGTGAVEEERASVSGAAEVVGTSDLLPLAFLGPLNGSSSPGI

SEQ ID NO: 134293 - protein, 117 aa, Glycine max
  Coding DNA Sequence Number=SeqID_42608
  Homolog annotation: Hit_ID=A0ST23; Match level="QueryCoverage=23%, HitCoverage=55%, E-value=2e-08, Identity=100%"; Hit description =Putative reverse transcriptase
RVPFAIQAAQLLGRAIGAGLFAITPAGERGMCCKAIKLGNARVFPVTTLIKLIDTVDLEGGPVGKPVVPAALMNRPTRGERRFAYWALAECILAYYVGTDEGVSEVLHVAGEKRLHR

SEQ ID NO: 134294 - protein, 72 aa, Glycine max
  Coding DNA Sequence Number=SeqID_42609
MAGTLFLLKQQNSLEVMSRRGRDPNRDVLDRITAVLETLVQERDVEPAEYRGLMAFRKNTGKVQWRLSIRKC

SEQ ID NO: 134295 - protein, 135 aa, Glycine max
  Coding DNA Sequence Number=SeqID_42610
  Subcellular localization annotation: CTP_CleavageSite=57; ConfidenceScore=5.68e-01
MVKVGTSYVPINVSFSPKVGPGLPGAPVASVSISCSSCSTTDGVGRKRQKHRRTSALASVAVTLRVTTTPAALNAPLQGASHSPFRLRNCWEGRSVRASSLLRQLAKGGCAARRLSWVTPVFSQSRRCKTTASEL

SEQ ID NO: 134296 - protein, 260 aa, Glycine max
  Coding DNA Sequence Number=SeqID_42611
MRGAPAEESLSLFLVRDFGGLDWLSKLKIINEENFEVPEEDEEVRALKTELGKARLAKEKFKLVATHIRKECAELREENAATARALERETKRACKEEHGRDKFRGALWGSNNELKLRRGERDQSRAHSMVLKEELAACSRSKRSLSQRLCETETNMLPIVSKYQEELNLATAHEHKVADEYARVYTEKEARGRVIESLHQDATMWMDRFALTLNGSQELPRLLGKAKVMADTYSAPEEIHGLLSYCQHMIDLMGHIIRNH

SEQ ID NO: 134297 - protein, 37 aa, Glycine max
  Coding DNA Sequence Number=SeqID_42612
MNRGARGRVRMDARPVINRSLSRVWLRTIKKCYWEAA

SEQ ID NO: 134298 - protein, 132 aa, Glycine max
  Coding DNA Sequence Number=SeqID_42613
  Homolog annotation: Hit_ID=Q6WAY6; Match level="QueryCoverage=65%, HitCoverage=15%, E-value=3e-07, Identity=34%"; Hit description =Putative uncharacterized protein
MGTRGCINYNPILAIRQLGYPMRGASSEESITPFIARGFSDPNARIFQGVRKAWCAVQRKDKEIKGSSNGIIDGYHKWLNARTQGLDWLLKLKVLREEEAETPEESEEVQALKAELERAQAVKEKFKTMTIK

SEQ ID NO: 134299 - protein, 121 aa, Glycine max
  Coding DNA Sequence Number=SeqID_42614
MAAIYAQIRSTSKISQYHTQKPLRHFTKHLGQCDMPIHLRIQNRPTAIPYSPPTQPIKHEFTHNSSHAICKKQATKALKYYNGKPKIKGKWHLLVGSEQKCRKMEAKMQKACLRLLNSKIP

SEQ ID NO: 134300 - protein, 310 aa, Glycine max
  Coding DNA Sequence Number=SeqID_42615
  Homolog annotation: Hit_ID=Q6WAY4; Match level="QueryCoverage=90%, HitCoverage=48%, E-value=3e-29, Identity=32%"; Hit description =Putative uncharacterized protein
MGTNQIGKRFYQVKIKGLDVTSLKELGQLMGQLQRQAFRKAYGKIWDLAMVEVSTEAVVSLTQYYDQPLRCFTFGDFQIVSTVEEFEEILGCPLGGRKPYLFSGFLPSLSKIAVVVRDSARELDCVKQTQNGVVGLPRKYLEGKVSDTANQEEWVPFGDVLALLIFGVVLFPNVDGLVDLAAIDAFLSYHHSKESPVVAILADLFDTLDRRCEKNSARIVCCLPALCVWLVSHLFQHDIRHPCPLQSYRSCVKKRGVDWDQYLAGIGGRTINWFPRWKEGKEGVLFSCEDYPNIPLIGMRVVLTTILHLL

SEQ ID NO: 134301 - protein, 104 aa, Glycine max
  Coding DNA Sequence Number=SeqID_42616
MASIIEAMLGIRQLMENNVATTAAVSSAAEADPTLPATAHHPLPNTVGRERSTLGHTNNIHLGYNRVTYPYGLPPNYTPPVMRDEAGHVPSPVLEGEPPRQSDE

SEQ ID NO: 134302 - protein, 132 aa, Glycine max
  Coding DNA Sequence Number=SeqID_42617
  Subcellular localization annotation: CTP_CleavageSite=43; ConfidenceScore=5.63e-01
MGVFPFLLCNLSAMPGANFLAMGSSSDSTSSRSMRSPGAERTSAFGVEDDGTSLSASGTEAFFKMLFTRLQIFLSISVSSSLGLEKARVVPGFDGVLEDDGDDGTEGETGDEVSFGEVAMEKQSFWSGFVNI

SEQ ID NO: 134303 - protein, 107 aa, Glycine max
  Coding DNA Sequence Number=SeqID_42618
DKRYPLSKGRVSYTTVIRAAVGGPFESCGSLPLHEWGQSSGSGSRSVPGARLLFRRVFDNLAVVRSPLLEAGVLGRWGFLFLNQFGCVSPEIGWSNIYELAGQRWME

SEQ ID NO: 134304 - protein, 93 aa, Glycine max
  Coding DNA Sequence Number=SeqID_42619
MPHGLFPYKSHALMPLRHFTEHLVGARLGNNSKRTGTMWHSTKRRSKYTNEKLESSGMEHLLVGDEQKRKAESKKRKMMTLGLQTRQSRGYGF

SEQ ID NO: 134305 - protein, 100 aa, Glycine max
  Coding DNA Sequence Number=SeqID_42620
  Gene Ontology: Mol. function=hydrolase activity, hydrolyzing O -glycosyl compounds; Cellular component=vacuole; Biological process =carbohydrate metabolic process
  Homolog annotation: Hit_ID=A7Q0C8; Match level="QueryCoverage=99%, HitCoverage=21%, E-value=1e-17, Identity=39%"; Hit description =Chromosome chr7 scaffold_42, whole genome shotgun sequence
MQHGLIGFNPFLLVFFLEQILLKMFMNPFTFGDYPDIMKKNAGSRLPSFTQKESNLVRGSIDFIGINFYYSFYVKNSPGSLQKEDRDYIADLSVEIESMS

SEQ ID NO: 134306 - protein, 167 aa, Glycine max
  Coding DNA Sequence Number=SeqID_42621
  Homolog annotation: Hit_ID=Q5NRP4; Match level="QueryCoverage=50%, HitCoverage=5%, E-value=6e-07, Identity=33%"; Hit description =Putative gag-pol polyprotein, identical
  Pfam annotation: Domain name=zf-CCHC; Domain location=147-164; Score =21.5; E_value=0.00084; Accession=PF00098.14; Description=Zinc knuckle
MSLHSSSSVNGEGSTPKDPLYKILDELRSLKLWKEKQERKEKGRHRSHLRPHSHRRENERKPQEVNIKITYFHGKDNVEANLDWEIRVEQQLKRKSTSKSYGSHSYPKKDQGQGILGVRPSKPKDDKGNTIEKKPLKASMQEKTSSMKCFKCLGRGHITSQCPTKKP

SEQ ID NO: 134307 - protein, 65 aa, Glycine max
  Coding DNA Sequence Number=SeqID_42622
LEVNTQERRSLEQIDQWLALENPDESLETSNNSFQNCPIAQWNAPGLPHDMHMLRSSHILRKMGV

SEQ ID NO: 134308 - protein, 76 aa, Glycine max
  Coding DNA Sequence Number=SeqID_42623
MTVEWRRKRERRRHFKEKMSLEEAHHHRRPWIRAWRKKEMNEGRGREEHEILCSKIDLKSEPTNPRSIPRFSTKCA

SEQ ID NO: 134309 - protein, 155 aa, Glycine max
  Coding DNA Sequence Number=SeqID_42624
  Gene Ontology: Mol. function=helicase activity; Biological process =viral genome replication
  Homolog annotation: Hit_ID=Q2A9E0; Match level="QueryCoverage=86%, HitCoverage=9%, E-value=3e-29, Identity=52%"; Hit description =Putative uncharacterized protein
MLDDHNVHAKSFRMVMDRLSDSQLDNLKLRLIAGREKDGRTYNLPNVYEVVALIVGDLDADSIRDIIVKTQNGELQRIHELHSSYLGLQYPLLFPYGEDGYRPDILHRSTSGSKKRKRNRLTMRDWFAYRLQSRVLASLNLKAIDRPNLVSRVFI

SEQ ID NO: 134310 - protein, 83 aa, Glycine max
  Coding DNA Sequence Number=SeqID_42625
  Gene Ontology: Mol. function=nucleic acid binding
  Homolog annotation: Hit_ID=A5AZ88; Match level="QueryCoverage=62%, HitCoverage=4%, E-value=5e-10, Identity=51%"; Hit description =Putative uncharacterized protein
MGVVEDVLVKVRQFTFPADFVIMDIEEDAEIPLILGCPFMLTANYVVDMGKEKHSLDRNICSKMDEVKNEMVLMARAKLAPDP

SEQ ID NO: 134311 - protein, 201 aa, Glycine max
  Coding DNA Sequence Number=SeqID_42626
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP6; Match level="QueryCoverage=73%, HitCoverage=30%, E-value=1e-74, Identity=97%"; Hit description=ATP synthase subunit beta
  Pfam annotation: Domain name=ATP-synt_DE; Domain location=153-200; Score=63.3; E_value=8e-16; Accession=PF00401.11; Description=ATP synthase, DeltaEpsilon chain, long alpha-helix domain
  Pfam annotation: Domain name=ATP-synt_ab_C; Domain location=53-165; Score=157.5; E_value=3.6e-44; Accession=PF00306.18; Description=ATP synthase alphabeta chain, C terminal domain
  Pfam module annotation: Pfam domain module=ATP-synt_DE::ATP-synt_ab _C; Domain location=153-200::53-165
DLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVVNDAEKGSDIDPQEAQQTLEIAEANLNKAEGKRQTIEANLALRRARTRVEAINVIS

SEQ ID NO: 134312 - protein, 131 aa, Glycine max
  Coding DNA Sequence Number=SeqID_42627
MTEKKMMTMIVDTLPVFYYEKMVGYTPSSFDDMVFTEERIKVGLKRGKSDHHALINAKKKKTRANEEGENVGEAYAVTAIPIQPSFPPTQQCHYSANKPTFSLPTAQLSTKAIPKSTTKYVYRTSNDEHHL

SEQ ID NO: 134313 - protein, 151 aa, Glycine max
  Coding DNA Sequence Number=SeqID_42628
WRNHPGNQFNKDQGGPSNRPQQQGPSLYDRTTKLEETLAQFMQVSMSNHKSTESAIKNLEVQVGQLAKQLVDRPSSSFSANTKKNSKEECKAVMARSRMAIQANEGRAEEKVEGYKQQSAIEPALEPVFDFVKLEEVVEDEDDQQERERHQ

SEQ ID NO: 134314 - protein, 168 aa, Glycine max
  Coding DNA Sequence Number=SeqID_42629
MGPSVATEEVEAPEEDEEVQALRTKLEQAQTVKERFKLAALKIRKENAKLRDINVATTKALEQETKRARREEHGWNKFRGALWGSNSELKLRREERDQSRVDSLILKDELKTCSRYKRSLSPRLCETETNMLAIITKYQEELNLATAHEHRVADEYAQVYAENQARGK

SEQ ID NO: 134315 - protein, 121 aa, Glycine max
  Coding DNA Sequence Number=SeqID_42630
  Gene Ontology: Mol. function=endonuclease activity
  Homolog annotation: Hit_ID=Q9AY32; Match level="QueryCoverage=27%, HitCoverage=50%, E-value=2e-09, Identity=93%"; Hit description=RRNA intron-encoded homing endonuclease
QSKSLNEDPLEGKSGASSRVKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSL

SEQ ID NO: 134316 - protein, 52 aa, Glycine max
  Coding DNA Sequence Number=SeqID_42631
MSVKNLIGRLGVHGKTNHTLASQVTLTRLKGALKPGDHQGLHSEKFVRASAS

SEQ ID NO: 134317 - protein, 197 aa, Glycine max
  Coding DNA Sequence Number=SeqID_42632
YIMNSIITVLYFNGRVYEDNDGVIFEGSKKAIQIKRGISFNALKKKLEIRFLVSGKYVALQICDDEDVETMIESFQQQQQMSVLELYVEKDVAGDDDDDDYLASNSYVEESFDEDDSDDGISDTDDEVTDIVEPVSIIHPTEGVPQIQNPFWNDAMHYNNINWSHPDEEDICGLDMPTTFNVGQELYVGMDFDSKDA

SEQ ID NO: 134318 - protein, 226 aa, Glycine max
  Coding DNA Sequence Number=SeqID_42633
MGNPVEQPDLPQEQPTVEVQQNVSVEEIPSCARTSPAPETDTVNVEEQGEGQGIRSSSPHGSSQKSSSEENFSDEEAIQEAEAGGSDIYPASSTSKLSASVGIAEETFIKMQDEDPAAALRLLLNTSQAHTSSEKIPGASSSSDAEINSSVRQDCLLLKLSMEYARADVLKSIEENPSAAFGHLNFLKKLHNPLTSDEILGKVIQSSPLSINLQALCRKSAKMTPD

SEQ ID NO: 134319 - protein, 144 aa, Glycine max
  Coding DNA Sequence Number=SeqID_42634
MKDKRDDEEKLEKQKKKKDSKALSSKAKGKEKEENDSSKKIVKKENHFATKGIIRHQIPMIGGMMNFLSGATLFCKITHAPNIFMICVHRDSLGRNNQHENKEKGIFYSITFLNFLNSDQGLPMDPKRIKVLRKESMSFKNLWI

SEQ ID NO: 134320 - protein, 56 aa, Glycine max
  Coding DNA Sequence Number=SeqID_42635
MATSRFLTAPRAFGSGPSMSIPHMEGSSDCGVCQEGHLSRGVINPLLNSLPSRMMQ

SEQ ID NO: 134321 - protein, 136 aa, Glycine max
  Coding DNA Sequence Number=SeqID_42636
NYTDNHSGISARQRDSKVSMTELVSVEDDIAKKNYTDNHSGISARQRDSKVSMTELVSAEDDVNLRVSTGLSAAIDEGLFVLQIAKKNYTDNHSGIFACQRDSKVSMTELVKVADKSEALAPTYPPMRNSDLRSSG

SEQ ID NO: 134322 - protein, 99 aa, Glycine max
  Coding DNA Sequence Number=SeqID_42637
  Subcellular localization annotation: CTP_CleavageSite=46; ConfidenceScore=5.41e-01
MVASFSNSSNVVGSMTLLHIALKTKHRRVMATQTLSGKIPQIATAYANNDKNSSSRLLTLCDMLEVDMFGNLVRLDATALVYPFRPSPDEISNHPMFCL

SEQ ID NO: 134323 - protein, 179 aa, Glycine max
  Coding DNA Sequence Number=SeqID_42638
  Homolog annotation: Hit_ID=UPI000065F7CF; Match level="QueryCoverage =70%, HitCoverage=15%, E-value=7e-07, Identity=33%"; Hit description =Homolog of Homo sapiens "Leucine-rich repeats and IQ motif containing 1
MDPWVLVTLTFRGLHVLTLRGLHALAIRGLHVLTFIGLHALTFRGLHVLANRGLHALTLRGLHVLALRGLHVLTIRGLHSLTSRGLHVLTLRGLPALALDTSYPHLQRTTRPHLQRATRPRHQRTACPHLRRATRPHLQRTTRPRLQRITRPRHQRTTCPPFSKGDRPSPLEDCMSSPS

SEQ ID NO: 134324 - protein, 100 aa, Glycine max
  Coding DNA Sequence Number=SeqID_42639
MRKQHTSYASGALKYLHDLRTKDPMMYVSCTADEGSRLQRLFWCDAERQLLYESSSNPLEIFHSLCKNPFTKSESHRDNPSLVFKNPYNLRDPRSLNQSL

SEQ ID NO: 134325 - protein, 72 aa, Glycine max
  Coding DNA Sequence Number=SeqID_42640
  Subcellular localization annotation: CTP_CleavageSite=11; ConfidenceScore=5.07e-01
MWSSAPFPEMSASSDGDFSSLTSYPELRRSEFLIGGYVGARASLLSTTPPFVVMTQELVARGDTLRSYPRIQ

SEQ ID NO: 134326 - protein, 274 aa, Glycine max
  Coding DNA Sequence Number=SeqID_42641
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDKIFDIKHAKTTPSDMHLMVMIHIRYIAPMTTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134327 - protein, 225 aa, Glycine max
  Coding DNA Sequence Number=SeqID_42642
  Homolog annotation: Hit_ID=Q6WAY6; Match level="QueryCoverage=90%, HitCoverage=40%, E-value=4e-21, Identity=32%"; Hit description =Putative uncharacterized protein
MVEEFEEILGCLLGGRKPYLFSGFYLSLARIYKIVQILAQELDHRKQVENGVVEVPRKCLEAKARILAGKGEWAPFIDILTLLIFGGVLFPNVDGLVDLAAINTFLPFHDRKESSVVAILADLYDTFDRRFEKSSTRIVCCTPALYVCWFPRWKEGRTGVLISCGGFPNVSLMGTRGCISYNLVLAIRQLGYPMRGAPLEEDLAPIIARGFNNTNVETLQKVRKA

SEQ ID NO: 134328 - protein, 110 aa, Glycine max
  Coding DNA Sequence Number=SeqID_42643
DRAHKTPSGPEEVQQGLGVASYDYGPLSVLWSACCPPAKSSSPLLIEFSSRSTVPLGRRKARHHNSLEMDDNGQQTHHHHLQSPSAHPQKVRSLPTTHGRPIGNQVQSQR

SEQ ID NO: 134329 - protein, 227 aa, Glycine max
  Coding DNA Sequence Number=SeqID_42644
MRGAPLEEELVPVITRGFNKTNVEALQKVPKAWEVVQKKDKELRGSNNGPIGGYRKWLKAHVQGLDWLPSLRTAKGEEVEAPEEDEEVQALRAELEQTQTVKERLKSASLKIQKENAKLRDINIATTKALEQETKRAHREEHGRNKFRGALWGSNSELKLRREERDQSQVDSLILKDELKVFLRSKRSLSQRLCETKTNMLAIVSKYQEELNLATAHEHKVADEYAR

SEQ ID NO: 134330 - protein, 87 aa, Glycine max
  Coding DNA Sequence Number=SeqID_42645
MTRGNPGDLQSFDPEIDRTFHRLVRHSVNPDHSVHFEHCEHCEHSVEGDSEYFDFEHSTTNFHTKNMAQTPPCGRTLREMAAPDFTY

SEQ ID NO: 134331 - protein, 43 aa, Glycine max
  Coding DNA Sequence Number=SeqID_42646
GSKMMQSYPLRALDRRLQEDWAIDAREGPRVLISLRVDFGTMG

SEQ ID NO: 134332 - protein, 266 aa, Glycine max
  Coding DNA Sequence Number=SeqID_42647
MARFDPEVVLEFYANAWPTEEGVRDMHSWVRGQWIPFDADALSQFLGDPLVLEEGQECEFSQRRNRADGFDLEAIAQLLCTPRQDFARTAAGRRVRIMRTSMTTLTQTWMTLLLSNVLPSDHNFDLPLPQCMPPTRHPLDPDKSNRALGFLALITGLCQSFGVPVTPSKVIRPPITRAFIEKYCTPRQTHGDAPQDAGAPPPPHQADPTGSLGMEHYLQHLVRQQAANHRGQVQIHECLYRFSLSQQGQGFGPFVCPTDRGRTRIK

SEQ ID NO: 134333 - protein, 96 aa, Glycine max
  Coding DNA Sequence Number=SeqID_42648
  Subcellular localization annotation: CTP_CleavageSite=41; ConfidenceScore=5.39e-01
MACSGVISGKARGARTPLPWPLPGSGAGCLRVNRNGRWHSCSSAVSTQRDVLGNPVERLSILKPHQSTQKCAADAVGGQPLGQLVGLPPRGGKRPP

SEQ ID NO: 134334 - protein, 77 aa, Glycine max
  Coding DNA Sequence Number=SeqID_42649
MPMGWTSQKSGANTEDEEPTNLRSNPLQGGEDDAILLRKGPVTKAMSKRLQEDWARATEEDPWVLMNLRIDFSAHGP

SEQ ID NO: 134335 - protein, 206 aa, Glycine max
  Coding DNA Sequence Number=SeqID_42650
  Homolog annotation: Hit_ID=A5B5G7; Match level="QueryCoverage=99%, HitCoverage=14%, E-value=2e-10, Identity=26%"; Hit description =Putative uncharacterized protein
MASKKRKAPSTPTQARFDRSRFTSQEARERYTDIVVPRKLLPERNVVVYYTEFDEFKEELERRHWDEKMTDFSDSSIYIAIVKEFYANLYDPEDKSPKQVRVRGHLVKFDEDTLNTFLKTPVVLEEGENLCTYSKFALLRPDPQKLATKLFIPGRGFKLNADGQPLKILMKNMTILAQTWSVLSFSNLIPTSHTSDVTLDRAKLIY

SEQ ID NO: 134336 - protein, 178 aa, Glycine max
  Coding DNA Sequence Number=SeqID_42651
MGAKYLKAVKQSLHAIKQWSPDKIRGNIPKWIPFEKRSTTTKITVLPQYAGKPTIKSSERSSQGRYGTNVTFVKNKVLCNREVKMDGRRIQNSAALMSVFGLVVQLTLVIGGDHEVVMKQKLGGERLTKEGNGVALLRQNRAHPYPNASVSSVNGLLKSGRARINAMDRTSFRRSKAT

SEQ ID NO: 134337 - protein, 538 aa, Glycine max
  Coding DNA Sequence Number=SeqID_42652
  Homolog annotation: Hit_ID=A5B5G7; Match level="QueryCoverage=37%, HitCoverage=14%, E-value=2e-09, Identity=25%"; Hit description =Putative uncharacterized protein
MSASSVDEEDNLVVTATFLVPRDPLSVTSAKRALCAKPECHSIKAKLSAACCAKPEAWDRYNDIVVPRKLLPERNVVVYHTEFDEFKEELERRKWDEELTSFDEGSIDVVIVKEFYANLYDPDDKSPKQVQVRGHLIKFDEDTLNTFLKTPMIIEEGETLSTYSRFSLLRPDPQELVVKLCIPRRGFELNVDGQPLKILRKNMTTLAQTWSVLSYSNLVPTSHTSDITLDRAKLIYGIIMKMDMNLGYLISHQISIIAQHDSSRLGFPSLITTLYDPTVTFRGPRKARGKRFEAPPTSTAPDASAPSSSTLPDPSAPFTSTPHLPQDVSLHNVEPSQRAGVQPSPSGGGGASAAQEPDSAEPVEEHTEEQVAKEPVLADDELTPLEPFSFAANTSMAQKEETSPDPMLEPSHAPPSISEDAPISEDTMPSAPAMEPEQPILQDVPAAPVLDLNEDQPQDEQDVFVNDLNEQMYEVSGLECMDFVLIKLEPLEEKEHESGRVQESRPHVKCVINSLSARVVLSQAQYMTGAKLKTTYSR

SEQ ID NO: 134338 - protein, 268 aa, Glycine max
  Coding DNA Sequence Number=SeqID_42653
  Gene Ontology: Mol. function=oxidoreductase activity; Cellular component=integral to membrane; Biological process=electron transport
  Homolog annotation: Hit_ID=Q5ENY4; Match level="QueryCoverage=51%, HitCoverage=23%, E-value=8e-25, Identity=41%"; Hit description =Respiratory burst oxidase 1
  Pfam annotation: Domain name=FAD_binding_8; Domain location=76-167; Score=4.3; E_value=0.00069; Accession=PF08022.3; Description=FAD -binding domain
MASTILLVTFLAFLMQVVKSTSSWNLFSEINHQVIGFFVKSWEGVTRIIMVFLMAIAFTLATPRFTLPKIIITWMYLAIPIMIYLSERLTRALRSSIKPVRILKILERHPFSITFAPGDDYLSVHIRTLGDWTWSLKVKFSEVNSGSYCCDILKFLPGILETWGTGTREAACKSRQDFSIQKKFQKLFLSSHVAFLLPSSPPLLSIEAPKFLLISTLNCKEKPFSESWSTPLHCGASNFKYGWTSSHMKFVGVGYLGDMMGNSTRLLP

SEQ ID NO: 134339 - protein, 483 aa, Glycine max
  Coding DNA Sequence Number=SeqID_42654
  Gene Ontology: Mol. function=binding; Cellular component=nucleus; Biological process=apoptosis
  Homolog annotation: Hit_ID=A7QNU3; Match level="QueryCoverage=48%, HitCoverage=79%, E-value=2e-65, Identity=71%"; Hit description =Chromosome undetermined scaffold_134, whole genome shotgun sequence
  Pfam annotation: Domain name=DUF1716; Domain location=108-212; Score =177.1; E_value=4.6e-50; Accession=PF08216.2; Description=Eukaryotic domain of unknown function (DU
MSYWLKPIVEVDWHQGWEWKERRELHGCPTWYEHAVKTSIFEMSGSCLAKVAVNGVGLEASTLLTVVAVTDLKDLSTMSLVNLTGYNKNVLAELSERANPRHEAKVVDVDLSLLEAIEKSQSAVEALDLRALKKHVLSFERRLKENIEARLKYPNQPDRFADSEVELHEELQKLKVLASAPEFYPDLVSLNVVPSIVDLLNHDNTDIAIDVVQLLQDLTNEDVLDDNDDSARVLVDALVENSALELLVQNLHRLNDSDPDKNAAVYGTLATVDNMLRRFLAIFHGSYSHLNILCFPSLDIQRVKAETKQLDQVEPDDLEIDEDEKYNCKLESGLYTLQGCKPPNTYDPPKGCKPPNSYDLPKVCKPPSSYDPPKVCKPPNSYDPPKGCKPPNSYDSPKGCMVRRCESKGHDPWEQSQPTIMIRSRGARSGDANQGNDPWKQSQPFRIIVSIRCSINISKPEWERHLGIRKNLNCGETDSRKLV

SEQ ID NO: 134340 - protein, 171 aa, Glycine max
  Coding DNA Sequence Number=SeqID_42655
  Gene Ontology: Mol. function=zinc ion binding
  Homolog annotation: Hit_ID=A5BEV8; Match level="QueryCoverage=77%, HitCoverage=24%, E-value=2e-13, Identity=27%"; Hit description =Putative uncharacterized protein
MARKKDLVRTNTDSRKCKLRGKLVVGSQGWMVKLMCESHNHEMENSLVGHPYVGRLTKDKQIIIANMTKSMGEHLNNVVWDLERFRGLFLRRDVLPEVIVADKDLALMNAVKIVFPKCTNLLCQFHIDKNVKAKCKSPIWIIPHREKFVKAWTNTVMYLGNTTTNRIEFAH

SEQ ID NO: 134341 - protein, 111 aa, Glycine max
  Coding DNA Sequence Number=SeqID_42656
MESICDGQMKQRCHIIEASLRVPAEPNSDLSRLFPCGVTVTYLPSLEVASLSVNNLVSNVLPRAGAGGSGGDEYHQLDGAQRMLLDAMNAQMQHLLDCNVTTRLVATISTL

SEQ ID NO: 134342 - protein, 113 aa, Glycine max
  Coding DNA Sequence Number=SeqID_42657
MVDTISTENVEMEIESTIEVVDWVDHENHDTRTLIFGVDNHLHTDNEIFVVRDKNHHWWKPVSFLNLMEEVRVSFNEEMKSSRDHWRKRRASPERLDKLIKMRFLNEAPIFIG

SEQ ID NO: 134343 - protein, 78 aa, Glycine max
  Coding DNA Sequence Number=SeqID_42658
  Homolog annotation: Hit_ID=Q1RU49; Match level="QueryCoverage=100%, HitCoverage=64%, E-value=4e-20, Identity=60%"; Hit description =Putative polyprotein, related
MTNDSSKMTSKFAKLDKFEGQDFKRWQKKMSFLLTTLKVVYVLSTPMSVFMEDETLDQTRKRSKWENDDYICRRHILN

SEQ ID NO: 134344 - protein, 91 aa, Glycine max
  Coding DNA Sequence Number=SeqID_42659
MLSIFFLSQDDNVETYQCKETTKENTQQIYDGNNNEDHPSFLESKFETNQQIGTLIDEAPGDTTNSMSSSTCEDPPPPQSEWYPPYTSLFH

SEQ ID NO: 134345 - protein, 33 aa, Glycine max
  Coding DNA Sequence Number=SeqID_42660
MKKILGLQASMELTSRLTLLDIPGGRNRVVKEF

SEQ ID NO: 134346 - protein, 143 aa, Glycine max
  Coding DNA Sequence Number=SeqID_42661
  Gene Ontology: Mol. function=kinase activity
  Homolog annotation: Hit_ID=A7P8S6; Match level="QueryCoverage=68%, HitCoverage=26%, E-value=2e-19, Identity=50%"; Hit description =Chromosome chr3 scaffold_8, whole genome shotgun sequence
MWRNWRFCKFILKDEEGRLTGVSTSNLLIANSRNDLPLLAYDASSLTCFFLVLFNGFHVIDLTRVSQELAYLANDVDLVMLEGMVKHPEVAEFLGSCLYDCITKYDEALIQFIDAETTSSVRDALDGRSIPRQIPASSPWRFL

SEQ ID NO: 134347 - protein, 53 aa, Glycine max
  Coding DNA Sequence Number=SeqID_42662
  Homolog annotation: Hit_ID=A5C3N0; Match level="QueryCoverage=73%, HitCoverage=7%, E-value=7e-12, Identity=84%"; Hit description =Putative uncharacterized protein
MDPSSSTSSHNSDLDWPIALRKGKKTVGCRWVYTIKVGPNGGVDRLKARLVAK

SEQ ID NO: 134348 - protein, 224 aa, Glycine max
  Coding DNA Sequence Number=SeqID_42663
  Gene Ontology: Mol. function=nucleotide binding; Cellular component =plasma membrane; Biological process=small GTPase mediated signal transduction
  Homolog annotation: Hit_ID=Q40209; Match level="QueryCoverage=100%, HitCoverage=100%, E-value=1e-102, Identity=86%"; Hit description =RAB5A
  Pfam annotation: Domain name=Arf; Domain location=1-195; Score=-90.1; E_value=0.011; Accession=PF00025.12; Description=ADP-ribosylation factor family
  Pfam annotation: Domain name=GTP_EFTU; Domain location=6-197; Score= -82.8; E_value=0.052; Accession=PF00009.18; Description=Elongation factor Tu GTP binding domain
  Pfam annotation: Domain name=Miro; Domain location=12-150; Score =44.4; E_value=3.9e-10; Accession=PF08477.4; Description=Miro-like protein
  Pfam annotation: Domain name=Ras; Domain location=12-197; Score =278.0; E_value=1.9e-80; Accession=PF00071.13; Description=Ras family
  Pfam module annotation: Pfam domain module=Arf::GTP_EFTU::Miro::Ras; Domain location=1-195::6-197::12-150::12-197
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSLSWDMEKIAACLYWLLGLKIMMGMDSFTRAKKWVQELQKQGNPNMVMALAGNKADLEDKRKVTAEEARVYAEENGLFFMETSAKTASNVNDIFYEIAKRLPRAQPAQNPAGMVLVDRPAEGTRAASCCS

SEQ ID NO: 134349 - protein, 115 aa, Glycine max
  Coding DNA Sequence Number=SeqID_42664
MILRYWQLETSTKCAHIYPLTSLQEQIGEIEENVMLPTFAEGRSKKLRFGKRGSVVVVITTWLWQSLVITTWLWKKFILRRIRRRRGPRGLEGVIVGGEAAVHGVGNHSNVGKEN

SEQ ID NO: 134350 - protein, 192 aa, Glycine max
  Coding DNA Sequence Number=SeqID_42665
  Gene Ontology: Cellular component=extracellular region; Biological process=cellulose and pectin-containing cell wall organization and biogenesis
  Homolog annotation: Hit_ID=Q9M9P0; Match level="QueryCoverage=69%, HitCoverage=48%, E-value=2e-49, Identity=69%"; Hit description =Expansin-A13 precursor
  Pfam annotation: Domain name=DPBB_1; Domain location=83-177; Score =96.0; E_value=1.2e-25; Accession=PF03330.9; Description=Rare lipoprotein A (RlpA)-like double-psi be
  Subcellular localization annotation: CTP_CleavageSite=33; ConfidenceScore=5.23e-01
MSQQTLTLTILLFTLLSLTSSPATCLYSSPSPPAASFSETTPDPEPRAEEWLPAQATHYAATDAVGGACGYGDLLNGGYGMATAALSEALFGRGQICGACFELRCREEDSDFDRRWCISGTTVAVTATNFCAPNYGSDAESVGGHCNPPKQHFVVPIEAFEKMAIWKTGTGNMPVEYRRFSFTHSWCYHIVI

SEQ ID NO: 134351 - protein, 128 aa, Glycine max
  Coding DNA Sequence Number=SeqID_42666
  Subcellular localization annotation: CTP_CleavageSite=62; ConfidenceScore=5.15e-01
MRVQLHSRRGRTALLRNSLTSLFKIVSSFMVLGHPTETSRNLLSESTTLELIGERAPTEQVRSSNRRRRGATVLRWRDPEAAGDGGAGDFVCEAREGENGGESGGNRLRDAAERGYSSFLDYNRKQKV

SEQ ID NO: 134352 - protein, 176 aa, Glycine max
  Coding DNA Sequence Number=SeqID_42667
MWLGCNLSHCNLSHCLSVEHSSIQGCLPKTNRRAFNVGCFIVEAKLHDESRLIQRCYDDNKDDDKKLKGQSKNEFKMFKIESRTLQDSRGKLKNTLRFKRKVDFKNQESRFKDQASKNQDQDSRLKIQESREDLIKISMKRFFQKLSSTWIFLKTCLPKSFYSLVINYQIIVIDYQ

SEQ ID NO: 134353 - protein, 418 aa, Glycine max
  Coding DNA Sequence Number=SeqID_42668
  Gene Ontology: Mol. function=RNA-directed DNA polymerase activity; Biological process=RNA-dependent DNA replication
  Homolog annotation: Hit_ID=A7PTP4; Match level="QueryCoverage=88%, HitCoverage=92%, E-value=1e-113, Identity=55%"; Hit description =Chromosome undetermined scaffold_30, whole genome shotgun sequence
MRWVVVEQSKRYLIQLMDSAPSSSWLQAFSFLALVWLFNCGCVHGASPAVKVGNFSKVEDAGNFHIYYGQTFKVIKNSADGQSYLLLQPTQFSSINSGRIIQGLHQGLNIAHQESNHLSFHCQTILLIQLFFRLLGLVESLKGITSDYVASPCVLKLYQGGQLEMFNNSDYQKLAEFSSYFLSDTDQQPACNFATFVPFMEDTPLQRAEWIKFMGAFANVEARANQVYTAVKVNYLCLAKVATTRTTFKPTVAWMRYKNEKYQLKYVQDAGGEILGANKNTYNVSDPDDLEEFHAILCTAEVVIDETLTSDPVNYTMSAFIQNLNVEDRSCFSFISNTSLWRYDKRVYNSVALDWYNGAVSQPQLALADLIEVLFPTGNYTMTYFRNIAKGEVPINIGPEMCDRDTSTAMEPTIVACG

SEQ ID NO: 134354 - protein, 203 aa, Glycine max
  Coding DNA Sequence Number=SeqID_42669
MACHIDEDMTKSKGKDPLEGLGGPKTRARARKAKEALQQVLSILFEYKPKFQGVKSKGPIGNLGISLLGDQMVADLLAVGGLILDDPKSALVPCGFISHIQDLVNVNAKHVRVVKNPLDFFYKASDLKTNETSHFGMIDGLPKALFINNLVMLRFNYKMLITLKDLQNCGNCNWDKVWLFVGVYPTSSSSLPEGYSDLESSPA

SEQ ID NO: 134355 - protein, 153 aa, Glycine max
  Coding DNA Sequence Number=SeqID_42670
  Gene Ontology: Mol. function=glutamate decarboxylase activity; Cellular component=cytoplasm; Biological process=carboxylic acid metabolic process
  Homolog annotation: Hit_ID=A8C8H3; Match level="QueryCoverage=92%, HitCoverage=28%, E-value=7e-76, Identity=99%"; Hit description =Glutamate decarboxylase
  Pfam annotation: Domain name=Pyridoxal_deC; Domain location=1-149; Score=-101.4; E_value=1.6e-08; Accession=PF00282.10; Description =Pyridoxal-dependent decarboxylase conse
MQNRCVNMIAHLFNAPLEETEAAVGVGTVGSSEAIMLAGLAFKRKWQNRRKQEGKPFDKPNIVTGANVQVCWEKFARYFEVELKEVKLRDDYYVMDPEKAVELVDENTICVAAILGSTLNGEFEDVKRLNDLLIEKNKITGCVSAFLPLAPFT

SEQ ID NO: 134356 - protein, 130 aa, Glycine max
  Coding DNA Sequence Number=SeqID_42671
MVGYTPSSFADLVFVDERIKVGLEKGKSDHPALMNVKTGANEEDENEGETLAMTAIPTRSNFPSAQQCHYSANNSPSHPIIHKSHPQISHKACLLTTCPGFLNLHFSEDTTRTQHVHIMEEFRDIPLSTV

SEQ ID NO: 134357 - protein, 83 aa, Glycine max
  Coding DNA Sequence Number=SeqID_42672
MNVENLSGLHHHPHPHPPPPPPPPPPPQDMMCGTGLIKWSVIDEGTNQHHWNGIGSAPNILSLIAQAIPYSPPYILVNLTTNK

SEQ ID NO: 134358 - protein, 233 aa, Glycine max
  Coding DNA Sequence Number=SeqID_42673
  Subcellular localization annotation: CTP_CleavageSite=35; ConfidenceScore=5.22e-01
MAIANAPMYIAVTKAKKRARNPPAAAKDISSDMTMAFMVAARKKSINTSNDEERAEGSAAASPEENVAGGVFGSFGKERSVVGDGEFDPAKFREENGGGDAVKDLRQGFFHSLRFLLQLYYFLFFFIDVDAVAVGSLCHFQLQEAEKKPKKRRCKKLLMNSLSEANWLSKPHPLSEAASWLSGWETLEEDKSEICMLNAQQACPARTLSLLALSAPKLTKRIFTYPGSARHAR

SEQ ID NO: 134359 - protein, 374 aa, Glycine max
  Coding DNA Sequence Number=SeqID_42674
  Gene Ontology: Mol. function=oxidoreductase activity, acting on NADH or NADPH; Cellular component=mitochondrial respiratory chain; Biological process=ATP synthesis coupled electron transport
  Homolog annotation: Hit_ID=Q9FGI6; Match level="QueryCoverage=36%, HitCoverage=18%, E-value=3e-45, Identity=69%"; Hit description=NADH -ubiquinone oxidoreductase 75 kDa subunit, mitochondrial precursor
  Pfam annotation: Domain name=Fer2; Domain location=300-364; Score =53.6; E_value=6.8e-13; Accession=PF00111.18; Description=2Fe-2S iron- sulfur cluster binding domain
MVGAFLQNSATLTGLPMILLSKSNLTYSFCDECDNSLPACCLCLDPVMILNFVFKGADDYVNCFKEPCAEGLEGVTGLEGDEEVGVSLRVDEGVVDLCTDDESVLLDARDASAQAVGEDVNSANDFEDAELGGKGHQGRAEGLVDLMLQRQRLLGLLEGKRVKDDGDGFHEGAGVCAWRMRSPSLWDGEVGGVMYWTRSQSSRVKEVSLRCKYACEEGVIAGLKTMISLREAIRPTSRLLLGSQNPTTFLLRTIVSKPELRNPEASAAQPEQPPAPDLPPRTPLAGARVHFSNPEDAIEVFVDGYPVKIPKGMTVLQACEVAGVDIPRFCYHSRLSIAGNCRMCLVEVEKSPKPVASCAMPALPGQPLQFPDFG

SEQ ID NO: 134360 - protein, 66 aa, Glycine max
  Coding DNA Sequence Number=SeqID_42675
MKDFRSQHKDKGLGIGEEGNTVDARGVARVSVKNGMDKENEEGGWKNRSSRIGVTHKVVFLDKPIS

SEQ ID NO: 134361 - protein, 486 aa, Glycine max
  Coding DNA Sequence Number=SeqID_42676
  Gene Ontology: Mol. function=aspartic-type endopeptidase activity; Cellular component=endoplasmic reticulum; Biological process =proteolysis
  Homolog annotation: Hit_ID=Q8L8L6; Match level="QueryCoverage=74%, HitCoverage=83%, E-value=1e-159, Identity=74%"; Hit description =Putative uncharacterized protein
  Pfam annotation: Domain name=Asp; Domain location=96-455; Score= -136.8; E_value=1.6e-05; Accession=PF00026.14; Description=Eukaryotic aspartyl protease
  Subcellular localization annotation: CTP_CleavageSite=58; ConfidenceScore=5.83e-01
MPPSSLFSNMHFLFFFLLSSIHLSVQLNHTTTTTNNSTSLFSLSFPLTSLSLSTNTALKMMLRNSLIANTNNNNTQLKSPPSSPYNYKLSFKYSMALIVDLPIGTPPQVQPMVLDTGSQLSWIQCHKKAPAKPPPTASFDPSLSSTFSTLPCTHPVCKPRIPDFTLPTSCDQNRLCHYSYFYADGTYAEGNLVREKFTFSRSLFTPPLILGCATESTDPRGILGMNRGRLSFASQSKITKFSYCVPTRVTRPGYTPTGSFYLGHNPNSNTFRYIEMLTFARSQRMPNLDPLAYTVALQGIRIGGRKLNISPAVFRADAGGSGQTMLDSGSEFTYLVNEAYDKVRAEVVRAVGPRMKKGYVYGGVADMCFDGNAIEIGRLIGDMVFEFEKGVQIVVPKERVLATVEGGVHCIGIANSDKLGAASNIIGNFHQQNLWVEFDLAYDHDDVVEIQRSKSEEEKESSTTVAMMTPTAFGRCVKAHKLYLVH

SEQ ID NO: 134362 - protein, 476 aa, Glycine max
  Coding DNA Sequence Number=SeqID_42677
  Gene Ontology: Mol. function=protein binding
  Homolog annotation: Hit_ID=A9PFT7; Match level="QueryCoverage=71%, HitCoverage=64%, E-value=2e-42, Identity=33%"; Hit description =Putative uncharacterized protein
QQQSLIPLGEVGYMNHTAKDQLADVFTKSLWEPSIMVGVAVHNLGQFYLGQRKLEEARVSYESECHCSLVTYFSLCCFSEVGIFAQMRILFYNNCVQVLYLQGKERDAEALIKDSIRMLEGWYFLDTVIAAESLALTLQASGNTKDSKELLERCLNVRKDLLPSDHIQIGANLLHLARVAMLDCSQHKKLDVSRAKAELDMAKNHLYNSIREKPGRTINYLTAVSHYAFNLLGPASKGRPSSTGHIGQSPSPDCYTPLMHLQSLYTLSSVELDKQELQEIQERDNINIEAQEALLQCISTYKENSDHIDLVVHHKGRFNKDDMTHWNMWTVSSVFGRIMKDDSGVPDKVVVNQTEDEVQDIDVDLDKEIERIVNQIQNQDEIDCSQFASTAEQPPTVSMVDSGGQPKPITVQTSLLPQEPNFVSVQPTPTFRPLLTRPTAPIRIPFLAGPSPRMIKPNFMSFILRPGMPQRENKKK

SEQ ID NO: 134363 - protein, 82 aa, Glycine max
  Coding DNA Sequence Number=SeqID_42678
TSTTTQKLRDKWTEEDRRRIQYDLKAKNIITSALGIDEYFRVTNCTNTKEIYLAPFVAQYVKSRDVPKIKRKQAYAIRENFM

SEQ ID NO: 134364 - protein, 29 aa, Glycine max
  Coding DNA Sequence Number=SeqID_42679
MGFQTLPYFNFPNTTNMLFGASSKGVVGE

SEQ ID NO: 134365 - protein, 170 aa, Glycine max
  Coding DNA Sequence Number=SeqID_42680
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-25, Identity=32%"; Hit description= UPI00006A17C9 related cluster
  Subcellular localization annotation: CTP_CleavageSite=74; ConfidenceScore=5.43e-01
VRTCGPLKARTCSPLKVRACSHLKARTCSPLKARACSPLKARVCSPLKARACSPLKARTCSPLKARTCSPLKVRACSPMKARACNPLKERAYSPLKARTCSPLKARMCSPLKARTCSPLKARACSPLKARTCNPLKVRMCSPLKARTCNPLKVRTCSPLKARACNPLKAI

SEQ ID NO: 134366 - protein, 114 aa, Glycine max
  Coding DNA Sequence Number=SeqID_42681
MKRKSLKSPYSRISLLGHYGYVGGKDKGRLELSVEDQKISFDLFEAMKHSDIGDACFEKRIGGEGNGTVSLNHACDEELDDSKDSCVDQVVFEELEKLRPTEKPKAELKTFPAH

SEQ ID NO: 134367 - protein, 121 aa, Glycine max
  Coding DNA Sequence Number=SeqID_42682
MYIKYGPKYIMKHSQQNKLSNETKTPHTYSQNNSKAPKFLKDMVSFKTRKGKQGSKGLSKELIQGKSIWLEAYKNKIASIISKYACELGSINKNQAKAIVQAINGANTPNDYDDGWLKFSQ

SEQ ID NO: 134368 - protein, 132 aa, Glycine max
  Coding DNA Sequence Number=SeqID_42683
  Gene Ontology: Mol. function=helicase activity; Biological process =viral genome replication
  Homolog annotation: Hit_ID=Q2A9E0; Match level="QueryCoverage=99%, HitCoverage=8%, E-value=3e-28, Identity=48%"; Hit description =Putative uncharacterized protein
MIESQKLNYVRQHQQELRVDKYMNLNACNNDPETHGNEKGKRIIPPSSFVGCRRYMEQLYFDGMEICGHIGFPDLFLTLTCNPAWQKIQRKVRKCNLRHDDCPDVVSRISKMKLSHLMNDLKSGHAFGPIVG

SEQ ID NO: 134369 - protein, 50 aa, Glycine max
  Coding DNA Sequence Number=SeqID_42684
MNLNSSPNDSNILDSSRRTNLSTQLPIGRARSEPLAMYSNPICQTMMKAV

SEQ ID NO: 134370 - protein, 66 aa, Glycine max
  Coding DNA Sequence Number=SeqID_42685
MEVDGGWLGLLQRALRGRAKARLTGALSKGGKMRGVATNVYLWKTSEKPKETGQNENSKFRSCIYA

SEQ ID NO: 134371 - protein, 219 aa, Glycine max
  Coding DNA Sequence Number=SeqID_42686
GCINYNPALAIRQLGYTMRGAPTEESLSPFLVRDFGLDWLSKLKIIDEENFEAPEEDEETFGKSVLGYKKKMQLPQEPLNKKPRGLARKSMVVTNFVELCGAATMSSSFEGKERDQSRAHSMVLKDELAACLKSKRSLSQRLCETETNMLAIVSKYQEELNLATAHEHKVVDKYAQVYTEKEARGRVIDALHQEATMWMDRFALTLNGSRELPRLLAKA

SEQ ID NO: 134372 - protein, 320 aa, Glycine max
  Coding DNA Sequence Number=SeqID_42687
MAKFDPEVVLEFYANAWPTEEGVRDVRSWVRGQWIPFDADALSQFLGDLLVLEEGQQCEFSQRRNRADGFDEEAIAQLLCTLGQDFTRTAARRRVRIMHTSMTTLTQTWMTLLLSNVLPSDQNSDLPLAKCQLVYAILTRMSVHVAQVIVDAIYLFAGMPPTKHPLDPDKSSRALGFPALITGLCQSFGVPVTPTKVIRPPITKAFIEKYCTPRQAQGDAPQAADAPPPPHQADPAGSLGMERYLYTWFASRRPTTGGRCRYMSVSTGSASVNRGRVSLLLHALLHSSLGLRSHGPEINPRPRQGRSPQDPLVRQRGSYG

SEQ ID NO: 134373 - protein, 258 aa, Glycine max
  Coding DNA Sequence Number=SeqID_42688
MASRKRKSIGRHILPERKVKIYHSELDEFKAELERRNFHKRLTNLVDGSIDLALVKEFYVNLYSSEDHPPKQSRVRGHLVKIDVDSLNTFLETPMVLAEGETLPAYSNTAGPSWEDSQEGSDYTSSGALISGQMTTIAQSNTSRLVFPTLIVALCRARGVVSDSLTFERLSPVINLAYIKKNCWNPKDLTVSIRGARRGEAPTPASTSAAPSVPAQTDSQHFAAMLQSIHQGHIILLQSLQVVAPPGSIPSTEQFREM

SEQ ID NO: 134374 - protein, 54 aa, Glycine max
  Coding DNA Sequence Number=SeqID_42689
SRAEVAWPRDWPEAWAGEAPAEGTQQRLPTRQMRPHEDEEMTDLLDFLGGSGAT

SEQ ID NO: 134375 - protein, 89 aa, Glycine max
  Coding DNA Sequence Number=SeqID_42690
MKDLDMGDSDKCWLYVEENPPHLVATGRLYEGSTTVHNIPLHHDQVKVDAEEVTDADAHILVPTEEAKEQWDWQNLQIGRIMMLMIPYI

SEQ ID NO: 134376 - protein, 71 aa, Glycine max
  Coding DNA Sequence Number=SeqID_42691
MSRQLQIENRSSEENPNDNNFLLGCPSESRNSIEMLLYENGSSEQILATITFSRMSDCLEYRDSRNSEQKL

SEQ ID NO: 134377 - protein, 126 aa, Glycine max
  Coding DNA Sequence Number=SeqID_42692
  Subcellular localization annotation: CTP_CleavageSite=56; ConfidenceScore=5.59e-01
MAFMFLSAVPPVVLKRGVLSAQIRHKAPAGTSALASVSRSNVTRNHHTRLIALPLQAAPFQSGTCRANCMRNARAIECGFALLPSGERADVYTALMLAVQGVPGSERAAAKPFFHRLRPPDKHHEI

SEQ ID NO: 134378 - protein, 73 aa, Glycine max
  Coding DNA Sequence Number=SeqID_42693
MMTKVMNKKLKRSKNNSSESRTSQEFKNQEEFKTQEERLQSRIKIQDSRSQESRSRFKTQDSRMKKGLHQDKY

SEQ ID NO: 134379 - protein, 114 aa, Glycine max
  Coding DNA Sequence Number=SeqID_42694
MSHLSSSVNGEGTSHKNTLSKILDELSSLKFWKEKLERKQKGKERVEINQDEREQISEEQRKNTLKELRKEKYVSYSSHDPCKSLSEELCDYYEGRHRSHLRPHSHKIEKERKP

SEQ ID NO: 134380 - protein, 133 aa, Glycine max
  Coding DNA Sequence Number=SeqID_42695
MKKAGVAAHDVQRYVKESDWAAQCTRQDKMSNEELKLQDPRCRIQCPGHPARKYWTHKSVISLTDCAGSTIHLDVTLTSSVGPECVELISIVQRAISGARVSGRQGEQKQKADVTRDVLTSWKRFATYQFRCA

SEQ ID NO: 134381 - protein, 108 aa, Glycine max
  Coding DNA Sequence Number=SeqID_42696
  Pfam annotation: Domain name=G-patch; Domain location=1-42; Score =27.8; E_value=4e-05; Accession=PF01585.14; Description=G-patch domain
MVARVMLGNGYEPGMGLGKDNGGITSLISAKGNHGKFGLGYKPTQAYIRKSIAERKSGSQGSRLRHEDEGSPPCHISRSFISAGLGDEAQVIAICEDDALSGSNLVRP

SEQ ID NO: 134382 - protein, 71 aa, Glycine max
  Coding DNA Sequence Number=SeqID_42697
IFAYHGCRMTKLGLCVPSDTTVSEWQRGADNRKVSPRIMGQYDKDCGAADKSKALAPTYPPMRNSDLRSSG

SEQ ID NO: 134383 - protein, 471 aa, Glycine max
  Coding DNA Sequence Number=SeqID_42698
  Homolog annotation: Hit_ID=Q2HW90; Match level="QueryCoverage=41%, HitCoverage=39%, E-value=1e-21, Identity=34%"; Hit description =Putative uncharacterized protein
MEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMANQGDWVPFMDVLALLIFGVVLFPNVDDLIDLAAIDAFLAYHHSKESPVVAVLADLFDTFDRRCEKSSARIICCLPALCVWLVSHLFQQDTRHPCPLLSHRSCTEKRRMDWDQLLAGIGGRTISWFPRWKEEDKEVQALKSELGKAKLAKEKFKLAATHVRKECAGLREENAITARALEQETKRARKEEYGRNKFRGALWGSNSELKLRREERDQSRAHAMVLKEELVACSRSKRSLSQRLCETETNMLAIIAKYQEELGLAPAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 134384 - protein, 373 aa, Glycine max
  Coding DNA Sequence Number=SeqID_42699
MQEEEERPLIRERKLPATSTKSAEQTEAGNFQAQMPKKKKKMKQVEPEPSVAVEGGEPIKKKKKKTKPSKEQGDNQPVDVQPPSTDIDGTEVEATPSIAEMGNPVDQPDSPQEQPAVEVQQNVSVEEIPSHARTSPAPETDAVNVEEQGEGQGIGSSSPHGSSQKSSSEENFFDEEAIKEAEAGGSDIYPASSTSKLSASIGIAEDTFIQMQDEDPAAALRLLLNTSQANTSSEKVPGASSSSDAEINSLKLHNPLTSDEILGKVIQIEAIIDQFASTVQKKRENSARLDAQKQAHILLLEKARAAQHEVERLTKEAKEGSSEIKACDDNISSWEATITNLLSQVDDLRQKIVTEQAKRKELQEKAANSIQKL

SEQ ID NO: 134385 - protein, 114 aa, Glycine max
  Coding DNA Sequence Number=SeqID_42700
MLPFDFRCVTETYGLCINIFLVFRHVLEFHKLPNDGCQAPHKDQRKVACHQAKGFASFSCPTPDQFRAEVAWPGDWPEAQAGEAPPEAPGDGEEAHEDEEMADLLDFLGGSGDT

SEQ ID NO: 134386 - protein, 182 aa, Glycine max
  Coding DNA Sequence Number=SeqID_42701
MEFFSNENFEYFQAFENSNLIPFMSLKLPVYSELVKTFNSNLEIHEGTLMSEVYGIKMVIDQSLFYDLTKLPSEGVPFEGALIDDWKFDFSVHDVRWLVCTNQADMTGRLLAGSLAFESRILHYLIVRILLPRSSNLAQEHDGSWIKKGARNVGEEGHEGEDSSLLSKILEKFDGLQTFVGE

SEQ ID NO: 134387 - protein, 172 aa, Glycine max
  Coding DNA Sequence Number=SeqID_42702
  Homolog annotation: Hit_ID=A5C995; Match level="QueryCoverage=63%, HitCoverage=6%, E-value=5e-13, Identity=39%"; Hit description =Putative uncharacterized protein
MTIDNPSDLQPFDPEIDRTFHRLVRHLVVPFEHPKHSVIGESEHFVVGNFEHPDFEHYSFEHFDFEHSENMAQPPPRERTLREMVAPDFTYESLCIQYPDEDVPYVLKTRLIHLLPKFHGLASEDPHKHLKEFHIVCSTMKPPDVQEDHIFLKAFPHSLEGVAKDWLYYLAP

SEQ ID NO: 134388 - protein, 31 aa, Glycine max
  Coding DNA Sequence Number=SeqID_42703
MKITSSPYRKQTSMSPPPFPPLQWYPLPNAI

SEQ ID NO: 134389 - protein, 146 aa, Glycine max
  Coding DNA Sequence Number=SeqID_42704
GVHALTSRGLHVLALRGLHALTLGTSYPHRQRTTRPHLERNTRPHHEGVPGEICKKDRIRGLHVLALRGLHVLTIRGLHALTSEDYIVLALRGLHALTLGTSYPHRQRTTRPRLERTTRPHHQRAARPYLQRTTCPRLERATRPHL

SEQ ID NO: 134390 - protein, 79 aa, Glycine max
  Coding DNA Sequence Number=SeqID_42705
MSRNFTDCLTMGVKYLEAVKRRLHATKQWSLDEIRGYCVLEFVDTKNQLADIFTKPLPKETFFSIRRELGLLDISDLDK

SEQ ID NO: 134391 - protein, 70 aa, Glycine max
  Coding DNA Sequence Number=SeqID_42706
MLQCEGIPNGENSHNLVANVALKFHDAPTVNESEIVIFLRQVRWPARKREGFGRREKKRNCEAEEAEESV

SEQ ID NO: 134392 - protein, 76 aa, Glycine max
  Coding DNA Sequence Number=SeqID_42707
MVGCTPSSFADLVFAGERIKVGLKREDENEGEILAMTAIPTWSNFPSAQQCHYSANISPSHYPPPSHPQRPSLNQP

SEQ ID NO: 134393 - protein, 304 aa, Glycine max
  Coding DNA Sequence Number=SeqID_42708
MRGVPTEESMSPFLVRDLGAQNSKTIQRIHKAWETPLRKDQELRGIRNGIIGGYHEWLKVRIRGLDWLAKLKVVSKENFEAPEEDKEVQALKGELGKAKLAKEKFKLAATHVRKECAELREENAITARALEQETKRARKEEYGRNKFRGALWGSNSELKLRREERDQSRARSMVLKEELIACSRSKRSLSQRLCETETNMLAIIAKYQEELGLATAHEHRIVDEYAQVYAEKEARGRVIDSLHQEATMWMDRFALTLNGSQELPRLLAKAKAMANTYSTPEEIHGLLGYCQHMIDLMAHIIRNR

SEQ ID NO: 134394 - protein, 242 aa, Glycine max
  Coding DNA Sequence Number=SeqID_42709
  Gene Ontology: Mol. function=motor activity; Cellular component=cell projection
  Homolog annotation: Hit_ID=UPI00016621D1; Match level="QueryCoverage =89%, HitCoverage=40%, E-value=2e-22, Identity=35%"; Hit description =UPI00016621D1 related cluster
MTSPLNESISCFLINVDPWVLEPIAFRGLHVLAFKGLHALTFRGLHALAFRGLHVLAFRGLHVLAFRGLHVLTFRGLHALTIRGLHVLAFVGLQALTFRGLHVLTFKGLHALNFRGLHALAFRGLHVLAFRRLHVLTFRGQHVLAFRGLRVLAFRRLHTLTFRGLHALTFKGLHVLTIRGLHALAFRRLHVLAVRELHVLAFKGRHVLDFRGLHALAFRGLHVLIFSGLHIRTLREFKVLCL

SEQ ID NO: 134395 - protein, 71 aa, Glycine max
  Coding DNA Sequence Number=SeqID_42710
MALRVLGFLDRLRRIRPSKVGMIPPPRILSVAGKIAAQKGKGLCGGQQRSINHRVWRQVQIFYSWPIGLPG

SEQ ID NO: 134396 - protein, 109 aa, Glycine max
  Coding DNA Sequence Number=SeqID_42711
MCMIRLRLLAFNEYGSGVIDILTGSVCHIGWCIVGRQAIWWEARWGRRVHLATTLVAETATALASIIFFMLIMASIIVAICSFMASMSAFICSCTSSTSPITLALAWVR

SEQ ID NO: 134397 - protein, 97 aa, Glycine max
  Coding DNA Sequence Number=SeqID_42712
  Gene Ontology: Biological process=transposition, DNA-mediated
  Homolog annotation: Hit_ID=Q1J7G7; Match level="QueryCoverage=40%, HitCoverage=55%, E-value=2e-15, Identity=97%"; Hit description =Transposase
MVKVGTSYVPINVSFSPKVGPGLPGIYSAQSASGDACQLTDLVYDGVFEVLQWLLFLSAVPPVQLLTGWCVTAKAPPDISAGKCSGHAARNHHTRRA

SEQ ID NO: 134398 - protein, 215 aa, Glycine max
  Coding DNA Sequence Number=SeqID_42713
ALKTELKKAQTVKEKFKSAAVRIRKENAKLRDVNIATTIALEQETKRAHREEHGWNKFRGALWGSNSELKLRREERDQSRVDGLILKDELKTCLRSKRSLSQQLCETETNMLAIISKYQEELNLATAHEHKVADEYARVYAEKEARGRVIYSLHQEAMMWMDRFALTLNGSKKLPQLLAKAKAMEDAYSAPEEIHGLLSYCQHMIDLMAHIIRSR

SEQ ID NO: 134399 - protein, 249 aa, Glycine max
  Coding DNA Sequence Number=SeqID_42714
  Homolog annotation: Hit_ID=Q6WAY6; Match level="QueryCoverage=36%, HitCoverage=19%, E-value=7e-12, Identity=37%"; Hit description =Putative uncharacterized protein
LLAGIGGRTISWFPRWKEGKEGVLFSSGGYPNIPLVGTRGCINYNPALAIRQLGYPMRGAPTEESMSPFLAWETPLRKDQELIGIRNGIIGGYHEWLKVHIRGLDWLAKLKVVSEESFEAPEEDEEVQALKSELGKAKLAKEKFKLATTHIRKECAGLREENAITARALEQETKKARKEEYGRNKFRGALWGSNSELKLRREERDQSRAHSMVLKEELVACSRSKRSLSQRLCETETNMLAIIASTKKS

SEQ ID NO: 134400 - protein, 73 aa, Glycine max
  Coding DNA Sequence Number=SeqID_42715
MVIFHHGDATEDKGDEKKELHHQESALDKKLREDASMEEKKEIEKERGGITKLKEEKRNNLVKKSSLKKKDYL

SEQ ID NO: 134401 - protein, 67 aa, Glycine max
  Coding DNA Sequence Number=SeqID_42716
MATIALSSRYGSKLAYDTGIWGESYRLFAAKFISWLVFFLEWQSQHGVSPSFSPSSFAPVFSVVLVG

SEQ ID NO: 134402 - protein, 314 aa, Glycine max
  Coding DNA Sequence Number=SeqID_42717
  Homolog annotation: Hit_ID=A5B5G7; Match level="QueryCoverage=68%, HitCoverage=15%, E-value=3e-08, Identity=25%"; Hit description =Putative uncharacterized protein
MASKKRKSSASSASQIRFDRSRFHSQEAWDMYNDIIIPRMLLPERNVVIYHTEFDEFKEELDRRRWDEELTSFKEGNIDVAIVKEFYANLYDPEDKSPKQVRVRCHLIKFDEEALNTFLKTPMIIKEGETLSAYSRFALLRPDPQELAAKLCIPGRGFELNADGQPLNILRKNMTTLAQTWSVLSYSNLVPNSHTSDITLDRVKLIYGIIMNMDMNLGYLISHQISIIAQHDSSRLGFPALITTLCKVSDMNGSRIEKEEREMRRHFKEKMSLEEAHHHRRPWIRAWRKKEMNEGRGREEHKILCSKRALKSKV

SEQ ID NO: 134403 - protein, 172 aa, Glycine max
  Coding DNA Sequence Number=SeqID_42718
  Gene Ontology: Mol. function=RNA-directed DNA polymerase activity; Biological process=RNA-dependent DNA replication
  Homolog annotation: Hit_ID=A2Q500; Match level="QueryCoverage=59%, HitCoverage=13%, E-value=9e-12, Identity=36%"; Hit description =Endonuclease/exonuclease/phosphatase
MNCPWLLIGDFNSILSPTDRFNGAEPNAYELQDFVDCYSDLGLGSINTHGPLYMWTNGRVWSKLDRALCNQAWFNSFGNSTCEVMKFISISDHTPLVVTTELMAGSKIFMAVACSWSEFSNISNRVELVEAEYNSVLNSLKQNPQDPSLLALANRTRGQTIILRKAESMKFA

SEQ ID NO: 134404 - protein, 201 aa, Glycine max
  Coding DNA Sequence Number=SeqID_42719
  Subcellular localization annotation: CTP_CleavageSite=6; ConfidenceScore=5.28e-01
MNSLPSAVHASSTIECGAPRIDCLALFANSPFSTFIRSPMNLLPSAVHASSTFESGAPRIDCLAKFANSPFSTFIRSPMNSLPSAVHVSSTFESGAPRIDCLALFASSAFSTFIRSPMNLLPSAVHVSSTFESGAPRIDRLALFANSPFSTFIRSPMNILPSAIHASSTNESGAPRIDCLAKFANSPFSTFIRSPMNSFLA

SEQ ID NO: 134405 - protein, 53 aa, Glycine max
  Coding DNA Sequence Number=SeqID_42720
MSSGSPPLDDKRAQNDHNLSLRAIGHNLLWMAKRVRDCGAADKSEALAPTYPQ

SEQ ID NO: 134406 - protein, 162 aa, Glycine max
  Coding DNA Sequence Number=SeqID_42721
  Homolog annotation: Hit_ID=A5BMG6; Match level="QueryCoverage=70%, HitCoverage=8%, E-value=1e-08, Identity=31%"; Hit description =Putative uncharacterized protein
STLEDPQHRHLTETSLQAGNSDVYGFLDPQSIQRSGQSQFESKSYIKSWMQSLKRDVYLGAYLNGPDNYLKGIINSALKGLDDTPQPKSKTTARWIVVKCNRQKGSTECGYYVMHWMSMIILGSFRNNWETYFNEVRPLEAERLKALRIQWAQYYLKVRNQI

SEQ ID NO: 134407 - protein, 74 aa, Glycine max
  Coding DNA Sequence Number=SeqID_42722
MVMYLTMLTFIRQWLKDLSISEGMLWRFNSSMVKYLTPPLVHASYDMGNSINCGNMYFVLGGMSPGGELPCGPG

SEQ ID NO: 134408 - protein, 218 aa, Glycine max
  Coding DNA Sequence Number=SeqID_42723
  Gene Ontology: Biological process=entry of virus into host cell
  Homolog annotation: Hit_ID=P03749; Match level="QueryCoverage=100%, HitCoverage=19%, E-value=1e-119, Identity=100%"; Hit description =Host specificity protein J
  Subcellular localization annotation: CTP_CleavageSite=75; ConfidenceScore=5.37e-01
MFVAQGNQIFMNDVFLKRLTAPTITSGGNPPAFSLTPDGKLTAKNADISGSVNANSGTLSNVTIAENCTINGTLRAEKIVGDIVKAASAAFPRQRESSVDWPSGTRTVTVTDDHPFDRQIVVLPLTFRGSKRTVSGRTTYSMCYLKVLMNGAVIYDGAANEAVQVFSRIVDMPAGRGNVILTFTLTSTRHSADIPPYTFASDVQVMVIKKQALGISVV

SEQ ID NO: 134409 - protein, 28 aa, Glycine max
  Coding DNA Sequence Number=SeqID_42724
LVKGIYKIVDSQAGCLGTGRRHKGVGIL

SEQ ID NO: 134410 - protein, 183 aa, Glycine max
  Coding DNA Sequence Number=SeqID_42725
  Homolog annotation: Hit_ID=A5BJP3; Match level="QueryCoverage=92%, HitCoverage=14%, E-value=5e-09, Identity=24%"; Hit description =Putative uncharacterized protein
MSTSNLDEVIVALRENERMMRTENIDDEHNAITMVESERGRNHSRRHDGEMQTNEGELEKKIRDMNKDSVNSQISEEKSVEDENNVFLATNDEVAKTKWVIDSATSKLICRDREMFDTLKTDGEFDHFKLGNGGKMKVEDIGNTRMKLHDDTIQTFSNVRFVPSVTVNMILQGTSILVQSGDG

SEQ ID NO: 134411 - protein, 79 aa, Glycine max
  Coding DNA Sequence Number=SeqID_42726
MLTPTAYPPPLNYMQPTMHMPNENANHAILIEGQQPQPMGGTREEPPKQAQGDFDPYPIFTAEGPAFNAMPQPNTAGAP

SEQ ID NO: 134412 - protein, 150 aa, Glycine max
  Coding DNA Sequence Number=SeqID_42727
MVIHTFHQPGANEPVDAQRLTSSSAPFVVQGQRVRWQAEIPYDRSLLSSTKANEFNGIKMMLVFTLVVRRHSSPTMHKILLCWAGTIKFDSMWKRRDRGVNRNSNLDPSGTFWKLGCLRRKQRGGKILHVVEKWFPWLPLCFRKIFENLQ

SEQ ID NO: 134413 - protein, 76 aa, Glycine max
  Coding DNA Sequence Number=SeqID_42728
MTVEWRRKRERRRHFKEKMSLEEAHHHRRPSIRAWRKKEMNEGRGREEHEILCSNRALKYEPTNPRSSPRFSTKCA

SEQ ID NO: 134414 - protein, 63 aa, Glycine max
  Coding DNA Sequence Number=SeqID_42729
MRKLEKAACQNSRTVVDSIGNVWSAWASSILEGRSRLLLLLPRAGPSEVRVIPPSRVVSVAGK

SEQ ID NO: 134415 - protein, 22 aa, Glycine max
  Coding DNA Sequence Number=SeqID_42730
MEEKLACGASMEVGSLSFNEVL

SEQ ID NO: 134416 - protein, 197 aa, Glycine max
  Coding DNA Sequence Number=SeqID_42731
MAPRKLASKRSRKDKVAEGTSSAPEYDSHRFRSAEHQQRFEAIKGWDDEYTDFQEEIVCRRWASLVTPMAKFDPDIVLEFYANAWPTEEGVRDMRSWVRGQWIPFDADAISQFLGYPLVLEEGQECEYGQRRNRSDGFDEEAIAHLLCIPGQDFARTAAGRWVRIMRTNMTTLIQIWMTLLLSNIQPSDHNFDFPLP

SEQ ID NO: 134417 - protein, 135 aa, Glycine max
  Coding DNA Sequence Number=SeqID_42732
MTQELVARGDTLRLSAPCHSVTPSVIDEQRPMWSSAPFPEISASSGGDFFKSHKLSRTTGGGPDDMRRQNLVILHPFTIQTQSCPMARRDKIWSFCTLLSSRGGGPDDMQRQNLVILHPLSSRGGGPDDMRRQNL

SEQ ID NO: 134418 - protein, 93 aa, Glycine max
  Coding DNA Sequence Number=SeqID_42733
WNLRKGRLLLHLPRPDMIDPGSHLMKLGRDIQILWCLGNVVVYYTEFDEFKEELERRHWDEKLTDFADNNIDIAIVKEFYANLYDPEDKSPKQ

SEQ ID NO: 134419 - protein, 93 aa, Glycine max
  Coding DNA Sequence Number=SeqID_42734
MGSSVLPKSLPTIFEVGRFICLRPDGSIGFTLATALNSGHLSLASIIFFMLIMAFIIVAICSFMASIFGIHLLLHLLCFTHYSSSSTSSERMQ

SEQ ID NO: 134420 - protein, 34 aa, Glycine max
  Coding DNA Sequence Number=SeqID_42735
MWDHHGGGACHPARPGELSSHRRARLLPPEATAF

SEQ ID NO: 134421 - protein, 70 aa, Glycine max
  Coding DNA Sequence Number=SeqID_42736
MSTSPERVQMTTLLCSGDQSHLGSLNDGCADNRKVSPRVTSSWVMTAKGGVVDKSKALAPTYPPMRNSDL

SEQ ID NO: 134422 - protein, 146 aa, Glycine max
  Coding DNA Sequence Number=SeqID_42737
IAPKRHPVDPEKSNRALGFPALVTGLYQSYRVLVPPRQGHIIIGIAPARHPVDPKKSNRVLELSSSNYGSLSVQGSACCPQQGHQAPYQSSFHLEVLRLQAGAGRNTTAAWGWPAAGNRRTAITSRVHLSSSTKRLERCLRHMADQ

SEQ ID NO: 134423 - protein, 77 aa, Glycine max
  Coding DNA Sequence Number=SeqID_42738
GETPGIFIVLSGFATTDLSVRFRDACQGGGAYGKTALPRPSTLASAEPVVFSPATHVTGKHPGVTQLVIASMHTSAL

SEQ ID NO: 134424 - protein, 112 aa, Glycine max
  Coding DNA Sequence Number=SeqID_42739
NFLSIFFNGNALTYFMSLTTDDSLLRVATKSLILSEAKIILILLRIPWPIHLQFNKDDAKGHVQPSHIQEDFFFSSFYFKKGFKRLQGSLDQDNLELQRRVDPKLNSRGSRS

SEQ ID NO: 134425 - protein, 63 aa, Glycine max
  Coding DNA Sequence Number=SeqID_42740
MKNVEERSKPLQNSSRKRYGNVSEAPRLRFSSRKQFFQQNRGDACHPARPGEQGCFLQKQQPS

SEQ ID NO: 134426 - protein, 51 aa, Glycine max
  Coding DNA Sequence Number=SeqID_42741
MRGVATSRKNRRKPVRMKILSSGVVFTLEEGRQKRGFCPYVPSIEEEIRPT

SEQ ID NO: 134427 - protein, 147 aa, Glycine max
  Coding DNA Sequence Number=SeqID_42742
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=7e-25, Identity=53%"; Hit description =Putative uncharacterized protein
MTMITPSSQLTLTKGNKSWYRAPHRVDARGIHVVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134428 - protein, 143 aa, Glycine max
  Coding DNA Sequence Number=SeqID_42743
  Homolog annotation: Hit_ID=A5BP71; Match level="QueryCoverage=37%, HitCoverage=13%, E-value=7e-11, Identity=56%"; Hit description =Putative uncharacterized protein
  Pfam annotation: Domain name=zf-CCHC; Domain location=119-136; Score =10.4; E_value=0.041; Accession=PF00098.14; Description=Zinc knuckle
MEIHDGQIYCPHVMKKLWENQEKACSHIVRIYDIQRTIFEVEEAFDPMTQRDVVYTNDYILRAYSAQWWPLGNDDVILPSNEPWKLVPDPSFIHDKKGRPRSTRLRNEMDWREPSQTRYKCGRCGTVGHNRRNCPLQSQEGSC

SEQ ID NO: 134429 - protein, 336 aa, Glycine max
  Coding DNA Sequence Number=SeqID_42744
  Homolog annotation: Hit_ID=Q84VH5; Match level="QueryCoverage=69%, HitCoverage=33%, E-value=1e-84, Identity=74%"; Hit description =Envelope-like protein
MAPVTMGLCTVIVQIQCWLGIVMLIGLEVQMTEKALLVDASIWATILFHGSARSRTVCPYLLQKQSILQQEAAALLLHGYRTKRNFSSGSPSVPSSPSSTKAPSNQERPEFNIQPIQIIPGPAPVPEKLVPKRQQGVKISENPSLATSPREVDTEMDKKIRSIVSNILKNASVPDADKDVPTSSTPNVSVPDAEKDVPTSSTPNAEVLSSSNKERSTEEDDQATEETPAPRAPEPAPGDLIDLEEVESDEEPIANKLAPGIAERLQSRKGKTPIKRSGRIKTMAQKKSTPITPTTSRRSKVAIPSKKRKEISSSDSDDDVELDVPDIKRAKTSGKK

SEQ ID NO: 134430 - protein, 62 aa, Glycine max
  Coding DNA Sequence Number=SeqID_42745
MVVILPKENLVAWFCSLHNRPDNYLKGIINSALKGLDDTPQPKFKASASVIDKKEALSVAIT

SEQ ID NO: 134431 - protein, 258 aa, Glycine max
  Coding DNA Sequence Number=SeqID_42746
MTSIIGGYHEWLKVHIRGLDWLAKLKVVSEDSFEAPEEDEEVQALKNELGKAKLAKEKFKLAATHIRKECAGLREENATTAKALEQETKRARKEEYGRNKFRGALWGSNSELKLRREERDQSRAHSMVLKEELVACSRSKRSLSQRLCETETNMLAIIAKYQEELSLATTYEHRVADKYAQVYAEKEARGRVIDSLHQKATMWMDRFALTLNGSQELPRLLAKAKAMADTYSAPEEIHGLLGYCQHMIDLMAHIIRNR

SEQ ID NO: 134432 - protein, 111 aa, Glycine max
  Coding DNA Sequence Number=SeqID_42747
MAKGCGMTKFCLRMSSGPPPLDDKGCRMTKFCLCAPSDTTVSEWKGVRNDQILSPHVTWLADLRVSADNRKVSPRATSSWVMTTKGGVVDKSEALAPTYPPMRNSDLRSSG

SEQ ID NO: 134433 - protein, 242 aa, Glycine max
  Coding DNA Sequence Number=SeqID_42748
  Homolog annotation: Hit_ID=A4PP05; Match level="QueryCoverage=73%, HitCoverage=48%, E-value=7e-15, Identity=30%"; Hit description=IMP dehydrogenase/GMP reductase, putative
YAWGVTALVHMYDQLNDASMSHSQQLGGYITLLQCWIYKHFPSVADSTADQEYDEDSPRACRWIATKKTVKSIRTSAYMERLNRLQIPDVCWISYGEHRSVPDFHTIPAPPVDSWVSYDDIHDRWMHYSDHIIPAGEVCVVPGQCASDYMDWFFRISHPFMTPGHALDPLPHGHTPQPRVVPQAPQTDIPHVPEPGASSTFLEESRHAVEVCDDIAERLECHLSLGVVTPGSSTQEVIEECL

SEQ ID NO: 134434 - protein, 124 aa, Glycine max
  Coding DNA Sequence Number=SeqID_42749
MSSPSEGYMSSPSEGYMSSPSRGVHVLAIRGLHALTSRGLHVLTLRGLHVLTIRGLHALTSRGLHVLALRGLHALTLVTLTVERTTRPRLERTTCPHLQRADALASKELHVLAIERATRPHLGY

SEQ ID NO: 134435 - protein, 49 aa, Glycine max
  Coding DNA Sequence Number=SeqID_42750
  Subcellular localization annotation: CTP_CleavageSite=36; ConfidenceScore=5.33e-01
MSHLLAKKARKASIAARSTNPSTFGKRTPPKINSARMSMNGAHSPPPAK

SEQ ID NO: 134436 - protein, 53 aa, Glycine max
  Coding DNA Sequence Number=SeqID_42751
MTLSLAHQWAKHASTAKCSFSTLSTTEESGKALISRPRAKHEISALSATVVLR

SEQ ID NO: 134437 - protein, 79 aa, Glycine max
  Coding DNA Sequence Number=SeqID_42752
MGGVNSNQAHLGPPEYSSRRLLLLEEATLARLGELSSPGRAELAWPRRFRNVSVSNYAKILDRSSRFIVRSSFSSVFNG

SEQ ID NO: 134438 - protein, 170 aa, Glycine max
  Coding DNA Sequence Number=SeqID_42753
MTSPSEDYMPAPSEDYTSSPSEDYTSSPSESYTLEDTHPLQSTPRPPLQRTTCPHLSEDYTSSPSEDYVALAFRGLHILPFRGLQALALIGLHDYTSSPSDARPRLQSEHLTFKRATRPVTFRGLHVLAFRGLLPSPSEVYTSSPSEYFTSSPLEGLHVPHLQRTTRPRL

SEQ ID NO: 134439 - protein, 238 aa, Glycine max
  Coding DNA Sequence Number=SeqID_42754
MASNFQQFSARNDAIVIRGVHEVATNPSASSETKKLEGKLDALVNLVTQLALNQKSVPVARVCGLCSSADHHTDLCPSMQQPGAIEQPEAYAANIYNRPPQPQQQNQPQQNNYDLSSNRYNPGWRNHPNLRWSSPQQQQQQPAPSFQNAAGPSRPYIPPPIQQQQQPQKQPTVEAPPQPSLEELVRQMTMQNMHFQQETRASIQSLTNQMGQLATQLNQQQSQNSDKLPSQAVQNPKN

SEQ ID NO: 134440 - protein, 254 aa, Glycine max
  Coding DNA Sequence Number=SeqID_42755
NNLKTWDEVVEKFLKKYFLESKTAEGKATISSFHQFPDESLRGKIKLKTPEEAMELIENIAAIDHAILRDRADIPTKRSLPELSSQDALLAQNNMLSKKLEALNETLSCVICGGAHDSGCCIPTEDTTHEVNYMRNQPRPNFNADQGGPSNKLEEIHAHFMQVSMSNQKSTKSTIKNLEVQVGQLAKQLADQPLSSFGANIEKNPKEECKVVMTRSKMVSVNEGEKRIGEEKQQLVTKPAIDPVVEPLSETEEE

SEQ ID NO: 134441 - protein, 76 aa, Glycine max
  Coding DNA Sequence Number=SeqID_42756
HLPVSSLVEETYFKTAQLFAIRGRQTQAMINSGSQYSEVVSKAMNRGDQWGPDPWRKRTAKGRPVSTRIYTKMDED

SEQ ID NO: 134442 - protein, 85 aa, Glycine max
  Coding DNA Sequence Number=SeqID_42757
MTLTIPQLFLKPLQVMWDATVFRVFNQNFPLYIKHENLSEIAHGGQCLNISVIQLWILALKGLDDTPQPKSKAVARWIVVKLTLN

SEQ ID NO: 134443 - protein, 150 aa, Glycine max
  Coding DNA Sequence Number=SeqID_42758
  Homolog annotation: Hit_ID=Q6UUU1; Match level="QueryCoverage=40%, HitCoverage=40%, E-value=9e-19, Identity=78%"; Hit description =Putative uncharacterized protein
MSPLPFAIFGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPNAAPLS

SEQ ID NO: 134444 - protein, 137 aa, Glycine max
  Coding DNA Sequence Number=SeqID_42759
  Homolog annotation: Hit_ID=Q6UUU1; Match level="QueryCoverage=35%, HitCoverage=33%, E-value=9e-14, Identity=75%"; Hit description =Putative uncharacterized protein
  Subcellular localization annotation: CTP_CleavageSite=73; ConfidenceScore=5.05e-01
PSGVANCRNLPFGGRATRDSRDACSTKGIRAESPPTFIRGKRRKNRKRRDLRTFKLKVGKPVVPAALMNRPTRGERRFAYWALAECILAYYVGTDEGVSEVLHVAGEKRLHRCVSRICDTGYIPIPRSLTRYARTYD

SEQ ID NO: 134445 - protein, 61 aa, Glycine max
  Coding DNA Sequence Number=SeqID_42760
MERSMIDAASGGALGDMTPAEARNLIEKMMQSYPPRVLDRRLQEARARATKEGLRVLMNLR

SEQ ID NO: 134446 - protein, 137 aa, Glycine max
  Coding DNA Sequence Number=SeqID_42761
  Gene Ontology: Mol. function=chloramphenicol O-acetyltransferase activity; Biological process=response to antibiotic
  Homolog annotation: Hit_ID=P62577; Match level="QueryCoverage=96%, HitCoverage=91%, E-value=7e-44, Identity=54%"; Hit description =Chloramphenicol acetyltransferase
  Pfam annotation: Domain name=CAT; Domain location=6-135; Score=137.8; E_value=3.1e-38; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDANPWVSFTSFDLNVANMDNFFAPFSPWANIIRMRQVLMPLAIQGHHAVCDGFHGRQNA

SEQ ID NO: 134447 - protein, 83 aa, Glycine max
  Coding DNA Sequence Number=SeqID_42762
  Subcellular localization annotation: CTP_CleavageSite=63; ConfidenceScore=5.26e-01
NPCGVYPDLSSFTGSGVYPDLSSFTGSGVYPDLSSFTGSGVIQKLYSLYQVIRPVRFTSSGIRASALDTVGLKQTTVAKVMSI

SEQ ID NO: 134448 - protein, 222 aa, Glycine max
  Coding DNA Sequence Number=SeqID_42763
  Gene Ontology: Cellular component=plasma membrane
  Homolog annotation: Hit_ID=UPI000065F7CF; Match level="QueryCoverage =63%, HitCoverage=19%, E-value=2e-12, Identity=34%"; Hit description =Homolog of Homo sapiens "Leucine-rich repeats and IQ motif containing 1
RTPRPHLERTTRPRLERTTRPRLERTTCPHHQRAARPHLQRTTRPRLERATRPRLGTTHPRLQRTTRPHLERTKRPRFERTTCPHHQRAARPHLQRTTRPRLERTTCPHHQRAARPHLQRTTRPRLERATRPRLGGPHVLTFRGLHALAIRGLHVLTFVGLHALTFRGLHVLANRGLHAFTFRGLHVLANRGLHALTLRRTTRPHLQRTIHPRLERVARPHL

SEQ ID NO: 134449 - protein, 232 aa, Glycine max
  Coding DNA Sequence Number=SeqID_42764
  Homolog annotation: Hit_ID=A8GIT1; Match level="QueryCoverage=98%, HitCoverage=94%, E-value=3e-74, Identity=65%"; Hit description =Putative uncharacterized protein precursor
  Pfam annotation: Domain name=DUF541; Domain location=17-227; Score =292.3; E_value=9.6e-85; Accession=PF04402.5; Description=Protein of unknown function (DUF541)
MSTGALSGLVQAGEVPNGPHVVTSGQASVDARPDMATLSIVVNVSSKDAADAKKQADDRVAQYFDFLQKNGIEKKDIDAANLSTQPEYDYTKEGKSVLKGYRAVRQVEVTLRQLDKLNELLDGALKSGLNEIRSVELGVANADSYKDQARKAAIANATQQASALAEGFNAKLGPVYSIRYHVANYQPMPMARMYKAAGAAADTTAQQTYEQQSIHFDDQVDVVFEIKPNTAQ

SEQ ID NO: 134450 - protein, 396 aa, Glycine max
  Coding DNA Sequence Number=SeqID_42765
  Gene Ontology: Mol. function=transporter activity; Cellular component= integral to membrane; Biological process=cell division
  Homolog annotation: Hit_ID=Q4J2V6; Match level="QueryCoverage=100%, HitCoverage=38%, E-value=1e-144, Identity=66%"; Hit description =Acriflavin resistance protein precursor
MNPSRLFILRPVATILLMIGVLIAGLFAYRFLSTSALPQVDYPTIQVTTLYPGASPDVMASSVTSPLERQLGQMAGLSQMTSASSGGSSIITLKFSLDLSLDVAEQEVQAAINAANNLLPDDLPNPPTYKKVNPADSAVITLAASSDTLPLTEVQDLVNTRVALKLSQINGVGMVTLAGGNQPAIRVQMDPKALAAHKLSLEDVNTLIANSNVNGSKGGFDGKYHSVTIDANDQLRTAAEYGNLILTWQNGAALRLKDIAHIEQGPENRFQSAWANNRPAIVISVQRQPGANVIQVVDSIKKQLPVLQAALPDGVKMRVLADRTQTIRASISDVQFELMLSIALVVMVTFLFLRNVAATLIPSVAVPLSLIGTFGVMYLADFSLNNLSLMALTIAT

SEQ ID NO: 134451 - protein, 280 aa, Glycine max
  Coding DNA Sequence Number=SeqID_42766
  Gene Ontology: Biological process=cell division
  Homolog annotation: Hit_ID=A7MR94; Match level="QueryCoverage=38%, HitCoverage=100%, E-value=2e-48, Identity=90%"; Hit description =Putative uncharacterized protein
  Pfam annotation: Domain name=ZapA; Domain location=177-274; Score =125.2; E_value=1.9e-34; Accession=PF05164.4; Description=Cell division protein ZapA
MAQQRGNAHVLNHLFQRLFELFLIFIFIVAKLRNGAQIVNRFAGLTGHFVQLRLRHAQAQQEVIDPAGQRVSTIEHRDVLLIRQHQLEQETLFIQRVGPAAVLIAAAQNATQQSVHLGGRHAYALLGKCRGQRVVSGKGVVTYHAGLYSCAPPNPLTGKGDANEVISQDGGMSAQPVDIQIFGRSLRVNCPPEQQDALNLAAEDLNQRLQDLKVRTRVTNTEQLVFIAALNICHELAQEKGKTRDYAANMEQRIRMLQQTIEQALVEQGRITERQGPKFE

SEQ ID NO: 134452 - protein, 753 aa, Glycine max
  Coding DNA Sequence Number=SeqID_42767
  Gene Ontology: Mol. function=aminomethyltransferase activity; Cellular component=cytoplasm; Biological process=glycine decarboxylation via glycine cleavage system
  Homolog annotation: Hit_ID=A8GIS1; Match level="QueryCoverage=45%, HitCoverage=94%, E-value=1e-167, Identity=84%"; Hit description =Aminomethyltransferase
  Pfam annotation: Domain name=FAD_binding_3; Domain location=2-270; Score=-112.5; E_value=4.6e-05; Accession=PF01494.10; Description=FAD binding domain
  Pfam annotation: Domain name=GCV_T; Domain location=455-663; Score =344.0; E_value=2.5e-100; Accession=PF01571.12; Description=Glycine cleavage T-protein (aminomethyl transferase)
  Pfam annotation: Domain name=GCV_T_C; Domain location=671-753; Score =87.6; E_value=4e-23; Accession=PF08669.2; Description=Glycine cleavage T-protein C-terminal
  Pfam module annotation: Pfam domain module=FAD_binding_3::GCV_T::GCV _T_C; Domain location=2-270::455-663::671-753
MEVWDQDSFGSISFDDEQQGLSHLGHIIENEVIHSALWQRASQCSDVTLIAPAQLQQVAFGDNEAFITLQDGSMMSARLLIAADGANSWLRDKADIPITFWDYEHHALVANVRTDMPHDAIARQVFHGDGILAFLPMQDPHLCSIVWSLSPQEAARLQSMPEALFNQQLSVAFDMRLGLCQVESERKTFPLMARYARNFAAHRLALVGDAAHTIHPLAGQGVNLGFMDAAELIGEIRRLHQQGKDIGQHLYLRRYERSRKHSAALMLAGMQGFRELFAGHHPAKKLLRDVGLKLADTLPGVKPPWASTTCPAGSANPPYYGTVSGAVFPALTLRDRPQGWAWQSAAAHESPNCTALSPSIATLCAPGNATTKPAPAPLLFNYSAELLRNSTKDDKVSPSFSLWLIAGMVMTQQTPLFEQHQACGARMVDFHGWMMPLHYGSQMDEHHAVRNDAGMFDVSHMTIVDLHGARTREFLRYLLANDVAKLTQPGKALYTGMLNASAGVIDDLIVYFMSEDFFRLVVNSATREKDLAWIAEHAQPFGVALTERDDLALIAVQGPNAQQKAQSLFSAAQRDAVAGMKPFFGVQAGDLFIATTGYTGEAGYEIALPAAQAADFWQQLLAAGVKPAGLGARDTLRLEAGMNLYGQEMDEGVSPLAANMGWTISWEPGDRDFIGREALEAQRENGTEKLVGLVMTEKGVLRNGLTVRFTDAQGQPQQGIITSGSFSPTLGYSIALARVPASIGEQAIVEIRN

SEQ ID NO: 134453 - protein, 487 aa, Glycine max
  Coding DNA Sequence Number=SeqID_42768
  Gene Ontology: Mol. function=glycine dehydrogenase (decarboxylating) activity; Cellular component=mitochondrion; Biological process =glycine decarboxylation via glycine cleavage system
  Homolog annotation: Hit_ID=Q6D974; Match level="QueryCoverage=98%, HitCoverage=50%, E-value=0.0, Identity=71%"; Hit description=Glycine dehydrogenase [decarboxylating]
  Pfam annotation: Domain name=GDC-P; Domain location=16-440; Score =915.6; E_value=2.2e-272; Accession=PF02347.7; Description=Glycine cleavage system P-protein
MTQTLSQLEHNGAFIERHIGPDAAQQATMLEAIGASSLASLIASIVPADIQLPGPPAVGDAATEQQALAELKAIASQNQRYKSWIGMGYSAVITPPVILRNMLENPGWYTAYTPYQPEVSQGRLEALLNFQTLTLDLTGLDIASASLLDEATAAAEAMAMAKRVSKLKNATKFFIADDIHPQTLDVVRTRAETFGLELIIDRAEKAREHDDLFGVLLQQVGTSGEVHDYRELIAELKSRKVVVSVAADFMALVQLEAPGKQGADIVFGSAQRFGVPMGYGGPHAAFFASRDEHKRSMPGRIIGVSRDAAGNTALRMAMQTREQHIRREKANSNICTSQVLLANIAGLYAVYHGPAGLKRIASRIHRLTSILAAGLQNGGLKLRHHSWFDTLTVEVADKAAVLNRALSFGVNLRSDILNAVGITLDETTTREDVLALFAILLGDAHGQDIEALGRRGGGEKQRHSRQASNVPANSLTHPGFNPSSQRN

SEQ ID NO: 134454 - protein, 257 aa, Glycine max
  Coding DNA Sequence Number=SeqID_42769
  Gene Ontology: Mol. function=folic acid binding; Cellular component =cytoplasm; Biological process=tRNA processing
  Homolog annotation: Hit_ID=A8GIQ4; Match level="QueryCoverage=97%, HitCoverage=76%, E-value=9e-88, Identity=65%"; Hit description=tRNA -modifying protein ygfZ
  Pfam annotation: Domain name=GCV_T; Domain location=21-218; Score= -63.6; E_value=0.067; Accession=PF01571.12; Description=Glycine cleavage T-protein (aminomethyl transferase)
MPIFTLPPRQPAAASRLPLTLISLDEWALVSVQGKDSTSYLQGQLTLDVAALDAAQHRPAAHCDAKGKMWSNLRLFHRGEGYAYVVRRNLREQQVTELKKYAVFAKVTIAADDDAVLLGVAGFQARAALANVFATLPDATTPVVQQDDTTLLWFAEPAERFLLVTTPAQAEALQQKLAGEAQLNDSTQWLALDIAAGVPVIDSATTAQLIPQATNLQALDAISFKKGCYTGQEMVARAKFRGANKRALYWLASSASK

SEQ ID NO: 134455 - protein, 121 aa, Glycine max
  Coding DNA Sequence Number=SeqID_42770
  Subcellular localization annotation: CTP_CleavageSite=48; ConfidenceScore=5.74e-01
MMPTLLLAAVAGTAGSTTGVTGVRVLPPPLPPPPPPPPQALSRNGMMSASRRGEGRKGMLSPVHVNGPECSLSLSRILLSNVADRQNAIDEARTPEIPSGCRKDKVRTGRLMARTAQHCAG

SEQ ID NO: 134456 - protein, 171 aa, Glycine max
  Coding DNA Sequence Number=SeqID_42771
  Subcellular localization annotation: CTP_CleavageSite=43; ConfidenceScore=5.16e-01
HIGDNVNLYGYSFISALPVASSGKNLINTTLSNDWNKASCVVVAANAGVVKGMSGGAVYNASDDTLAGVIVGYSSVAGWGGEVLGWVRADALTPALSHREREKTTAVLCHRETEKTTAALCHREREKTTADLCHREREKTTVVLCHREREKTTAALSHRGTGKSPLPMGEG

SEQ ID NO: 134457 - protein, 220 aa, Glycine max
  Coding DNA Sequence Number=SeqID_42772
  Homolog annotation: Hit_ID=UPI00016621D1; Match level="QueryCoverage =97%, HitCoverage=40%, E-value=1e-10, Identity=28%"; Hit description =UPI00016621D1 related cluster
MRALTSQELSIASIEGIHAPTSSEGSSINYRGLHVLAFIGLHALTFRGLRVLTFRGLHLAFSRTACPRLRGYTPSPLEDYTSSPSEGHTPSPSGLQVLGFRGLQVLTFRALLVLAFRGLHVLTFRGLHILAFRGPHAFAFRGLQVLPFRGPHALAFVGLQAVTFRGQHVFAFIRLHALSFGGLHVLPIRGPRVLTFRGLHVLGFRGLHVLTFRGLHALAL

SEQ ID NO: 134458 - protein, 87 aa, Glycine max
  Coding DNA Sequence Number=SeqID_42773
  Subcellular localization annotation: CTP_CleavageSite=50; ConfidenceScore=5.13e-01
ELTGALSKGGKMRGVATNVYLWKRRKSRRKPVKMKILSSGVVFTFEEGISTSHVDKSGAFAPTYPLSKRKSDLRSSFLRVNQAILIT

SEQ ID NO: 134459 - protein, 66 aa, Glycine max
  Coding DNA Sequence Number=SeqID_42774
MATSGQDLLRCTSRTYLSHPSQDHFLRDQHNSPLCLLENLRDQPEAREAVQVPEIASGTKSGTASG

SEQ ID NO: 134460 - protein, 105 aa, Glycine max
  Coding DNA Sequence Number=SeqID_42775
MDNGSPREIQMGHNFALGCPIQEHHISRRSKLDNGSSSRNSNGHNFSHGGPIQAQHIWRRPKLNNGRYREIQMVISYHTEVRFKRIIYRDARNCITEALEKLKLS

SEQ ID NO: 134461 - protein, 77 aa, Glycine max
  Coding DNA Sequence Number=SeqID_42776
  Homolog annotation: Hit_ID=A5AYU6; Match level="QueryCoverage=87%, HitCoverage=12%, E-value=5e-13, Identity=50%"; Hit description =Putative uncharacterized protein
MESSKDSENEEINLCFMAKSYESDEEEPLKKKWYIDSGCSKHMTGDESKFTHISPKKSGHVTYGEGGREVEFLELEK

SEQ ID NO: 134462 - protein, 40 aa, Glycine max
  Coding DNA Sequence Number=SeqID_42777
MAHQSPCARTTGARKTSYPIHEYIRWVNGVYKMDTIKYIY

SEQ ID NO: 134463 - protein, 318 aa, Glycine max
  Coding DNA Sequence Number=SeqID_42778
  Homolog annotation: Hit_ID=Q6WAY6; Match level="QueryCoverage=80%, HitCoverage=47%, E-value=2e-15, Identity=25%"; Hit description =Putative uncharacterized protein
IDWDQLLAGIGGRTINWFPRWKEGKEGVLFSCGGYPNIPLIGTRGCINYNPALAIRQLGYSMRGAPTEEGMSPFLVRDFGAQNSKTIQRIHKAWETPLKKDQELRGIRNGIIGGYHEWLKVHIRGLDWLTKEKFKLAATHIRKECVGLREENAITARALEQETKRARKEEYGRNKFRGALWGSNSELKLRREERDQSRAHSMVLKEELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGY

SEQ ID NO: 134464 - protein, 95 aa, Glycine max
  Coding DNA Sequence Number=SeqID_42779
  Homolog annotation: Hit_ID=B0HC01; Match level="QueryCoverage=35%, HitCoverage=72%, E-value=1e-11, Identity=100%"; Hit description =Putative uncharacterized protein
MEKRQQRGLFTVSWPFAGLLLTCSFLRYPLILWITVLPPLSELIPLAAAERPSAASHWHDRFPDWKAGSERNAINETAMTMITNSSSVPGAMRSD

SEQ ID NO: 134465 - protein, 184 aa, Glycine max
  Coding DNA Sequence Number=SeqID_42780
MQFMLSPYGRRVSNLDDLVPCLDKMTLLAEEEDRIFEACEEAPPSVPQFESQQFDMLGRSVETQGLGRRMESVDAETHVIPTMPERQHGMYYTPDQFTQESSQMSPLYPYPNQSGTSLDAYFMGTQPLLQPGYVMADLFGSPSPAGTPSFAHGCQISTLNAPIGPSWTVSGNIPNITDLLGVDL

SEQ ID NO: 134466 - protein, 22 aa, Glycine max
  Coding DNA Sequence Number=SeqID_42781
MTTKKSRKEKAMDEGVEVPYPM

SEQ ID NO: 134467 - protein, 124 aa, Glycine max
  Coding DNA Sequence Number=SeqID_42782
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=85%, HitCoverage=7%, E-value=5e-54, Identity=100%"; Hit description=DNA -directed RNA polymerase subunit beta''
MDSVGIRSANPYLATPGATVHGHYGEILSEGDILVTFIYEKSRSGDITQGLPKVEQVLEVRSIDSISMNLEKRVDTWNGRITKILGIPWGFLIGAELTIAQSRISLQVFKKLLEFYQKPLSGGA

SEQ ID NO: 134468 - protein, 260 aa, Glycine max
  Coding DNA Sequence Number=SeqID_42783
  Gene Ontology: Cellular component=mitochondrion
  Homolog annotation: Hit_ID=Q6R9L5; Match level="QueryCoverage=30%, HitCoverage=66%, E-value=1e-27, Identity=77%"; Hit description =Putative uncharacterized protein orf121-a-ct
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGGPNRLMLKKSADEVVVRGENAPSNPELAGSPPKCVEAQQLTRHLGVKHCFGAGRESGTKSRQTLNTRYDLKITRVKVGQ

SEQ ID NO: 134469 - protein, 234 aa, Glycine max
  Coding DNA Sequence Number=SeqID_42784
MEGLVDLAVIDAFLAFHHGKESPVVTILAMHDTFDQRCEKSGARIVCCTLALYVWLVSHLFLQEGRLVYPLQGRKNQDSIFMRRMSKCSLDGTKDCINYNPVLVIRQLGYPMRGVPSDESITPFITRGFSDPNARDRELRGSSNGSIGGYHKWLRVRTQGLDWLPNLKTVRDDEVKASEESDEVQALKAELERARVVEEKFKSIAIKLKPWNEEVKGIITGQRHDLEGRANGLP

SEQ ID NO: 134470 - protein, 142 aa, Glycine max
  Coding DNA Sequence Number=SeqID_42785
MTGRLLAGSLAFESRILHYLIVRILLPRSSNLAQLVTLFFRHFQIPLDSEPYVPIKRSFLIGAAVIASFGYRKEHDGSWVKKGAPPADDEGNQPVEDNSSLLRKLLEKFDGLQTFVGDKFDNIELQVEMRFDAMESRITKVE

SEQ ID NO: 134471 - protein, 110 aa, Glycine max
  Coding DNA Sequence Number=SeqID_42786
MARRDKLWSLCALCHLEVASRVINAQRQIMVIVRPLSFRSNKSSDKRAKTNYGHSAPFVIQKQRVESSQSSDKRAETKYGHSAPFVIQEQCVEWWAETNYGHSAHLFVIP

SEQ ID NO: 134472 - protein, 43 aa, Glycine max
  Coding DNA Sequence Number=SeqID_42787
MSLPSAVHVSSTFEFGAMFHDCLSALFMCPPLSSAEPLQKKKE

SEQ ID NO: 134473 - protein, 107 aa, Glycine max
  Coding DNA Sequence Number=SeqID_42788
MGDQEEVQEQMKADMSALKEKMACMMDAMLGLRQLMENNAATAAAVSSAADADPTLPATAHHPIPNVVGRERSTLGHISNPHPGYNRVAYPYGLPPNYTPAAIRDDA

SEQ ID NO: 134474 - protein, 78 aa, Glycine max
  Coding DNA Sequence Number=SeqID_42789
MVSRVGDERDEFLFHLGESHDMETCPAVEELLQWLMDCGQLEVSIGGRKEPQICMQSEEKKVPLTPKALVICFTRKGT

SEQ ID NO: 134475 - protein, 210 aa, Glycine max
  Coding DNA Sequence Number=SeqID_42790
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPSRVSTSQQSLPLPSYRQHANTPSDYLAHLTKGMQAWHWPSFYNVVTGKTLALPNLIALQHIPLSPAGVIAKRPAPIALPNSCAA

SEQ ID NO: 134476 - protein, 264 aa, Glycine max
  Coding DNA Sequence Number=SeqID_42791
  Gene Ontology: Cellular component=membrane; Biological process =transport
  Homolog annotation: Hit_ID=A5FCL9; Match level="QueryCoverage=91%, HitCoverage=90%, E-value=1e-98, Identity=68%"; Hit description =Putative uncharacterized protein
  Pfam annotation: Domain name=DUF6; Domain location=13-134; Score =36.0; E_value=1.3e-07; Accession=PF00892.11; Description=Integral membrane protein DUF6
MKKSYVLLHLAVILAGFTGIFGKLISLNEGLLVWYRLLFSTLILFVILKSLRIPYTISTRGKFHIAKVGILITLHWLFFYASIKYANISIGVVCYCLTSFFTAVFKPLIDKERFKISELLLSLLTVFGISLIFHFDTSYQLGIGLGVISSAIGALYTIFNKRLVQHYDTKVINYYQMLSGTVCLGAVLPVYLYFFPVESVIPGMKDIEVLKKIPAFTVNLTFNLEPVYAIIMAFLFFDESKQWPLRDMYCFFRDQLVQFICRKL

SEQ ID NO: 134477 - protein, 34 aa, Glycine max
  Coding DNA Sequence Number=SeqID_42792
MACILMYGRKVRSGENVYMHSVHEASGEGEGRRG

SEQ ID NO: 134478 - protein, 80 aa, Glycine max
  Coding DNA Sequence Number=SeqID_42793
MMEIRKITTVNFLKKEEEHFLIMVKGAESNGVIMLQAPIANYARKIIMIQMIVGTNAKSAKGTYTTKKIVFTDKKKKQIF

SEQ ID NO: 134479 - protein, 48 aa, Glycine max
  Coding DNA Sequence Number=SeqID_42794
MVKYRAKSNIEMNRGTRGRARMGARPVINRSLSRVQLRTIEKPSWEAA

SEQ ID NO: 134480 - protein, 48 aa, Glycine max
  Coding DNA Sequence Number=SeqID_42795
WVGERRSIYGHVGFPTRLTTMKPHLEFFSFGDALLLIVLIATMYYLSG

SEQ ID NO: 134481 - protein, 251 aa, Glycine max
  Coding DNA Sequence Number=SeqID_42796
MVNVPLKKKKKCRLARLGSHRFRSAVHQQRFEAIKGWSFLRERRVQLRDDEYTDFQEEIGRRRWASLVTPMAKFDPEIVLEFYANAWPTEEGVHDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPLPKCQLVSQPTLRREGDARLTGCVFHERNTRGVATNVYLRKTSEKPETTRSTNF

SEQ ID NO: 134482 - protein, 240 aa, Glycine max
  Coding DNA Sequence Number=SeqID_42797
MRDMRSCLRGLWIPFDADALSQFLGDPLVLEEGQECEFSQRRNRDDEFDEEAIAQLLCIPGMPPIRHPLNPNKSNRALGFPALITGLYQSFGVPVTPSKVIRPSITRAFIEKYCMPRQAQGDAPQATDAPPPPHQADPAGSFGMERYLQHLVHQQAANHRGQVQIHECLYQLSISQQSQGFVPFACPTPDQFRAEVAWPGDWPKAQAGEAPVEAPGGAEEARMDEEMTDLLGFLGGSGAT

SEQ ID NO: 134483 - protein, 157 aa, Glycine max
  Coding DNA Sequence Number=SeqID_42798
MGDPISRLSFPELRRSEFLIGGYVGARASLLSTTPPFVAMTQELVARGDTLRLSAPRHSVTPSVIDEQRPIWSSAPFPEMSSFSDGDFSSLTSYPELRRSEFLIGGYVGAIFGHVTCTLVSSRGGGPDDTRRYLTVIRTLLSSRGGGPDDQAGIPEF

SEQ ID NO: 134484 - protein, 83 aa, Glycine max
  Coding DNA Sequence Number=SeqID_42799
MMLMFEKCSTLNLSLPFVEVFVIICDNNNPPSHQYDSTSNLEDLSDEYQTCWIKNHDSDTDSSSEPEGSNLSPSHETIFKQDW

SEQ ID NO: 134485 - protein, 103 aa, Glycine max
  Coding DNA Sequence Number=SeqID_42800
MALEEVKSTDQIPEPSPAPIPNDAIPSAPASDFYISVLLNFSTFSCLLPLEENEHVIGSMTENVSQFVRLIVKECINRIPESIIHRKRGSKKIFPKFRGVFIK

SEQ ID NO: 134486 - protein, 104 aa, Glycine max
  Coding DNA Sequence Number=SeqID_42801
MEEEGCAASANQNYQWKIHLHRNWKVVEGPQLLVLSGAVAVVGLVEECHNCSAVVDFAAEVEEVYCKYLQYKLRAAQLLQVAAWKGKGLYGGQQRSTNRRPLRQ

SEQ ID NO: 134487 - protein, 47 aa, Glycine max
  Coding DNA Sequence Number=SeqID_42802
MKSLRGKEIPLVKVQWGTDEGDSTWELEDRMRELYPKVGIAGARYAG

SEQ ID NO: 134488 - protein, 387 aa, Glycine max
  Coding DNA Sequence Number=SeqID_42803
MAPKKLSTKRSRRDATAEGSNAAPEFDSHNFRSVGLQQRFEAIKGWSFHRERRVQLREDEYTSFWGEIARRHWTSQVTPMAKFDLEVVLEFYANAWPTEEGVRDMRSWVRGQWIPFDADAFSQFLGDPLVLEEGQQCEFNQRRNRADGFDEEAIAHLLCTPGQDFARTAAGRRVRIMRTSMTTLTQTWMTLLLSNVLPSDHNSDLPLPKCQLVYAILTRMTVHVAQVIADAIYLFAGMPPTRHPLDPDKSNRALGFPALITGLCQSFGVSVTPSKVIRSPISRAFIEKYCTPRQAQGDAPQAAANYRGQVQIHECHYRFSLSQQEQGFAPFACHTPEQFGAEVAWPRDWHEAQAGEEPAGFPGEAEEARMDEEMTDLLGFLGESGAM

SEQ ID NO: 134489 - protein, 68 aa, Glycine max
  Coding DNA Sequence Number=SeqID_42804
MEIQEKGRSLEFQEPMDLRSNPFQGVGNDAILPPPKALDRRLQEDWARDAKEDPRVLMSLRVDFEPMS

SEQ ID NO: 134490 - protein, 159 aa, Glycine max
  Coding DNA Sequence Number=SeqID_42805
  Subcellular localization annotation: CTP_CleavageSite=53; ConfidenceScore=5.20e-01
MTMQNMQFQQETRASIQSLTNQMGQLATQLNQQQSQNSDKLPSQAVQNPKNVSAISLRSGKQCQGPQPVAPSSSANEPAKLHSILEKGDDKNLPNNFCAGESSSTGRRVTRGMRVPRKEYARSRHQRLFEENVGKTGKDAIYELLSERFGSCIYARGRC

SEQ ID NO: 134491 - protein, 265 aa, Glycine max
  Coding DNA Sequence Number=SeqID_42806
MTSKAAKEIADKIASQDFFVTHGCQDVLTAAIGRLEHPSRVRGARPGVMIKKYFGPASRTSRTSSSMASKDLEKLTQKIRDQLEELALPPEFEGSTTIHNIPLLLDQVKVGVEEVRDADAPIPVPIEKVMWDATVFGVFNENFPLYIKHEDLSKIAPVVNVSASLLYSCGFRKHMTKTSMRAGNAENSKRDVYLGAYLNGLDNYLQGIINSALKGLDDTPQSKSKSAARWIVVKYFNDARLLEPERLKALRIQWAKYYLKFKNET

SEQ ID NO: 134492 - protein, 149 aa, Glycine max
  Coding DNA Sequence Number=SeqID_42807
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKAGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPFIFQEAKESIDEEDPRPTSSNGAYIKRVRSYEKSKRLTL

SEQ ID NO: 134493 - protein, 91 aa, Glycine max
  Coding DNA Sequence Number=SeqID_42808
MRKEKYRIRRHSPFRLRNCWEGRSVRASSLLRQLAKGGCAARRLSWVTPGFSQSRRCKTTASAKLACLQVDSRGSPLKKKRILISYLLEGN

SEQ ID NO: 134494 - protein, 165 aa, Glycine max
  Coding DNA Sequence Number=SeqID_42809
MLQSIHQGQIILLQSLQVVAPPGSIPSIAQFLERVAWPGAQPFLHREDEGPTAQEPRQVQDASSRTTIPEPFTFLQDAGEEQVRPKTTTTLERSLEGTSDPPALVVDLSSPQLATDPSTPVVDTPEDQTTLVLTLNTSPPATPVLHLTDEEDVHTRDTQDLSQGF

SEQ ID NO: 134495 - protein, 244 aa, Glycine max
  Coding DNA Sequence Number=SeqID_42810
  Homolog annotation: Hit_ID=A1FY24; Match level="QueryCoverage=86%, HitCoverage=84%, E-value=1e-77, Identity=61%"; Hit description =Putative uncharacterized protein
MEPRRDARNPPRRAGVLAKEMAMYRWVSGFISYRTFYIWRARYRYYTRNLDLWTLMSGLCIVGLLLVLWYMWQMLGVPPPRIHPDTAALRIEGVTHEAIHRIVLVRHAGSTRGAEFTTPEDVRASTLRTMRVRQVMDSEVVWRLKADMLADIADYINVTGGCFPYDCRQIRDRLDPVRKAAVENAQINASLATILDVPLDQMPLLKGGERERVKSGWSDTFNDVYFQAGLLREPAGHACADDAG

SEQ ID NO: 134496 - protein, 132 aa, Glycine max
  Coding DNA Sequence Number=SeqID_42811
MAPKKLSAKRSRRDAVAEGTSATPEFDSHRFRSTEHQQCFEAIKGWSFHRERRVQLRDDEYTDFQEEIARQHALSQFLGDPLVLEEGQECKFSQRRNRADGFDEEAIAQLLCTLGQDFARTVAGRRVRIMRT

SEQ ID NO: 134497 - protein, 121 aa, Glycine max
  Coding DNA Sequence Number=SeqID_42812
MTRGNPCDLQPFDPEIDRTFHRLVRHSVHPGHSVHFEHFEHSVEGNFEYSDFEHSTTTFHTENMAQPLPRERTLRETAAPDFTYENLCIQYPDKGVPYVLKTGLVKILISILRSSILFVPP

SEQ ID NO: 134498 - protein, 88 aa, Glycine max
  Coding DNA Sequence Number=SeqID_42813
MVPSGVTNCRNMPFCGRARRGSRVRFPKEERCAESPPTFICGKRQKNRRKPVKTKILSSGVVFTFEEGRQKWGFCSYVPSIEEEIRPT

SEQ ID NO: 134499 - protein, 160 aa, Glycine max
  Coding DNA Sequence Number=SeqID_42814
  Subcellular localization annotation: CTP_CleavageSite=42; ConfidenceScore=5.18e-01
MPISPCGSISWSVSSRHRDRTHKTQWTRRSPTGPWGFQLWLRASISPTGCPSPQQGHVHHAIGDRAHRTPSGPKEVQQGPGVSSSELRASVSPIRSALVTPSKVIGPPTNRAFIKKYCAPRQAEGETPQQPGDGHQQATNAPPPLPVPLSSSTKRLEYCL

SEQ ID NO: 134500 - protein, 79 aa, Glycine max
  Coding DNA Sequence Number=SeqID_42815
MMIGGGITWMLWKLGRIDRDPTLRGMRIRATWEYVSSVGGGQQGMICREGQETLGTSGAVLLPKTKLDQSRPNPGIVSQ

SEQ ID NO: 134501 - protein, 156 aa, Glycine max
  Coding DNA Sequence Number=SeqID_42816
MMTHHLGNGAKATVQQLQKVLGMTLLVVDGWDHGKRMDQHPSFSLIFSPTTRLRTCGTRKKRVVEKLERKDIRGNQSTRGNESSYARFINKRSMLFIDRKGRRQSAIPMHGVSFNPKEEDKQRLNSMWGEWSTEMIHISPNRSLILKAFLLEKWPQ

SEQ ID NO: 134502 - protein, 118 aa, Glycine max
  Coding DNA Sequence Number=SeqID_42817
MGQVSGFDEETIAQLLCIPGQDFTQPLQGDEWIASPMRSPLDLEKSNRALGFPALIIRSPINRAFIKKFCAPWQAQGEAPQQPRDGQQLATDARPPPPKFTSAHIQRLECCLQPVVDQ

SEQ ID NO: 134503 - protein, 76 aa, Glycine max
  Coding DNA Sequence Number=SeqID_42818
MWNSNMSLATLGKYRTQESLSHLQEKDGEVFKKKMASANLSFQKRNEDLHHMEITTTGKPECKFLIEAIENIWEEK

SEQ ID NO: 134504 - protein, 152 aa, Glycine max
  Coding DNA Sequence Number=SeqID_42819
  Gene Ontology: Mol. function=thiamin pyrophosphate binding
  Homolog annotation: Hit_ID=A7MHV0; Match level="QueryCoverage=35%, HitCoverage=8%, E-value=8e-18, Identity=79%"; Hit description =Putative uncharacterized protein
MSDRPEDLAAAWQQALSATRPVVLEVKTDPEVAPLPPHITLKQAKAFMSSMAKGDRGMAQAGIFAIFHYDLLVCKECAPFICGKPLEEGNVGSCIPDIQSAMNGLFLDECGFLPGRHKWRPYRLGIVFGRSKWQNHRTDAINGDPIERRRVL

SEQ ID NO: 134505 - protein, 37 aa, Glycine max
  Coding DNA Sequence Number=SeqID_42820
MTKARQKGVRKGKEGEACHPARPGKLGCFLGGTSWKA

SEQ ID NO: 134506 - protein, 143 aa, Glycine max
  Coding DNA Sequence Number=SeqID_42821
MAAQLIHDQVEMECLEGAWETLEGNARCRFRGTIRFTATSLVHPDEPARTLQRTVEWILPTPTPYRLVEPVQVIEVTSSEEDPEEDLEGLPLEPAVDALDFLEDDEDPLPEVDSPEEVMSVSEADSTEDSGPGEMAISGGSSS

SEQ ID NO: 134507 - protein, 115 aa, Glycine max
  Coding DNA Sequence Number=SeqID_42822
MDRFDIFVPHPLIITSLLPLEYGCEPLICLLKQLTLLSVDFQDSSIKDYSSCMLVGVPCYKVMTKDNNWYLKALHWAMRGTMYEPQVNIGADQKFSPIDVFKQKKGQTLGFQWID

SEQ ID NO: 134508 - protein, 32 aa, Glycine max
  Coding DNA Sequence Number=SeqID_42823
MADGKLIEMKGRVNLGFKRLWESLDCAKEENE

SEQ ID NO: 134509 - protein, 277 aa, Glycine max
  Coding DNA Sequence Number=SeqID_42824
  Subcellular localization annotation: CTP_CleavageSite=31; ConfidenceScore=5.23e-01
MAEPSKKRKGSSSRSQRHSETQKTQIPSSISSSSLFSSEEQQIRYPNLFSSRSIIDPKFIDMDFFSNESFECIQAFENSNLIPFMSLKLPVYSELVKAFYSNLEIQEGTLISEVYGIKMVIDQSLFYDLTQLSSEGVPFEGTLNDDWKFDFSVHDARRLVCTNQADMTERLLAGSLAFEGRILHYLIVRILLPRSSNLAQRSFLIGAAVIASFGYRKEHDGSWVKKGAQPIDEEGHLPVGEDSSLLQRILDRFDGLQTFVGERFDTLELQVDCDLMR

SEQ ID NO: 134510 - protein, 33 aa, Glycine max
  Coding DNA Sequence Number=SeqID_42825
MEFGPGKEMHVGLDKKMNNGTMILLCKKEGGRG

SEQ ID NO: 134511 - protein, 128 aa, Glycine max
  Coding DNA Sequence Number=SeqID_42826
GDEEVQTLRAELEQAQTVKERFKSVAPKIRKENAELLILKDELKACSRFKRNLSQRLCETETNMLAIVSKYQEEVNLATTHEHKVADEYARVYAEKEARGRVIGSLHQEATMWMDRFALTLNGSQELL

SEQ ID NO: 134512 - protein, 49 aa, Glycine max
  Coding DNA Sequence Number=SeqID_42827
ITSSDENPKAAQIQGPMTRGRTKQSKDTLQQMVTVILDKAQVEKDEGPE

SEQ ID NO: 134513 - protein, 215 aa, Glycine max
  Coding DNA Sequence Number=SeqID_42828
MEAMKEQMAIMMEAMMSVKKIMEANAVATAATNVVAKVNPMPPSGLNQMNHPTSAMVGKDLGSTGGPHYAQSQNKHAFPPHGFPPNYTPPNVAYTPSGNVNNSTPIFIESRQPQTDHAHVSQPMGETHEMPHHNLADFEPCLGYATEGQAISGIPLQNPLEGPQYHPQLHLLHSTTSKNPHAMAEMGKLDHLKKMLRAIKGGEDYAFANLEELFL

SEQ ID NO: 134514 - protein, 190 aa, Glycine max
  Coding DNA Sequence Number=SeqID_42829
MVGYTPSSFTDLVFASERIKVGLKGGKFNRPAWTTEKTGANEEGENEGETHAATVIPTWPNFPPAQQCRYSANNNPSPYPPPNYPQRPSLNQPQNPPTTQPMLNTTFSTNQNTNQEMSFAAKKACRIHPHSAITPAKVHQPPFLREYDSNATCACHGEAPGRSIEHCRALKRKVQGLIDAGWLKFEENRV

SEQ ID NO: 134515 - protein, 145 aa, Glycine max
  Coding DNA Sequence Number=SeqID_42830
YILCGTSRGYIYLGLTENKRGYISCGSVLVEGTSTRFKENKGGYIPCRSLLVKGHSIQQVVSEQVSCTMAYLDSLSFKSIFRNRLLKDDDGDQVNMCLMTKSSENNKEDSIRKKWYIDSGCSKHMTVGKIGTNSSTPIENVLLVE

SEQ ID NO: 134516 - protein, 139 aa, Glycine max
  Coding DNA Sequence Number=SeqID_42831
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A6YA17; Match level="QueryCoverage=64%, HitCoverage=17%, E-value=3e-31, Identity=78%"; Hit description=NADH -plastoquinone oxidoreductase subunit 2
  Pfam annotation: Domain name=Oxidored_q1; Domain location=1-125; Score=-59.1; E_value=0.00021; Accession=PF00361.11; Description=NADH- Ubiquinoneplastoquinone (complex I)
MASSSGNPSYLSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSASTIPGISMNPIIEIAQDTLF

SEQ ID NO: 134517 - protein, 211 aa, Glycine max
  Coding DNA Sequence Number=SeqID_42832
  Gene Ontology: Mol. function=phosphoinositide phospholipase C activity; Biological process=intracellular signaling cascade
  Homolog annotation: Hit_ID=A5B3Q0; Match level="QueryCoverage=100%, HitCoverage=16%, E-value=5e-28, Identity=33%"; Hit description =Putative uncharacterized protein
MFVDKSRKRVHLKYLQNLGDLRECSSYAWGAAVLGNLYREMCIATDYNTKSIGGFTLLIQLWAWERCPTLAPSVIPPQQQNTPLGYRWLGGELHHIGNDNLIEFRRKLDVMKRDETRIILLICFQEVEWHQPDRVMRQFGMQQPIPGPVMQPNNIHDLTLKGNEGKNWMRLMQPALNEWNSRYERRVEQTPPQTGTLSLSYEYMRWYRRNT

SEQ ID NO: 134518 - protein, 31 aa, Glycine max
  Coding DNA Sequence Number=SeqID_42833
MEKFESSPFQDILDIGLLKEEATARQAPPCC

SEQ ID NO: 134519 - protein, 182 aa, Glycine max
  Coding DNA Sequence Number=SeqID_42834
  Gene Ontology: Mol. function=protein serine/threonine kinase activity; Cellular component=cell surface; Biological process =recognition or rejection of self pollen
  Homolog annotation: Hit_ID=A7QGD7; Match level="QueryCoverage=32%, HitCoverage=7%, E-value=2e-23, Identity=83%"; Hit description =Chromosome undetermined scaffold_91, whole genome shotgun sequence
  Subcellular localization annotation: CTP_CleavageSite=70; ConfidenceScore=5.60e-01
SRVALPPKGRLRHWVLRSFSFGGFQDTSSTLFVKVRANGSWTSKGQAGGSNSSSDGMGSAMEKPVIIPIVLSMVVTMVRGTRGYLAPEWVSNRPITIKDDVYNFGMLILEIIGGKRNLDMSFGAEDFFYPGAGVDDERMSSAQALFLDAICPLSQMQLIREMNVLFQRMNSLSAVGPLSEFV

SEQ ID NO: 134520 - protein, 321 aa, Glycine max
  Coding DNA Sequence Number=SeqID_42835
MAPRKLSAKRSRKDAAAEGTSAIPEFGSHRFRSAEHQQCFEPIKGWDDEYTDFQEEIARWRWTSLVTPMAKFDPDIVLEFYANAWPTEEGVRDLRSWGQECEYSQRRNRADGFDEEAIAQLLCIPGQDFARTAAGRRVRIMYTSMTTLTQTWMTLLLSNILPSDHNSDLPLPECQLVYAILTRMSVHVAQLIADTIYLFAGMPPTRHPLDPDKSNRAIGFPALITGLCQSFGVPVTPSKAPNAPPPPHQADLVGSFDMERYLRHLVRQQAAIHRTHVAWLGDWPKAQVGEAPAEAPSDGEEARMDEEMTDLLDFLGGSGAT

SEQ ID NO: 134521 - protein, 108 aa, Glycine max
  Coding DNA Sequence Number=SeqID_42836
MGEKLGTQLQASSVASSRSNRHLEEFSGRPKWARLLFAPPSGPKRRMTIICLCVLLDTIEPLDGKKVCGMTKGAEFVSARLSPNLRNLNDKGRRICLCAFITRLAAPE

SEQ ID NO: 134522 - protein, 90 aa, Glycine max
  Coding DNA Sequence Number=SeqID_42837
  Gene Ontology: Mol. function=nucleic acid binding; Biological process= DNA integration
  Homolog annotation: Hit_ID=A5AV98; Match level="QueryCoverage=98%, HitCoverage=11%, E-value=4e-21, Identity=57%"; Hit description =Putative uncharacterized protein
MTVADSIKTGLPKTNNAKEFMGLVGERSQTANKSLAGTLMSTLTTMMFDGSCTMHEHVIEMTNIEERLKTLGMVVNENFLIQFILNSLPS

SEQ ID NO: 134523 - protein, 121 aa, Glycine max
  Coding DNA Sequence Number=SeqID_42838
MGEVEEVQEQMKADMEAMKEKMATMMSVKKIMEANAVAIATTSAVAKVNPMPPSSLNQMNHPTADMVGKDLGSTGSPYYAQIQNKHAFPPYGLPSNYTPPNVAYTPGEDVNNSTPILIESQ

SEQ ID NO: 134524 - protein, 156 aa, Glycine max
  Coding DNA Sequence Number=SeqID_42839
MQSTDEEGFRKPKPLVIYFTRDTAPQMPRYPSVVRPIPFPYKNNHADTWRYAPPSERKEEAAGISSLSAKVTNITGLSGMTRSGRMFAPPDLPTQPANAKGKAKIAEEQNDIVIPAPNEDVPMKGLSEKRDGCGEREVSLEETGEFLRIIQQSEFK

SEQ ID NO: 134525 - protein, 56 aa, Glycine max
  Coding DNA Sequence Number=SeqID_42840
MTKARQKGVRKGKRGRWLQPSSPRRAGLLPPEGIAFCWKILEGPSGPDCYLYSPVY

SEQ ID NO: 134526 - protein, 90 aa, Glycine max
  Coding DNA Sequence Number=SeqID_42841
  Subcellular localization annotation: CTP_CleavageSite=58; ConfidenceScore=5.61e-01
MPITPCKSISWSVSSRHGDRTHKTPSGPGRSPTGVSAPNKVIRPPTNQAFIKRYCAPRQAQGETPQQPGDGRQRATDALPPPLEFTSAHP

SEQ ID NO: 134527 - protein, 107 aa, Glycine max
  Coding DNA Sequence Number=SeqID_42842
  Subcellular localization annotation: CTP_CleavageSite=79; ConfidenceScore=5.03e-01
MSFSMRQFPFAKLHTPHFQTYDFLDDGPNPYVVHHLVSQSTTPNAQTPGLVPFGPNSPNIATGPTIEPKKNIVNCTNCPATASPPPSLALLHVLAHLFGLLHAANMG

SEQ ID NO: 134528 - protein, 71 aa, Glycine max
  Coding DNA Sequence Number=SeqID_42843
MADSKPISPFRKEKLSAVIRARLSFKLIQDYMKEGHNFNVFWQSHYAMIAALLANSGADFAANLVKRRSLT

SEQ ID NO: 134529 - protein, 145 aa, Glycine max
  Coding DNA Sequence Number=SeqID_42844
MKDKRNEEEKLERQKKKKDSKALSTKAKGKEKEEKDSSKKIVKKENHFATKCDIKRALILKQSFYLLLSRETSLSTAIPLELEVIHQVKELLDEGLVRKSLNICALLVPKIGIIRHQIPMIGGTPLGRVPEIWFFSPRCILGTPD

SEQ ID NO: 134530 - protein, 135 aa, Glycine max
  Coding DNA Sequence Number=SeqID_42845
MASGNRLPRGVIDYQSNRSLVIDYQLCVIDYTVHIAEEPARTLQRTVEWILPTPTPYRLVEPVQVIEVTSSEEDPEEDPEELPLEPAVDALDFPEGDEDPLPEVDSPEDVMSASEADSTEESGLGGIATSGGSSL

SEQ ID NO: 134531 - protein, 80 aa, Glycine max
  Coding DNA Sequence Number=SeqID_42846
MRGKEQYDMQIYKRIKDTPRAIHYSHQSKHFDHGFANNSSHKYCKENNKQSTKYHMEKECKKNDTKVQKNLEVAAKMEAP

SEQ ID NO: 134532 - protein, 168 aa, Glycine max
  Coding DNA Sequence Number=SeqID_42847
MERSMIDAASGGALGDMTPAEAKNLIKMMASNSQQFSAKNDAIVIRGVHDVAINSSTSSETKKLEAYAANIYNRPPQPQQQNQPQQNNYDLSSNRYNPGWRNHPNLRWSSPSQQQPQQQQPYFQNVSGLSRPYVPPPIQQQQQQQQQQQQPKNSKQLRLLRNLLLKNL

SEQ ID NO: 134533 - protein, 89 aa, Glycine max
  Coding DNA Sequence Number=SeqID_42848
MVRKTMKKLKQKKKRDAVVTSEIVEEKVVSEEQKQKSKKQATNKGKAIINIPFSEAFEQMPTYATFMKDLLTKKKRIVDDEIVDAQPQQ

SEQ ID NO: 134534 - protein, 151 aa, Glycine max
  Coding DNA Sequence Number=SeqID_42849
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=A1FUA3; Match level="QueryCoverage=76%, HitCoverage=9%, E-value=2e-59, Identity=95%"; Hit description=Hpt sensor hybrid histidine kinase precursor
MRSWAVRGLVLLLAVLALPAALAQAVPGPLPLTPLQREYVAAHPSIVVGQYDSGWPPFESLRDGQQVGLGPDYLSLLARQLGMKVEARRYSDWTSVLDAACRGEIDVVMNVGLSADLTRCMVYTAAYGEAPLALVGRPDDLRASDIPEGIL

SEQ ID NO: 134535 - protein, 91 aa, Glycine max
  Coding DNA Sequence Number=SeqID_42850
MESAIKNLEVQVGQLAKQLVERPSSNFTTNTEKNPKEECKAVMTKSRMAIQAEESRVDQKVEGFKHWLADELALEPIDDLVELEEIVEEAE

SEQ ID NO: 134536 - protein, 76 aa, Glycine max
  Coding DNA Sequence Number=SeqID_42851
MAPRKLSSKRSRKDAAVEGTSAAPEFDSHRFRTAEHQQHYEAIKGWSFHRERRIQLRDDEYTDFQEEIAHRRWTSL

SEQ ID NO: 134537 - protein, 82 aa, Glycine max
  Coding DNA Sequence Number=SeqID_42852
MANNNVPAQIPICWKVINGTVATYPFAGERGEAHGCVFQRRKMRGVATNEGISTSHVDKTRALAPTYPPSKRKSDLRSSFFK

SEQ ID NO: 134538 - protein, 325 aa, Glycine max
  Coding DNA Sequence Number=SeqID_42853
  Homolog annotation: Hit_ID=Q84VI1; Match level="QueryCoverage=99%, HitCoverage=40%, E-value=1e-67, Identity=85%"; Hit description =Envelope-like protein
CPNIVQPKCSVPDVKKDVPTSSAPNAETLPSPSEEGSTEEDDQAAEETPAPRAPEPAPGNLINLEEVESDEEPIANRLAPGIAERLQSRKGKSPLKRSGRIKTMAQKKSTPITPATSRRSKVAIPSKKRKEISSSDSDENWEELLVIARRSIGPQSRLLERAEDESAQLGMIATEGFREFSCFNDPSTFLIQIYICLAFVFLPAFPNSLLRFTKSFQTLCFSMATSSKETAASGSPSVPSSSHQEQPELNIQPIQIIPGQASVPEKLVPRRPQGVKIAENPSPATSPREVDTEMDKKIRSIVSSILKDASVPEADEDVPTSSNPN

SEQ ID NO: 134539 - protein, 95 aa, Glycine max
  Coding DNA Sequence Number=SeqID_42854
IDEDQWMYDNIMSEQVDMDDENEQECVAYENGFVAVITRSDTNAGIRGRTSFVLIGCERSGQCRSRKKDFVRKDTESRKRGCPFKLYGKLVVGRQ

SEQ ID NO: 134540 - protein, 15 aa, Glycine max
  Coding DNA Sequence Number=SeqID_42855
MEHASRESCVALPPK

SEQ ID NO: 134541 - protein, 151 aa, Glycine max
  Coding DNA Sequence Number=SeqID_42856
  Gene Ontology: Mol. function=helicase activity; Biological process =viral genome replication
  Homolog annotation: Hit_ID=Q2A9E0; Match level="QueryCoverage=98%, HitCoverage=10%, E-value=2e-21, Identity=40%"; Hit description =Putative uncharacterized protein
MSQYSGIQGHIVSSLSHMLDEHNAHAKSFRMARDILADDQADNIKLQLIAAREKDGRVYDMPNVPKIAVLIVGDFHPGSKRDIIVETQNGELQRIHELHPSYLPLQYPLLFPYGEDGYRADILHRSTSSNKKRKRNCLTMREWFAYRLQYM

SEQ ID NO: 134542 - protein, 72 aa, Glycine max
  Coding DNA Sequence Number=SeqID_42857
MGASGNRLPRGCNQLPGLEMKAAEEWVTGNRLPDEPARTLQRTVEWILPTPTPYRLMEPVQVIEVTSSEGRP

SEQ ID NO: 134543 - protein, 80 aa, Glycine max
  Coding DNA Sequence Number=SeqID_42858
MSVVSSSSLFGGVYLHGTAWLFWYGKGTGLGAEGCRVFCEAAPLVKYITKGLGLPKLLSSTDCIHICCSSPPSSPTSSQP

SEQ ID NO: 134544 - protein, 51 aa, Glycine max
  Coding DNA Sequence Number=SeqID_42859
  Gene Ontology: Mol. function=mannose-6-phosphate isomerase activity; Biological process=carbohydrate metabolic process
  Homolog annotation: Hit_ID=A7PAR8; Match level="QueryCoverage=58%, HitCoverage=7%, E-value=4e-09, Identity=96%"; Hit description =Mannose-6-phosphate isomerase
MATSDNVVRAGLTPKHRDVQSLCSMLTYKQLHGDFFLTDKKEENILGWGYK

SEQ ID NO: 134545 - protein, 114 aa, Glycine max
  Coding DNA Sequence Number=SeqID_42860
MVFEVQTQEHRSLEQMNQWLALNSGFTCDSPQSSASPHQLDLAPYASGPYNAQWNAPGLLHDKHTLRSSRILGEMEVDEPWLRLSRYKIHFLVGVLVYAKGMAFVDNWAVGKEK

SEQ ID NO: 134546 - protein, 157 aa, Glycine max
  Coding DNA Sequence Number=SeqID_42861
MVCNDQADMTGRLLARSFTFDCRIKHYIIVHILLPRSTNLAQASKEDLILLWALQTGRQIDWAHLFNTECIRHYGPMHLYHILTLLPSFFIISKFPWMMNHLSRLKGLFPLVTVLLPTLVIVRTWMVSGSTSKICHRLFPTSVHHLLHHKGTLPLLC

SEQ ID NO: 134547 - protein, 89 aa, Glycine max
  Coding DNA Sequence Number=SeqID_42862
  Subcellular localization annotation: CTP_CleavageSite=10; ConfidenceScore=5.15e-01
MPNNTQRLTSSSAPFVIQGQRVRRWTEIPYGHPRLSLTGRNEFGSFFHSRRPETFKSSDARNSSLLGRDDWVQWQREVSRCPTLSFSKH

SEQ ID NO: 134548 - protein, 76 aa, Glycine max
  Coding DNA Sequence Number=SeqID_42863
MEAEAEGEASVQGDDVEAEEDDDDDSSEYSEVSDSDFEENWDWTEYHDPETFTQTAATNFDFGDEDGHSDELDTPY

SEQ ID NO: 134549 - protein, 376 aa, Glycine max
  Coding DNA Sequence Number=SeqID_42864
  Gene Ontology: Mol. function=transferase activity, transferring glycosyl groups; Cellular component=endoplasmic reticulum membrane; Biological process=GPI anchor biosynthetic process
  Homolog annotation: Hit_ID=A7PFI3; Match level="QueryCoverage=98%, HitCoverage=90%, E-value=1e-112, Identity=48%"; Hit description =Chromosome chr11 scaffold_14, whole genome shotgun sequence
  Pfam annotation: Domain name=Glyco_transf_22; Domain location=1-289; Score=89.0; E_value=1.5e-23; Accession=PF03901.8; Description=Alg9 -like mannosyltransferase family
MVNSVLVQTYFNPDEHWQGPEIAHRIAFGGNKVSEATCTPSSSFRFIGSLPYCILIPHGLWAPRLLQSVFSAVGDLYLYKLAAVLFGDSVAKWTWGLAVAAVACAIRPTSAITWLYVGLLELFKAHDRFKFIFLEVAPIGYVFGGSLFQDPGAWTYLLIRSFHVWHMDSRDYYGTHKWHWYFTQGFPVMIFSHLPFCIAGIIYSKQWKFSGLLAWVLGFYSLLGHKEFRFALPVLPIALMFSGYSLAVIEDPGPEDAMNHLAREALHGKVKSILFLTPCHATPYYSMLHHNLPMQFLDCTPSEEKGVPDESDRFLMDPIPFVSEYAKNKSLPSHVVLFDSEEQKLKNLLISLDYKEDLKEDEMYMSKGLVYSKDIG

SEQ ID NO: 134550 - protein, 516 aa, Glycine max
  Coding DNA Sequence Number=SeqID_42865
  Gene Ontology: Mol. function=diacylglycerol kinase activity; Cellular component=integral to membrane; Biological process=activation of protein kinase C
  Homolog annotation: Hit_ID=B0KYU1; Match level="QueryCoverage=99%, HitCoverage=98%, E-value=0.0, Identity=61%"; Hit description =Diacylglycerol kinase 7
  Pfam annotation: Domain name=DAGK_acc; Domain location=312-489; Score= 44.9; E_value=1.4e-10; Accession=PF00609.10; Description =Diacylglycerol kinase accessory domain
  Pfam annotation: Domain name=DAGK_cat; Domain location=83-262; Score =99.1; E_value=1.4e-26; Accession=PF00781.15; Description =Diacylglycerol kinase catalytic domain (pres
  Pfam module annotation: Pfam domain module=DAGK_acc::DAGK_cat; Domain location=312-489::83-262
MGSQSTTGNTNKIVVRSSFVESFRGCGISGIRIDKEELKKQLTMPQYLRYAMRDSIRLQDPAAGESRYISRAEGEDSAAPPCPMVVFINPRSGGRHGPALKERLQQLMSEEQVFDLLDVKPHEFVRYGLSCLEMLAGLGDSCAKETRERIRVMVLTPHVIYKLCAKLGSRVGFLPVVHTYFKKFVEVAGGDGTVGWVLGCLTELRAQGREPVPPVGIIPLGTGNDLSRSFRWGGSFPFAWRSAIKRTLQRASNGTVNRLDSWRVSLSMPEGTPVDLPHCLKHSEEFSLDQVVGLGFEIEGELPEKVASYEGVYYNYFSIGMDAQVAYGFHHLRNEKPYLASGPISNKIIYSGYSCTQGWFFTPCVSDPGLRGLKNILRMHIKRANSSEWEQIAIPTSVRAIVALNLHSYGSGRNPWGKPKPEYLEKRGFVEADVADGLLEVFGLKQGWHASFVMVELISAKHLAQASAIRLEVRGGQWKNAYMQMDGEPWKQPLSKDFSTYVEIKREPFQSLVISG

SEQ ID NO: 134551 - protein, 518 aa, Glycine max
  Coding DNA Sequence Number=SeqID_42866
  Gene Ontology: Mol. function=extracellular-glutamate-gated ion channel activity; Cellular component=integral to membrane; Biological process=ion transport
  Homolog annotation: Hit_ID=A5AIS1; Match level="QueryCoverage=71%, HitCoverage=41%, E-value=1e-66, Identity=37%"; Hit description =Putative uncharacterized protein
  Pfam annotation: Domain name=Lig_chan; Domain location=167-397; Score= 28.5; E_value=9.7e-13; Accession=PF00060.17; Description=Ligand-gated ion channel
  Pfam annotation: Domain name=SBP_bac_3; Domain location=40-353; Score= -61.5; E_value=0.00065; Accession=PF00497.11; Description=Bacterial extracellular solute-binding proteins, family 3
  Pfam module annotation: Pfam domain module=Lig_chan::SBP_bac_3; Domain location=167-397::40-353
MAKCFSSLLSWFLIFLFVLLHTQTGYGSNATSKSEAIINLRVGVPLKNGFPQFVNVVWDSHEKKYNVSGYCIDVFYAVVNILPFKVSLDIQPFEVESRDNSGAGSYDSLLQQIPAKYDVVVGDITILANRSNMVDFTLPYTGSGFKMLVTVQHGRQQTMWIFVKPFSWDLWLSIVIISTFIGVSILVMERNVNAPTDQEGLPNRKKLSPATILWTSSGQELLEICVNDMASIGVRAHAKLHCKLDFYIDFGSQFKFDTSKLRPYSNSAEYHNALKTGSQRGGVAAIFDEVPYLKVFLQEYGSNYIMAGSRYRNDGFGFAFPLNSNLTTHFSRAILKVTESELMNEIERKYFGKKDIEEDSSAEISSAAPSLNFHSFAGLFLITGISTLLALMVSETVIWRRVILMAKAISQSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 134552 - protein, 396 aa, Glycine max
  Coding DNA Sequence Number=SeqID_42867
MGKEIRDLADRKKDTLILRKTEAGKAVKRVYSTGSNSTRAPQRQGYRDAPHPSQFRFVSRTGLLSWAGFPHKPFAMRIESSSQIFGSSFSLCIAAPSLPDPSHTTASRLVHPTPQSHSNTTCPTLCSRPAPLRHQATTKKPVTTYALAKRLGWVVKGGELRAAKIDVEASLRLVVVLVIVDGGRGERGEEYLLGLDFGGVHEFGPEIGVRDEPGGGVGVVGGEDVGGSAIVGGDDEPERGGGGGFDDGFRGIEEGLHGNALVALREWVGGVDVGVARDAKGGRVSLARDRSGCLLAHLTHPHALVARREFIRAVNLGIARDAEKRGIEVAEKRRRSQLTGVAWLLRRHTPAAPESLQASSFNSHRKALLKNAANGTNPLIARSGRKRIRDLNVFGE

SEQ ID NO: 134553 - protein, 792 aa, Glycine max
  Coding DNA Sequence Number=SeqID_42868
  Gene Ontology: Mol. function=pyridoxal phosphate binding; Cellular component=cytoplasm; Biological process=biotin biosynthetic process
  Homolog annotation: Hit_ID=A7Q6J5; Match level="QueryCoverage=95%, HitCoverage=81%, E-value=0.0, Identity=54%"; Hit description =Chromosome chr11 scaffold_56, whole genome shotgun sequence
  Pfam annotation: Domain name=Aminotran_3; Domain location=312-768; Score=-100.9; E_value=2.7e-08; Accession=PF00202.12; Description =Aminotransferase class-III
MFRFPSVLLSRRLHRRELSSSTTSHPPSLPLSHPIYLIWGSNTGVGKTLVSAGIAAAFLLSSPTPSQFHYLKPLQTGFPSDSDSRFVFNKLRQLSLIRNPHIPLSASHRVINVSPAVTASNPLAGEEGVGPPPELLCKTLYAWEEAVSPHLAAEREGLVVKDSAVLETLGECLEDVAECGAGKERSEVLCVVETAGGVASPGPSGSLQCDLYRPFRIPAVLVGDGRLGGISGTISAYESLKLRGYDVVAVVFEDHGLLNEGPLMSYMRNKVPVLVLPPIPKDPLNDLMEWDIIWWPFTQHKLVPDGGVTVIDSRCGENFSIFKVQKTEVIAPQFDACASWWTQGPDAIMQTELAREMGYAAARFGHVMFPENVHEPALNCAELLLQGVGKGWASRTYFSDNGSTAIEIALKMAFRKFSVDHGLIVHCHEDTTNERSTELMVLALQRSYHGDTLGAMEAQAPSSYTGFLQQPWYTGRGLFLDPPSVFMHNSTWNVSIPEGYHLESLKGKSITFASPDEIFHKGRDKSELATVYSSYISKVLSGFRGGSSPCEGMGEGCCTQPYPCICKEAVSRFEPMTNKSPRHNFTAAPGLALIPHGSLDILINLFSPFLDIDHLIWGLSCYVVIQGAGGMHMVDPLFQRVLVNECRSRKIPVIFDEVFTGFWRLGVETAVELIHCVPDIACFGKLLTGGIIPLAVTLATNAVFDSFIGDSKGSEERRGHVVSCESIGVFVHWEVQTPLKYYKLGTLKALLHGHSYSAHAMGCAAAVKSIQWFKDPCSNPNITSEGRLLREV

SEQ ID NO: 134554 - protein, 271 aa, Glycine max
  Coding DNA Sequence Number=SeqID_42869
  Gene Ontology: Mol. function=prephenate dehydrogenase (NADP+) activity; Cellular component=cytoplasm; Biological process=tyrosine biosynthetic process
  Homolog annotation: Hit_ID=Q944B6; Match level="QueryCoverage=64%, HitCoverage=75%, E-value=4e-56, Identity=57%"; Hit description =Arogenate dehydrogenase 1, chloroplast precursor
MLGRLCFAFQELRKQLLKGVHAVVREHLFENPVTARVQSLQEDAAPYHRDVSEYKSSLSSHYSDNNSKLKIAIVCFGNLKLERSTLFVDVLSVKEFHRNLFLQHLPPDFDVLCTHPMFGPQSAKDGWSGFLFVFDKVRIGTDEARTSRCDWCLNIFSSEGCQLVETPCAEHDRQAAGSQFITPTVGRILEKLDFLEPTKIDTIGFESLLNLMDNTVRDSFDLYFDLFLFNKNSRQQLERFHLAFESLQNQLFDHVLDNLKQVLKLEEESHD

SEQ ID NO: 134555 - protein, 186 aa, Glycine max
  Coding DNA Sequence Number=SeqID_42870
  Homolog annotation: Hit_ID=A2ZZY7; Match level="QueryCoverage=38%, HitCoverage=12%, E-value=2e-35, Identity=97%"; Hit description =Putative uncharacterized protein
  Pfam annotation: Domain name=Yip1; Domain location=108-186; Score= -43.2; E_value=0.098; Accession=PF04893.8; Description=Yip1 domain
  Subcellular localization annotation: CTP_CleavageSite=42; ConfidenceScore=5.02e-01
MSHSDTIPLHPSSQSDIDEIENLINASVHQSVPSARPPSPPRASIPVSVSVSTAPSPFISSNLPPPPPLPKSSVSAVTPSPPPPRPGIATSGFGPAPNTLTEPVWDTVKRDLSRIVSNLKLVVFPNPYREDPGKALRDWDLWGPFFFIVFLGLTLSWSASVKKVLTLLAVSSAEISLVVNNPRLET

SEQ ID NO: 134556 - protein, 262 aa, Glycine max
  Coding DNA Sequence Number=SeqID_42871
  Gene Ontology: Mol. function=hydrolase activity; Cellular component =cellular_component; Biological process=metabolic process
  Homolog annotation: Hit_ID=A7Q6E1; Match level="QueryCoverage=61%, HitCoverage=90%, E-value=5e-65, Identity=64%"; Hit description =Chromosome chr11 scaffold_56, whole genome shotgun sequence
MTSFPPMTTLPSLDPFILVLPHPPSSVCEVKLSREEEKNKKGRVWTRAECGRKKRKRGRTESTEVVDRRLGKKVALASSSRNGPSLCCRLRQKANHPHTERFYTQVQEIILARYNKTFDWSLKAKMMGKKAIESARIFVEETGISDSLSAEQFLVEREDMLEKLFPTSEPMPEVKQGKPSPDGFLAAAKRFEGGPVDPSNILVFEDAPAGVLAAKNAGMSVVMVPDPRLDKSFLDTADQVLNSLLDFNPSEWGLPPFDDNRD

SEQ ID NO: 134557 - protein, 697 aa, Glycine max
  Coding DNA Sequence Number=SeqID_42872
  Gene Ontology: Mol. function=electron carrier activity; Cellular component=endoplasmic reticulum membrane; Biological process =electron transport
  Homolog annotation: Hit_ID=O04434; Match level="QueryCoverage=97%, HitCoverage=98%, E-value=0.0, Identity=74%"; Hit description =Putative NADPH-cytochrome P450 reductase
  Pfam annotation: Domain name=FAD_binding_1; Domain location=300-510; Score=288.5; E_value=1.4e-83; Accession=PF00667.11; Description=FAD binding domain
  Pfam annotation: Domain name=Flavodoxin_1; Domain location=101-245; Score=181.2; E_value=2.6e-51; Accession=PF00258.16; Description =Flavodoxin
  Pfam annotation: Domain name=NAD_binding_1; Domain location=546-658; Score=125.6; E_value=1.5e-34; Accession=PF00175.12; Description =Oxidoreductase NAD-binding domain
  Pfam module annotation: Pfam domain module=FAD_binding_1::Flavodoxin _1::NAD_binding_1; Domain location=300-510::101-245::546-658
  Subcellular localization annotation: CTP_CleavageSite=54; ConfidenceScore=5.53e-01
MQDSGSMKISPLDLMSAIIKGKLDPSNVSSSSSNAAAAVLLENRQFLMLLTTSVAVLVGCFVVFIWRRSSSPKAKPLEPPKRVIEKLPEIEVDDGTKKVTIFFGTQTGTAEGFAKAIAEEAKARYDKATFRVVDMDDYAADDDEYEERFKKETHALFFLATYGDGEPTDNAARFYKWFTEGGEKGEGWLENLHYGVFGLGNRQYEHFNKVAKVVDDMLAEQGGKRLVPVGLGDDDQCIEDDFTAWKEELWPALDDLLRDEDDTTVSTPYTAAVLEYRVVIHDPLEASVDEKKWHNVNGHAIVDAQHPVRANVAVRKELHTPASDRSCTHLEFDISGTGVTYETGDHVGVYCENLSETVEEAIRLIGLSPDTYFSIHTDDEDGKPLGGSSLPPTFPPCTLRKALAQYADVLSSPKKSALLALAAHASDPSEADRLRHLASPAGKDEYSEWVITSQRSLLEVMAEFPSAKPPIGVFFAAVAPRLQPRFYSISSSPSDWEETSKNEDQVGEALLNNSVPLEKSQDCSWAPIFVRTSNFRLPADNKVPIIMIGPGTGLAPFRGFLQERLALKGGGAELGPSVLFFGCRNRQMDYIYEDELNHFVNTGALSELILAFSREGPTKEYVQHKMMEKASEIWSMISQGAYIYVCGDAKGMARDVHRALHTILQEQVVSSGKAQGFLSSVILFTMNFPFPPNLLLI

SEQ ID NO: 134558 - protein, 64 aa, Glycine max
  Coding DNA Sequence Number=SeqID_42873
MGKGRKGYMALKLDMLKAYDNEEWVLLEMVLRAMGLPTLIGRSKKDIFQYVKSRVWKKVKGRNQ

SEQ ID NO: 134559 - protein, 360 aa, Glycine max
  Coding DNA Sequence Number=SeqID_42874
  Gene Ontology: Mol. function=prenyltransferase activity; Cellular component=integral to membrane; Biological process=bacteriochlorophyl l biosynthetic process
  Homolog annotation: Hit_ID=Q58FG4; Match level="QueryCoverage=61%, HitCoverage=61%, E-value=1e-98, Identity=80%"; Hit description =Homogentisate phytylprenyltransferase
  Pfam annotation: Domain name=UbiA; Domain location=96-337; Score= -11.4; E_value=0.001; Accession=PF01040.9; Description=UbiA prenyltransferase family
MAVATCHEIANGSCNLPFGLQTLQPAAKACTLELASLTGGSIFQLYRQWQGRFVPVHVQVAAGPCTDDQKCELLYHSLEIEITCSRVRTCIGVEALSIISVSLLAVEKISDISPLFFTGVLEAVVAALFMNIYIVGLNQLSDVEIDKINKPYLPLASGEYSFETGVTIVASFSILVPLLRWKRFAVLAAMCILAVRAVIVQLAFFLHIQTHVYKRPPVFSRSLIFATAFMSFFSVVIALFKDIPDIEGDKVFGIQSFSVRLGQKPVFWTCVILLEIAYGVALLVGAASPCLWSKIVTVQILKIGFPLVGKGEATFIYPPRSPLGGSLVPFSNCLFHNCLLNYGTEVLLHCCKFSIEFTGV

SEQ ID NO: 134560 - protein, 492 aa, Glycine max
  Coding DNA Sequence Number=SeqID_42875
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q4VCM0; Match level="QueryCoverage=99%, HitCoverage=51%, E-value=0.0, Identity=83%"; Hit description=Plasma membrane H+ ATPase
  Pfam annotation: Domain name=Cation_ATPase_N; Domain location=1-74; Score=102.7; E_value=1.2e-27; Accession=PF00690.17; Description =Cation transporterATPase, N-terminus
  Pfam annotation: Domain name=E1-E2_ATPase; Domain location=86-307; Score=300.2; E_value=3.9e-87; Accession=PF00122.11; Description=E1 -E2 ATPase
  Pfam module annotation: Pfam domain module=Cation_ATPase_N::E1-E2 _ATPase; Domain location=1-74::86-307
MVERIPIEEVFQQLKCTREGLSSDEGANRLQIFGPNKLEEKKESKFLKFLGFMWNPLSWVMEAAAVMAIALANGDGKPPDWQDFVGIVCLLVINSTISFIEENNAGNAAAALMAGLAPKTKVLRDGKWTEEEAAILVPGDIISIKLGDIIPADARLLEGDPLKVDQSALTGESLPVTRGPGEEVFSGSTCKQGEIEAVVIATGVHTFFGKAAHLVDSTNQVGHFQKVLTAIGNFCICSIAVGMLAEIIVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGVEKDHVILLAARASRTENQDAIDAAIVGMLADPKEARAGVREVHFLPFNPVDKRTALTYIDADGNWHRASKGAPEQIMTLCNLRDDAKRKVHAIIDKFAERGLRSLAVARQEVPEKTKESAGAPWQFVGLLSLFDPPRHDSAETIPRALHLG

SEQ ID NO: 134561 - protein, 150 aa, Glycine max
  Coding DNA Sequence Number=SeqID_42876
  Gene Ontology: Mol. function=molecular_function; Cellular component =nucleus; Biological process=biological_process
  Homolog annotation: Hit_ID=A7QI55; Match level="QueryCoverage=49%, HitCoverage=14%, E-value=4e-22, Identity=70%"; Hit description =Chromosome chr17 scaffold_101, whole genome shotgun sequence
MKIKSCKKLQNASKNSCLQMAALEQMKVDKNVMKLAEDQKLCFAILMELHDLIILSSSFEASQCKILKSSGKSYLAKILHDLEVENGGDAPRIHSMDDYFMTEVGKVEDGEASKSSSSSGNKKPVTKKVMKFCYEPEMEEDVEHNVYSKK

SEQ ID NO: 134562 - protein, 265 aa, Glycine max
  Coding DNA Sequence Number=SeqID_42877
  Homolog annotation: Hit_ID=A2Q3A0; Match level="QueryCoverage=100%, HitCoverage=100%, E-value=3e-64, Identity=53%"; Hit description =Putative uncharacterized protein
MGTKIEYSINLLATLVDRNNLAVGGVDVWEHFQNKHQRTGINKLQGPMDRMLDRNNIQYIKKTMQRHEDIFKHQVRELHRVYSVQKMLMDDLKNEIRQQQIWNHMNDINVSHPHSIKQQHQTTQISHQPDFHVQNLRGRGFDLERPAEEDIFIRARGFDEGEAGPSSHTAFQRCKTSTSGYDEEMEVDLTLSIGGSQVKNSHLPQLACSNSTNNGKIRKLNSSASFKSDRTGECSDPTTPMSSSTVTFTQERKGPHWLSQGLKLK

SEQ ID NO: 134563 - protein, 62 aa, Glycine max
  Coding DNA Sequence Number=SeqID_42878
MWERRWNNEHRQERDVARKTGEWLVMEEADLRIVRIRREKEINRGKLELPANVAIAIAMNAY

SEQ ID NO: 134564 - protein, 230 aa, Glycine max
  Coding DNA Sequence Number=SeqID_42879
  Gene Ontology: Mol. function=binding
  Homolog annotation: Hit_ID=A7PWT3; Match level="QueryCoverage=64%, HitCoverage=28%, E-value=1e-27, Identity=43%"; Hit description =Chromosome chr19 scaffold_35, whole genome shotgun sequence
  Subcellular localization annotation: CTP_CleavageSite=56; ConfidenceScore=5.00e-01
MASDVAVKVISFIPNSLLQFHMLDLVYCLSSLLSSHQVEVATPCANALNLVISNLSATSEKAVMEALKETETSMRIVGNRKDFAEGAKKIEYFEETTLLLSTILWRWPPSRLPVGNDVILMKVLANIHTRTDSSIKLTLLKLYTSLCIKLFPYYHPFSTRKRIEDGEVFPQMFVQAMGKSDPHAVRIEGFRLAQCLLRSQENCLKVVGLCGEALVDAIICGMKETGLSSK

SEQ ID NO: 134565 - protein, 148 aa, Glycine max
  Coding DNA Sequence Number=SeqID_42880
  Gene Ontology: Mol. function=binding
  Homolog annotation: Hit_ID=Q593S0; Match level="QueryCoverage=62%, HitCoverage=43%, E-value=6e-16, Identity=45%"; Hit description =Expressed protein
MLDLVYFLSSLLSSHQVEGATPCAIALNLVISNLSATSEKAVMEALKETETSMRIVGNRKDFAEGAKKIEYFEETTLLLSTILWCWPPSRFPVARKLIEDGEVFPQMFVLAQCLLRSQANCLKVVGLCGEALVDAIICGMKETGLSSK

SEQ ID NO: 134566 - protein, 105 aa, Glycine max
  Coding DNA Sequence Number=SeqID_42881
MGNRDAHHGEILESNYKRHVVADFENTIAGSKIARNRKANVDSQKKLIKTPAMVCGAAVNQRTRSGRLHLWRKSDESERVAVDPLIDMCDSLSPEATKRCHANNM

SEQ ID NO: 134567 - protein, 117 aa, Glycine max
  Coding DNA Sequence Number=SeqID_42882
MKREKHASYSSHNSFKSLSEELRDYYEGRHRSHLRPHSHRREKESLKRLTLTSHTSMGRTIGHITSQCPTKKNMIMRGQDIYSSQDEATTSPSLVKVKKQKGKNLVKKSTPKKKDNL

SEQ ID NO: 134568 - protein, 73 aa, Glycine max
  Coding DNA Sequence Number=SeqID_42883
MASSRGGNGRGIRGCDSEWRLLSLAEIAYSGWSFALLTLLRNAEEEPQLLVVFVVTATVPAAVLEEEHMACLD

SEQ ID NO: 134569 - protein, 83 aa, Glycine max
  Coding DNA Sequence Number=SeqID_42884
MKQKGKRKKHREGRHVIVTKYKSFVKSKRIFWKQGTDAKSLFSGITEIRMDEFIELMKEHNLESWVYLCKFPTIVSQCHKRDA

SEQ ID NO: 134570 - protein, 88 aa, Glycine max
  Coding DNA Sequence Number=SeqID_42885
MTLLLSNILPSDRSADLLLRKNRTHKDTQWTRRSPTGPWDFQLWGSAHKTPSGPRGAQQGPRVSSSGYGPLSVLQGARPPQQVHAIVT

SEQ ID NO: 134571 - protein, 87 aa, Glycine max
  Coding DNA Sequence Number=SeqID_42886
MKGNQQRVESPTVATYPSAGGRRETRGMRVPRKEYARSRHQRLFEENVGKTGKDAIYELLSEKVRELYLRTGKVLAPHTSVPRDGSL

SEQ ID NO: 134572 - protein, 46 aa, Glycine max
  Coding DNA Sequence Number=SeqID_42887
IPLGVILAILDPVLIAVLKSGHAVIAGKSIVLKPPTQLGATDIKFQ

SEQ ID NO: 134573 - protein, 157 aa, Glycine max
  Coding DNA Sequence Number=SeqID_42888
MANQEEWVPFMDVLALLIFGVVLFPNVDGLVDLATIDAFLAYHHSKESPVVAVLADLFDTFDRRCKKNWLAKLKIINEENFEAPEEDEEVRALKTELGKARLAKEKFKLVATDVRKECAGLREENAATAKALEQETKRARKEEHGRDKFRGALWGNN

SEQ ID NO: 134574 - protein, 109 aa, Glycine max
  Coding DNA Sequence Number=SeqID_42889
  Subcellular localization annotation: CTP_CleavageSite=40; ConfidenceScore=5.68e-01
MPASLSAARRSTALPSSNSAFSFSRLSDSPPGVRNRQEIRGTYLTARKWNQSRLLQDSFDLEVGRPPYPTLPKVEQFETPIPNLKKLVHRLKPVNLSKEPTLRQKKGIL

SEQ ID NO: 134575 - protein, 242 aa, Glycine max
  Coding DNA Sequence Number=SeqID_42890
MDEKKKKQLEEATKSKSINIVIDPPSPIRRHEKWKMARTKKTGQMTSEAAKEIVGKIVSQNSFVAHGRQDVLTAAIGRPEHPGRVRAARVDVMIKQYFGLTPKTSRTSSSMAFEDLEQKIKDQLEESITEKGLALPPEPEVGPSAARVSTKERNDPDTGNSENYGLYVEENHPCLIALGRLYEGSTNIHNILLRHDQVKVGVEEVRDADAPFPVPTQEVQLVGQTLTPSLLGRHILSSVYQN

SEQ ID NO: 134576 - protein, 163 aa, Glycine max
  Coding DNA Sequence Number=SeqID_42891
MFRCFDDHGRFLVALQPERVVRQFGCIQTIPLPSVTGSLSYEDIDNRWMHFGDLVAPVGEICVVPGQVSANYMEWFFQISHPFVMPTQEGDDPRQPAAPDVDAYVEPHVPEVSVATDLPRHSMVACEGYEAIAERLERVLNLRMVVAGTELHDEIMEDCLRIA

SEQ ID NO: 134577 - protein, 171 aa, Glycine max
  Coding DNA Sequence Number=SeqID_42892
NLTGCSVGTKQVVVQATRDRCTICGGAHEFECCIPNEEQIAHEVNYMGNQPRGNFHTSGYPGFQNNQQYQQQRQWQNHPSNQFNIDQGGSSTRPQQHMPSLYDQTTKLEETLAQFMKVSMSNQKSIESAIKNLEVQLVDELALEPVDDLIELEEIVEEAEGDEEGEIPIRD

SEQ ID NO: 134578 - protein, 117 aa, Glycine max
  Coding DNA Sequence Number=SeqID_42893
  Subcellular localization annotation: CTP_CleavageSite=52; ConfidenceScore=5.19e-01
MKLGGRQRYLSGYPYKHSFAIRQTQSPKSGGSRGYRMVIRTFHQPQANEPVNAQRLTSSSAPFVIQGQQVRWQAEIPYGRLHLSSTKLFTLVVRRHSSPMMHEILLCWAGTIKFDSM

SEQ ID NO: 134579 - protein, 163 aa, Glycine max
  Coding DNA Sequence Number=SeqID_42894
MTGRLLADSLAFESRILHYLIVRILLPRSSNLAQALRLNAPLPYPHLVTLFLQHFNIPLDFEAYVPIKRSFLIGAAVIASFGYRKEHDGSWVKKGAQPIDKEGHLPVGEDSSLLQRILDRFDALELQMDMQFNEMDSRITKVKGDVSHIRTCFDLPPPPRPSS

SEQ ID NO: 134580 - protein, 171 aa, Glycine max
  Coding DNA Sequence Number=SeqID_42895
MAASDIAILRVRAHVPTKKILLELTSQDALLAHNKLLSKQLEALTETLWCAIYGGAHNYGCCVPNEEPTHEVNYMGNQPRQNFNGQWRNHPRNQFSKVQGGPSNRPQQQGPSLYDRTTKLEETLAQFMQADEGRPEEKVEGYKQQSAAKPALEPVSDFVELEEFVEDEDDQ

SEQ ID NO: 134581 - protein, 111 aa, Glycine max
  Coding DNA Sequence Number=SeqID_42896
  Homolog annotation: Hit_ID=Q6WAY6; Match level="QueryCoverage=39%, HitCoverage=7%, E-value=3e-11, Identity=68%"; Hit description =Putative uncharacterized protein
  Subcellular localization annotation: CTP_CleavageSite=63; ConfidenceScore=5.03e-01
MGWLEYQENFGGKSKNLGSFTPFSPRGEACLPARKSPLMHRERRGKEGRTRVLISCRGFPNVPLMGTRGCISYNPVLAIRQLGYPMRGAPLEDELTPVISRGFNKTHMETL

SEQ ID NO: 134582 - protein, 160 aa, Glycine max
  Coding DNA Sequence Number=SeqID_42897
MQAFHKGLQIDWAHLVRYRMHKALRLNSPLPYPHLVTLFLQHFNIPLDSEPYVPIKRSFLIGASVIASFGYIKEHDDSWVKKGARNMGEEGHEGEDSSLLSKILERFDGLQTFVGERFDTLELQVDMRFNEMESRMTKVEEDVSYIRSSFDLPPPPPPSS

SEQ ID NO: 134583 - protein, 71 aa, Glycine max
  Coding DNA Sequence Number=SeqID_42898
LQVVPSVVRLMKQANVFPLKKTHKKFIIWEINKDKGILKVDFQASSRVLIINKDSGGRTWVINSTKTKVDP

SEQ ID NO: 134584 - protein, 137 aa, Glycine max
  Coding DNA Sequence Number=SeqID_42899
  Homolog annotation: Hit_ID=A0PAV3; Match level="QueryCoverage=27%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGELELHRGGGRSRTSGSPGLQEFDVLSEPQEIVAHHTAHQLHLPLWETRSGQRMRRGQGSSSQQCFSGLHSPPLNKAPLAWARG

SEQ ID NO: 134585 - protein, 102 aa, Glycine max
  Coding DNA Sequence Number=SeqID_42900
AHCHHLGRPIQLGHWEWSAIYNIGFASRLSTTVGSLSQQGQGSAPFVCPTLEQFGAEVAWSGDWPNAQAGKEPAGSPGETDESRMDEDMIDLLDFLRGSGAA

SEQ ID NO: 134586 - protein, 75 aa, Glycine max
  Coding DNA Sequence Number=SeqID_42901
MALARDFRRETTHGAIWFRIGSKIPLAIYTLDRSKILGCIRNTRMCTYAIFDSQSALSMHENGPEEAGLKEIQEG

SEQ ID NO: 134587 - protein, 177 aa, Glycine max
  Coding DNA Sequence Number=SeqID_42902
  Homolog annotation: Hit_ID=Q2HW90; Match level="QueryCoverage=90%, HitCoverage=37%, E-value=5e-13, Identity=31%"; Hit description =Putative uncharacterized protein
MGSSQKPSLKKRFYQVKIKSLEVTSLREVGQLMGQLQHQAFRKAYGKIWDLARVEVSMEPIASLSQYYDQPLRCFTFEDFQLVLTVKEFEEILGCPLGGRKPYLFSSSIPPRQELPRKGQRPWKIKANGLSFIDILALLIFGVVLFPNMEGLVDLAVIDTFLAFHHGKESPVVAILA

SEQ ID NO: 134588 - protein, 235 aa, Glycine max
  Coding DNA Sequence Number=SeqID_42903
MKREKHASYSSHNSCKSLSEELRDYYEGRHRSHLRPHSHRREKERNPQEANINLPYFHGKDNVEANLDWEIRVEQQLKKKSTSKPYGSHSYAKKDQGQGILGVTPSKPKDDKGKTIEKQAPKASMQEKTSSINESEKAKGEKSSAEIYPQEKGQPSVVKEKCKETNIKETSPLRQPPHLLLCKKTLISMPHLLGLRIIPQVNELLDRGLVRKELKSLCFVGSQNRYYEAPNSYDR

SEQ ID NO: 134589 - protein, 179 aa, Glycine max
  Coding DNA Sequence Number=SeqID_42904
MVGDGDNGGVYHQLDRSQRLLLDAMTTQMQHLLNRNNEELYRRIAKSSLFILKPLSPREVCDDQIRMREKREQEKENSEAPQRNRKKKSDTPEGKSDTHKREMKVQIAKKNESYAKQAHKKRKEVVLEPGDDPGHLRTNVFQEEGNDENHEIGQIQAKDPSGEGRRPKWRRTKPSSGEG

SEQ ID NO: 134590 - protein, 152 aa, Glycine max
  Coding DNA Sequence Number=SeqID_42905
  Pfam annotation: Domain name=zf-CCHC; Domain location=35-52; Score =25.3; E_value=0.00022; Accession=PF00098.14; Description=Zinc knuckle
MDLNIEENLTRHQRTIAMGFAGGSGSKPSTFPTQITCYKCGKSGHISLNCAGKGVTYFNYGLKGHIQRDYPYPKKEQNGGGLNDQTGHPKATGRVFTLNGAEVSKSKDLIQVFDDSGVSKDMMFISANQVVTSLKEDAQVYMMYLGGVLLRF

SEQ ID NO: 134591 - protein, 217 aa, Glycine max
  Coding DNA Sequence Number=SeqID_42906
MPFCATEFINPQKKKLVTSCTICGEAHETGQCIPIEENTQEFHYMGNQQRQGYTQGGFSGFQQGAYNQQGQWRSHPDNQFNKDQGGPSNRPIQQGPNIFQRTTKLEETLTQFMQITMSNHKSIESALKNLEVQVGQLAKQIADKSSNSFVANTKKNPKEECKAMMTRSKRFMEAEDRDSVVSKKKAAEKKGTDEKKDDVRGERNQEKEKQIMVKKKN

SEQ ID NO: 134592 - protein, 163 aa, Glycine max
  Coding DNA Sequence Number=SeqID_42907
VKDWGTLWQELFPEFEPKLRCGGVYVIQNVKVVDTHSDYKVNAIKYLVYFVKTTSVKEVDRHEIPPNVHVITSFADIISGVAKLDTLVDIVGVIAEVIERKTVNPAYRVTVKLRDNSHVEIIMTVWEEYVLQLNDAIEKNHFGQKPLVVMLTLAKIKEPKGQY

SEQ ID NO: 134593 - protein, 188 aa, Glycine max
  Coding DNA Sequence Number=SeqID_42908
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=79%, HitCoverage=23%, E-value=2e-46, Identity=56%"; Hit description =Chromosome chr9 scaffold_7, whole genome shotgun sequence
MHDLYTVLSSSDLPHGNLKSNNVLLGQDNEPMLVDYGFSHMAPEAAQQGQVSRSCDVYCLGVVIIAILTGRFPSQYLSNGKGGADVVQWVETAISEGRELEVLDPEIAGSRNWLGEMEQLLHIGAACTESNPQWRLDMAEAVRRIMEIKFEGGHESRSLANSHHGEQSQRRHGTNSFESWDDIEYGSS

SEQ ID NO: 134594 - protein, 60 aa, Glycine max
  Coding DNA Sequence Number=SeqID_42909
MAVVLEAGKNLSKNTLLRSSQLVMDLGARHVMSFKLGSSPAAYFGRKEQAAMLLIDEVDI

SEQ ID NO: 134595 - protein, 180 aa, Glycine max
  Coding DNA Sequence Number=SeqID_42910
  Gene Ontology: Mol. function=phosphoprotein phosphatase activity; Biological process=intracellular signaling cascade
  Homolog annotation: Hit_ID=A5AWR0; Match level="QueryCoverage=70%, HitCoverage=15%, E-value=9e-21, Identity=40%"; Hit description =Putative uncharacterized protein
MFVLLGLRVDGAPLIGQTNFDWAELCEELLGVRPQEGELQGSVVKLSWLANHFSQINNYDGNVEQLQRFTRAWILRFIGRVLFVDKSSNKVSLREMCSAIDYKIKSIRGLCILIQMWTWERCTTLAPKRTPPVIENKPLRHWWLRRGNQHIGNNDLIVFRRKLDIMKRHLLYVDLTNAVI

SEQ ID NO: 134596 - protein, 70 aa, Glycine max
  Coding DNA Sequence Number=SeqID_42911
MKEGIGHILDLTPIGEKMKESLNINLSYFHGKDNVEAYLDWEIRVEQKLKRKSTLKSYGSHSYPNNDQGL

SEQ ID NO: 134597 - protein, 192 aa, Glycine max
  Coding DNA Sequence Number=SeqID_42912
VQRVASDSLVFERLRPVINLAYIRKNCWNPADLTVTIRGARRARARPAEAPSTSAAPPLTRTLAAPSTHLLQTFNVLKPCFKAYIRGRLLYYEREDESSETSTLESLIRRKRVVETQEAATTSKKSLEASSEPSKPVANTTSIQQAADPSTPEDQTTPILSPNTSPSATPVLRLTDEEDVQTPDTQDRSQDF

SEQ ID NO: 134598 - protein, 207 aa, Glycine max
  Coding DNA Sequence Number=SeqID_42913
MSPFLMRDFGAQNSKAIQRIHKAWETPLRKDQELRGIRNGAIGGYHEWLKLKVVSEESFEAPEEDEEVQALKSELGKAKLAKEKFKLAATHIRKECAGLREENATTARALEQETKRARKEEYGRNKFRGALWGSNNELKLRREERDQSRAHSMVLKEELVACSRSKRSLSQRLCETETNMLAIVAKYQEELGLAAAHEHRITDEYAQ

SEQ ID NO: 134599 - protein, 88 aa, Glycine max
  Coding DNA Sequence Number=SeqID_42914
MAGVGGGGDEYHQLDGAQRLLVDAMNAQMQRLLDRTTEEVYGRLEALENQANQNARRNIDGNRGNNGGNDGPRQNQVEGVKLNVPPFK

SEQ ID NO: 134600 - protein, 139 aa, Glycine max
  Coding DNA Sequence Number=SeqID_42915
MLDVWNLPDGEFILVEVDHWGNPMGWEGKTLLNAIGSLVMRHQCAPINFLSWKDMPKDYITDMEFRQFKYELKSKGYDESKTKEEMIAHIPDPRVDPSQYRDLKINNINQRSRSKYEDLHCMGTNNLPRRIHEMVCGIL

SEQ ID NO: 134601 - protein, 118 aa, Glycine max
  Coding DNA Sequence Number=SeqID_42916
MHRSPTGTLVPLDLEIEATLRRNKAEKRRKLLQDRTVASILEEENHFSDSSSSDSPLSRESTNQLSEIATMVDEHDQRTTLEDYSRLPNEDPYAHLATFIEICNTVKIVGVPDEAIRL

SEQ ID NO: 134602 - protein, 214 aa, Glycine max
  Coding DNA Sequence Number=SeqID_42917
  Homolog annotation: Hit_ID=Q84VH5; Match level="QueryCoverage=90%, HitCoverage=28%, E-value=1e-59, Identity=64%"; Hit description =Envelope-like protein
  Subcellular localization annotation: CTP_CleavageSite=66; ConfidenceScore=5.28e-01
PFASIATHHHDHHQNIKANCIYIVVVIPSSAFPNSSQKFTKPFQKLCFSMATAPKETSAPGSPSVPSSAKAPSNQEQPEFHIQPIQMIPGQAPVPEKLVPKRQQGVKTSENPSLATSPREVDTEMDKKIRSIVSSILKNASVPEADEDVPTSSTPNVSVPDAEKDVPTSSTPNAEALPSPSEEESTEEEDQATEETPAPRAPEPAPGDLIDLEE

SEQ ID NO: 134603 - protein, 79 aa, Glycine max
  Coding DNA Sequence Number=SeqID_42918
MSGIIREHRGIPHGDLVGYRSRIDHMESHQFSWVPYRGFEDHLPRHANRDMDIWSAYTVIICFPIVEQHTIWTTSRYPC

SEQ ID NO: 134604 - protein, 72 aa, Glycine max
  Coding DNA Sequence Number=SeqID_42919
MRTCSPLKARACSPLQARMCSPLMARTYGPLKIDCPFEKGDNSCNPILSFANLSGNSLRVYVLFDLVMTILE

SEQ ID NO: 134605 - protein, 196 aa, Glycine max
  Coding DNA Sequence Number=SeqID_42920
  Homolog annotation: Hit_ID=A5B5G7; Match level="QueryCoverage=90%, HitCoverage=12%, E-value=6e-07, Identity=27%"; Hit description =Putative uncharacterized protein
MASKKRKAPSTPIQTRFDRSRFTSLEAWERYTNIVVLRKLLPERNVVVYYTEFDEFKEELERRHWDEKLTGFSDSSIDIDIVKEFYANLYDPEYKSPKQVRVRGHLVKFDEDTLNTFLKTPIVLEEGENLCTYFRFALLRPDPQELAAKLCIPRRGFELNADGQPLKILRKNLTTLAQTWKVLRIHFVCSLLYDMR

SEQ ID NO: 134606 - protein, 16 aa, Glycine max
  Coding DNA Sequence Number=SeqID_42921
MEEVEKEILETFRKVE

SEQ ID NO: 134607 - protein, 81 aa, Glycine max
  Coding DNA Sequence Number=SeqID_42922
  Subcellular localization annotation: CTP_CleavageSite=32; ConfidenceScore=5.15e-01
MGKQKNSQAVSPLKSFVYGKGKNQKNSQTVILNSLKREKGDTKEFKRLVLHSFGKGRRETQKEFRRLFQSGQENHWKRYNL

SEQ ID NO: 134608 - protein, 250 aa, Glycine max
  Coding DNA Sequence Number=SeqID_42923
  Gene Ontology: Mol. function=transporter activity; Cellular component= integral to membrane; Biological process=transport
  Homolog annotation: Hit_ID=UPI00005FA59E; Match level="QueryCoverage =98%, HitCoverage=31%, E-value=2e-59, Identity=43%"; Hit description =COG3188: P pilus assembly protein, porin PapC
  Pfam annotation: Domain name=Usher; Domain location=2-250; Score= -486.5; E_value=0.021; Accession=PF00577.11; Description=Fimbrial Usher protein
MGFSTNQSGVSYNIGLGYNSGRYTDKPDKIATLNVQIPLSKGQSNNWMNYTSSKSSKGKLNQQLGLSGTALENNQLSYNVSAAQSGTRDGYSGNSSAYYRSRYGEIGAGYSFDKDVQRINYSLRGGAVVHRNGITLSQSLGDTIALVEVPNAGNVEIINSTGVTTDWRGYAVVPYINSYHKNRINLNPQSFDDSVEIENNSQTVIPTKGAIVVANFASHIGNRIIFKVHHRGTEIPFGAVATLRSDPGKS

SEQ ID NO: 134609 - protein, 119 aa, Glycine max
  Coding DNA Sequence Number=SeqID_42924
MIMRGQDIYSSQEETTSCPSSSGSEDEALLLKQSFYLLLPREKSLSTAIPLELEVIPQVKELLDEGLVHKSLNPCALLVPKIGLPIDPKRIKVILEWPTPPSIREIWGFNILANFYKRC

SEQ ID NO: 134610 - protein, 149 aa, Glycine max
  Coding DNA Sequence Number=SeqID_42925
MTIICLCVPSDMIVSGWQKVSGMTIICLCMSSGPPPLDDKRRRMTIICLYVPSDTIVIGWQKVSRMTIICLCVPSDTIVSGWQKVSEMTIICLRMSSGPPPLDDKRCRMTIICLCVSSDTIVSEWQKGQYDRDCVVANKSEALAPTYPQ

SEQ ID NO: 134611 - protein, 221 aa, Glycine max
  Coding DNA Sequence Number=SeqID_42926
DPRMPDRRKEAIPLFWVLPFYGIPRKCLEEKVKTLASQGEWVSFMDVLALGCIIYNPVLAIRQFGYPMRGASSEETIMPFITRGFNKANMKILQKIRKAWNKVGKKDKELRRRSNSVIGDYHKWLKSRTQGIAWHKKLKGLNGEEAGVPEESEEVQDLKAELGKTKVEKEKLKVVVTRVRKECDKLKDVNMSTTEALEQKMKKARKEEWSRNKFRGALLGS

SEQ ID NO: 134612 - protein, 94 aa, Glycine max
  Coding DNA Sequence Number=SeqID_42927
MVTSMLQLDSMNLFVKARAWFNPITQGMEILIANTSTIFHRDERLENTHATHGKCNYEIEMPEETSFLNHALEENTRIMYEQTCRTKSMLNAYA

SEQ ID NO: 134613 - protein, 395 aa, Glycine max
  Coding DNA Sequence Number=SeqID_42928
  Homolog annotation: Hit_ID=Q6WAY4; Match level="QueryCoverage=85%, HitCoverage=63%, E-value=1e-37, Identity=31%"; Hit description =Putative uncharacterized protein
MGTNQNGKRFYQVKVKGLDVTSLKELGRLMGPLQRQAFRKVYGKILDLAAAEIFTEAVVSLAQYYDQPLSCFTFGDFQMVPTIEEFEEILGCPLGGRKPYLFSDFLPSLSKIAAGVGDSAKELDRTKQTRNGVVGLPRKYLEGKARDMASQEKWGPFADILALLIFGVVLFPNVDGLVDLAAIDAFLAYYHSKESPVVAILADCLTPLTGDTRHPCPLQSYRSCAEKGRVDWDQHLAGLGGSAINWFPRWKEGKEGVLFSCGDYPNVPLIGTRGCINYNPALAIRQLGYPMRVAPTEESFSPFLVRDLGAQGLKVIQRIHKAWRSPLKRDKELRGIRNGVIGGYHGWLRIHAQGLDWLSKLKFFDEENFEAPEEDEEVRALKLELGKARLAKEKF

SEQ ID NO: 134614 - protein, 99 aa, Glycine max
  Coding DNA Sequence Number=SeqID_42929
  Homolog annotation: Hit_ID=Q2QV34; Match level="QueryCoverage=56%, HitCoverage=6%, E-value=3e-08, Identity=51%"; Hit description =Transposon protein, putative, CACTA, En/Spm sub-class
MEKAKPVGILESRLDERVRDIIFGDHNASETLRKLVDGPKRNVTTWQRYGINKYLFYTKSQDDKSTMQNSGAHGYTTQLTSSSFRVSNTFFTVYVEEDK

SEQ ID NO: 134615 - protein, 268 aa, Glycine max
  Coding DNA Sequence Number=SeqID_42930
  Gene Ontology: Mol. function=protein kinase activity; Cellular component=chromatin; Biological process=protein amino acid phosphorylation
  Homolog annotation: Hit_ID=Q2A9E0; Match level="QueryCoverage=95%, HitCoverage=19%, E-value=2e-62, Identity=45%"; Hit description =Putative uncharacterized protein
  Pfam annotation: Domain name=DUF889; Domain location=111-262; Score =93.3; E_value=7.9e-25; Accession=PF05970.5; Description=Eukaryotic protein of unknown function (DUF889)
MTDEQASIYNQIVEVVNKDEGASSGIASLLLPGGRTAHSKFKISVPVFEDSTCNIHQGTQLAELLNQTSLIIWDEAPMAHKFCFEALDHSLRDIIKHNSKDNKIFGGKVMVFGGDFRQILPIIPRGSHSNIVNATINSSYLWDHCQILRLTKNMRLQNNTQATNQEETVAFAQWIIDIGDDIIGDENDGYATIEIPQELLITEYNDPIHSIISSTFPDLSHHHNDREYFQTRAILASTNETIQQVNDYMLTMIPSDHILNYLILFFIF

SEQ ID NO: 134616 - protein, 62 aa, Glycine max
  Coding DNA Sequence Number=SeqID_42931
MNLLSEHVALSEFINTHCRIAKPRSLAQILAAHVQLSGHFFAKPILQNLKILQLPLSGSTCC

SEQ ID NO: 134617 - protein, 220 aa, Glycine max
  Coding DNA Sequence Number=SeqID_42932
MAPPKEIATIIYHNGHIVDDPVQGSMYTCTTPIFFYVSRSITFTQFIRKINNRLPTRATEQVAQLLFRVPISFHLGQTRFISAQLFDNDDLRGAMETILQNSQLNYVKFYAITELIRQPQPSCPQLSCPQLQLPPPQQLLYNNIDLNNPVSSYNNLESQDPFDIYASYTQILSENDSFLHGQQTSFDQQNHLKKPLMLAGYACTEKMHWRHLGDIRANKP

SEQ ID NO: 134618 - protein, 85 aa, Glycine max
  Coding DNA Sequence Number=SeqID_42933
  Homolog annotation: Hit_ID=A5B7I7; Match level="QueryCoverage=38%, HitCoverage=3%, E-value=1e-07, Identity=81%"; Hit description =Putative uncharacterized protein
MSGKPNMNGVAERRNQTLKDMVRSMISHSFLPDDQVLVPITVQDIISVIEDNVQTINIVPKQDNNEVLPQIPLEQPQQPQEGFKG

SEQ ID NO: 134619 - protein, 146 aa, Glycine max
  Coding DNA Sequence Number=SeqID_42934
MASLVSVKDSPLPVAICPCKTQIASTNGDIHNARKPPVKLVAGAFSEKGELQLPLASCLQVATPIGDLDRKNSHHEWRFCAYKYSSFTCVLTHVFSCSSNQKFFPLSVVAVCAHNQASPGAAVKLCLGDLLVMGSNPETALFAYAR

SEQ ID NO: 134620 - protein, 84 aa, Glycine max
  Coding DNA Sequence Number=SeqID_42935
GTSFVVQVKGTSTWVVVTENKRRYISCGSVQVEGTSTWLFKENKGWYIPYGSLLVKDFTRLKRNLKGCRLLRDWMLARVVAEPV

SEQ ID NO: 134621 - protein, 276 aa, Glycine max
  Coding DNA Sequence Number=SeqID_42936
  Homolog annotation: Hit_ID=A7UQU7; Match level="QueryCoverage=44%, HitCoverage=23%, E-value=4e-11, Identity=35%"; Hit description=IMP dehydrogenase/GMP reductase, putative
  Pfam annotation: Domain name=DUF1723; Domain location=169-208; Score =20.2; E_value=0.0021; Accession=PF08330.1; Description=Protein of unknown function (DUF1723)
MIYISWARTRGLGRAIGRVVGRDRAADEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQERPDLKLVSHGRKLTLIGRPVPEIEGLVAATGLSPLIDCSVITGDPGLISAFVERWHRELTITLDDVSSILHLPITGALHNFHALSTEEARFLLTELLEVSAEEARAETALTRGAYAEKVFRKLLRPIPEEGLPEVFFGSTSSGMGLSCA

SEQ ID NO: 134622 - protein, 30 aa, Glycine max
  Coding DNA Sequence Number=SeqID_42937
SYEQVVAWKVLNGDDYNHCLAFMFMNLVNP

SEQ ID NO: 134623 - protein, 60 aa, Glycine max
  Coding DNA Sequence Number=SeqID_42938
MVSGASVASECFRKISENLGNLSLGPSGTFWKLGCLRRKQLGGKLLHIFEKWFLGLPWLP

SEQ ID NO: 134624 - protein, 85 aa, Glycine max
  Coding DNA Sequence Number=SeqID_42939
MTMMSKDERVRSSNYSHGEDDKYEEDGGGWRNERYRERRSHRRYGGRQREEGIDGVKVKIPTFKGTRDPKVYLEWEIKVEQVFAC

SEQ ID NO: 134625 - protein, 956 aa, Glycine max
  Coding DNA Sequence Number=SeqID_42940
  Gene Ontology: Mol. function=dTDP-glucose 4,6-dehydratase activity; Cellular component=cytoplasm; Biological process=lipopolysaccharide biosynthetic process
  Homolog annotation: Hit_ID=P27830; Match level="QueryCoverage=35%, HitCoverage=94%, E-value=1e-154, Identity=77%"; Hit description=dTDP- glucose 4,6-dehydratase
  Pfam annotation: Domain name=3Beta_HSD; Domain location=151-422; Score=-61.9; E_value=3.7e-06; Accession=PF01073.10; Description=3 -beta hydroxysteroid dehydrogenaseisomerase family
  Pfam annotation: Domain name=Acetyltransf_1; Domain location=866-944; Score=60.7; E_value=5e-15; Accession=PF00583.15; Description =Acetyltransferase (GNAT) family
  Pfam annotation: Domain name=Epimerase; Domain location=150-398; Score=324.9; E_value=1.5e-94; Accession=PF01370.12; Description=NAD dependent epimerasedehydratase family
  Pfam annotation: Domain name=NAD_binding_4; Domain location=152-382; Score=-15.0; E_value=7.9e-08; Accession=PF07993.3; Description=Male sterility protein
  Pfam annotation: Domain name=NTP_transferase; Domain location=484 -691; Score=153.5; E_value=5.9e-43; Accession=PF00483.14; Description= Nucleotidyl transferase
  Pfam annotation: Domain name=Polysacc_synt_2; Domain location=150 -460; Score=-136.3; E_value=3.4e-05; Accession=PF02719.6; Description= Polysaccharide biosynthesis protein
  Pfam annotation: Domain name=RmlD_sub_bind; Domain location=148-457; Score=-113.1; E_value=4.8e-06; Accession=PF04321.8; Description=RmlD substrate binding domain
  Pfam annotation: Domain name=UDPG_MGDP_dh; Domain location=1-40; Score=-28.1; E_value=0.064; Accession=PF00984.10; Description=UDP -glucoseGDP-mannose dehydrogenase family, central domain
  Pfam annotation: Domain name=UDPG_MGDP_dh_C; Domain location=67-166; Score=83.7; E_value=6e-22; Accession=PF03720.6; Description=UDP -glucoseGDP-mannose dehydrogenase family, UDP binding domain
  Pfam annotation: Domain name=adh_short; Domain location=148-326; Score=-5.1; E_value=2.7e-05; Accession=PF00106.16; Description=short chain dehydrogenase
  Pfam module annotation: Pfam domain module=3Beta_HSD::Acetyltransf _1::Epimerase::NAD_binding_4::NTP_transferase::Polysacc_synt_2::RmlD _sub_bind::UDPG_MGDP_dh::UDPG_MGDP_dh_C::adh_short; Domain location =151-422::866-944::...
  Pfam module annotation: Domain location=150-398::152-382::484 -691::150-460::148-457::1-40::67-166::148-326
PGPGVGGHCIAVDPWFIVAQNPQQARLIRTAREVNDAKPGWVLDQVKQALAECLTASGKRATDVTIACFGLAFKPNIDDLRESPAMSVAQRIAGWHSGRTWVVEPHVADIPPQLAERATLVSLADALQHADILVMLVDHAQFRAVTPEEFLVTGGAGFIGSALVRFLIANTDHRVVVVDKLSYAGNLASLAPVEQDARFAFEQVDICDRAALDRVLAQYQPDCIMHLAAESHVDRSIDGPIAFVETNIVGTYQLLEATRHYWNGMTDERKKGFILHHISTDEVFGDLHGTEDFFTETTPYAPSSPYSATKASSDHLVRAWLRTYGLPVVVTNCSNNYGPYHFPEKLIPLTIINALAGKPLPVYGNGSQIRDWLYVEDHARALYTVVSSGKVGETYNIGGHNERRNIEVVETLCDLLDELAPQQRAAGLSSYRELITFVHDRPGHDLRYAIDASKIARELGWTPQETFDSGIRKTVQWRSNDERYHLSRWLGHTPAPDNPGDIQAAAAGVRQTDDLLSAVVNLACSCSMPSSRAPDGLAQAFIIGESFIGDDSCCLVLGDNLYFGQGFSPKLKKVAARSHGATVFAYQVMDPERFGVVEFDDDFNALSIEEKPQQPKSRWAVTGLYFYDNRVVEFAKQVQPSARGELEITAINQMYLEQGELAVELLGRGFAWLDTGTHDSLIEASVFVQTVEKRQGFKIACLEEIAWRNGWLSDEQLLAAAQALTKTGYGHIDPLAWESDFFRCATARLTLDGDVPLAEALQQPYTLWQVKVPAQDSAAIDALSQHGFQLVEGEADLAINIKRTERQTGVRIAREAQIPQLRAAAAQAFSQSRFRAPWFDAEDSGRFYAQWIENAVRGTFDHQCLIACDEQGALQGFVSMREVAGDARIGLLAVLPAAQGNGVGQRLLLAAADWGRVRQLERLRVATQLSNLTAMRLYLRSGARLESTAYWFYRKA

SEQ ID NO: 134626 - protein, 266 aa, Glycine max
  Coding DNA Sequence Number=SeqID_42941
  Homolog annotation: Hit_ID=Q6UUU1; Match level="QueryCoverage=22%, HitCoverage=40%, E-value=3e-18, Identity=78%"; Hit description =Putative uncharacterized protein
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTFFQASKTGDAVLNPVSVLNFMMRQVSNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134627 - protein, 105 aa, Glycine max
  Coding DNA Sequence Number=SeqID_42942
MAKFDPDVVLEFYANAWPTEEGVRDMRSWVKGQWIPFDADTLSQFLGDPLVLEEGQECEYSQGRNQADGFDEEAIAQLLCISVTSCPAIITPTSLCRSVSWCMPS

SEQ ID NO: 134628 - protein, 139 aa, Glycine max
  Coding DNA Sequence Number=SeqID_42943
MDNEEGVQEQMKADLSALIDQMASISEVMLKLQKTIEDKATATASSTVREAEPVLQPVLNPGRDRNTAVFGRRYSPQAYPYGLPPDFTPRVTPEDLSQAPTFEGQLPPYDDYPKQDDEEGDTHLGPLLHLKDPSPHELP

SEQ ID NO: 134629 - protein, 85 aa, Glycine max
  Coding DNA Sequence Number=SeqID_42944
PPSLNVLAHLVALQYQGLAQELIKGNYEPLNRGAQVPARMCNPLMARTYSPLKVIGTSTQGSTFMRKQEIDSSRGPVIQQDWKRD

SEQ ID NO: 134630 - protein, 137 aa, Glycine max
  Coding DNA Sequence Number=SeqID_42945
  Homolog annotation: Hit_ID=Q6WAY6; Match level="QueryCoverage=48%, HitCoverage=11%, E-value=8e-07, Identity=43%"; Hit description =Putative uncharacterized protein
MGTRGCISYNPDLAIRQLGCPMRGAPLEEELAPVISRGFNKTNVDTLQKVCKAWEVVQKKDKELRGSNNGAHWWLPTAKREEVEAPEEDEEVQTIRAELEQAQTVKERFKSVALKIRKENAELNSELKLRREERDQS

SEQ ID NO: 134631 - protein, 130 aa, Glycine max
  Coding DNA Sequence Number=SeqID_42946
  Gene Ontology: Mol. function=glucosamine-1-phosphate N-acetyltransfera se activity; Cellular component=cytoplasm; Biological process =lipopolysaccharide biosynthetic process
  Homolog annotation: Hit_ID=Q5PKV8; Match level="QueryCoverage=98%, HitCoverage=30%, E-value=2e-54, Identity=81%"; Hit description =Bifunctional protein glmU [Includes: UDP-N-acetylglucosamine pyrophosphorylase (EC ...
  Homolog annotation: Hit description=2.7.7.23) (N-acetylglucosamine-1 -phosphate uridyltransferase); Glucosamine-1-phosphate N -acetyltransferase (EC 2.3.1.157)]
MRMSNSAMSVVILAAGKGTRMYSDLPKVLHYSGREANDLGAAAVHLVYGHGGDLLRQTLHEDNLNWVLQAEQLGTGHAMQQAAPFFNDDEDILMLYGDVPLISVETLQRLRAAKPQGGIGLLTVKLDDPT

SEQ ID NO: 134632 - protein, 142 aa, Glycine max
  Coding DNA Sequence Number=SeqID_42947
  Gene Ontology: Mol. function=RNA-directed DNA polymerase activity; Biological process=RNA-dependent DNA replication
  Homolog annotation: Hit_ID=Q2HRM6; Match level="QueryCoverage=38%, HitCoverage=13%, E-value=3e-09, Identity=51%"; Hit description=RNA -directed DNA polymerase
MQEFQDVFPKESRHGLPPSRSIVHQVDLLLEASLPNEPTYYWKPHETQHKDAQVKVEYVKRLYDHVKVQIAKKNESYTKQADKQRKELVLDPGDDPGHFRAYVFQERGNDENPEIGQIQAKGPSGEGRRLKWRRTKPPSGEG

SEQ ID NO: 134633 - protein, 27 aa, Glycine max
  Coding DNA Sequence Number=SeqID_42948
DSVEILHHSSSFFTVLHPFFVRSSFFN

SEQ ID NO: 134634 - protein, 181 aa, Glycine max
  Coding DNA Sequence Number=SeqID_42949
  Subcellular localization annotation: CTP_CleavageSite=52; ConfidenceScore=5.67e-01
MADSNFKPALNSSLFLAGLPRPSRRFFNVAICAYSSLGMVKLSRSIFTLLVLALSFSVAVAVLLTTLMAGVGATFFAATGGFAATFATGGFAATGFADAGFCAAGLAATGLVGVLVLTALVAGLLAVKGLATEAVFHDKIQHLQSGSMRCAGYWWQIPKEAAAKPLWPRILLAIWHNWVTK

SEQ ID NO: 134635 - protein, 118 aa, Glycine max
  Coding DNA Sequence Number=SeqID_42950
MATQLIHDRVVMECLEGVWETLEGNARCRFRGMIRLTATSLVHPGEPARTLQRTLEWILPTPTPYRLVEPVQVIEVSSSEEDPEEDPEVLPPEPTVDAIDFPEGDEDPLPDVDSPEDV

SEQ ID NO: 134636 - protein, 120 aa, Glycine max
  Coding DNA Sequence Number=SeqID_42951
MAGLCDSKVRESEVTPQTLHKVVIRAGNPSRLGQSGKIFPQELPRQTFGIKYKSPPRDTQPGCKLLRIRPQSSKPGVRGQALPLLHDHWSLQKGVEGINIKFYQVPSNPNLLGILVLRDI

SEQ ID NO: 134637 - protein, 42 aa, Glycine max
  Coding DNA Sequence Number=SeqID_42952
MRQPQRRLNPVILDVVKKKVVPKKTGLTVIKNEKEELIPTRV

SEQ ID NO: 134638 - protein, 145 aa, Glycine max
  Coding DNA Sequence Number=SeqID_42953
MGETHEIPHHNLADFEPWLGYATEGQAVGGIPFENTLEGPQFRPQPQPLHFAVGRAPPAMAEKGKLDHLEERLRAIEGGEDYAFANLKELFLVPNIITPPKFKVLDFDKYKVLDFDKYKGTTCPKNHLKMYCQKMGEYALKMRNC

SEQ ID NO: 134639 - protein, 169 aa, Glycine max
  Coding DNA Sequence Number=SeqID_42954
  Homolog annotation: Hit_ID=UPI00006A2D9E; Match level="QueryCoverage =92%, HitCoverage=98%, E-value=4e-13, Identity=17%"; Hit description =UPI00006A2D9E related cluster
GLHALAIRGLHVLTFRGLHALAIRGLHVLTFVGLHTLTFRGPHVLTFRGLHALAIRGLHVLTFRGLHALAIRGLHVLTFVGLHALTFRGLHVLANRGLHALTLRGLHVLAKRGLYALTLRGLHTLTSRGLHILALRGLHVLTIRGLHALTSRGLHVLRLERATRPRLGY

SEQ ID NO: 134640 - protein, 108 aa, Glycine max
  Coding DNA Sequence Number=SeqID_42955
MVHDIFVKVKLEVTRISTILNVFGSRRSNDVRLTGASSKGGKCAESPPTFICGKHQKNRRKPVMKNIPDSGVVFTFEEGISTSHVDKSGALAPTYPPSKRKSDLRSSF

SEQ ID NO: 134641 - protein, 137 aa, Glycine max
  Coding DNA Sequence Number=SeqID_42956
GYTPSRGLHAFTFRGPHILANRGLHALTLRGLHALAIRGLHVLTFVGLHALTFRGLHVLANKGLHALTLRGLHFLANRGLHALTLRGLHVLANRGLRPSLFRGLHILAYREFRLHALCLKCLHDLAKSLHPPLKGLQ

SEQ ID NO: 134642 - protein, 79 aa, Glycine max
  Coding DNA Sequence Number=SeqID_42957
MTARGGHWWSVEVEKKLGGVGGWFRGREGGRKWLFYAAGRICSLQHLPKRNVENGLRNLQTKLEDNATVNKSGMMILLK

SEQ ID NO: 134643 - protein, 57 aa, Glycine max
  Coding DNA Sequence Number=SeqID_42958
MAFLECLLEHLAEVCSTSLLLACKGVSRDDSLEFSIVFPSVEIRSLTGSDAGASLEH

SEQ ID NO: 134644 - protein, 216 aa, Glycine max
  Coding DNA Sequence Number=SeqID_42959
MTTLTQIWMTLLLSNILPTDHNSDLPMPKCQLVYAILTRKSIHVAQLIADAIYIFAVQQGPGIPRTDHRTLPVVRGPRCTYQGDSAAQAAGAPQAQGNAPQAAGAPPPPHQAGQAGAFGMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 134645 - protein, 93 aa, Glycine max
  Coding DNA Sequence Number=SeqID_42960
MVKEECKEVSVSSKRLAKKESHFEIKTNIKETSPLRQPPHLLLCKKTLVSTVTPLGLEVIPQVKELLDEGLVHKSLNPSALLVPKIGIINTKI

SEQ ID NO: 134646 - protein, 210 aa, Glycine max
  Coding DNA Sequence Number=SeqID_42961
  Gene Ontology: Mol. function=metalloendopeptidase activity; Biological process=proteolysis
  Homolog annotation: Hit_ID=Q7CW99; Match level="QueryCoverage=81%, HitCoverage=36%, E-value=1e-75, Identity=84%"; Hit description =Putative uncharacterized protein
  Pfam annotation: Domain name=Peptidase_M23; Domain location=69-173; Score=54.7; E_value=3.2e-13; Accession=PF01551.13; Description =Peptidase family M23
MEKARAEEQRLARLSEAEREKQRAAAEAGMPDKNRIAPAYPFASLKGKLEFPVAGEVLRRFGDADGTGHFSKGVVVASGPEAIVTAPADGFGVFAGDFRSYGRMVILNTGDGYHVVMTGMDNVRTRQGMFVFSGEPIASMGAKRVASAAALALETDRPTLYIEFRKDGVPVSLLLIGGLMGATAMSVIYSASMPAQAAGPSTYKELCGIL

SEQ ID NO: 134647 - protein, 163 aa, Glycine max
  Coding DNA Sequence Number=SeqID_42962
MREASRLVYQMTAAPAKLSWKKCINNFSSLECTPILQQYILRWVLRTSRPFVLVKNQGTLNFGGDNDVPLPSQRSSHVHEPDLSQPTLRREGDAVTRGMRVPRKEYARSRHQRLFEENVGKTGKDAIYELLSERFGSCIYARGRVFPFAPTYSSIWDEKIRPT

SEQ ID NO: 134648 - protein, 32 aa, Glycine max
  Coding DNA Sequence Number=SeqID_42963
MAHQNPPYLVSYPNFVRGPLLDDMRPFFGPCK

SEQ ID NO: 134649 - protein, 83 aa, Glycine max
  Coding DNA Sequence Number=SeqID_42964
  Subcellular localization annotation: CTP_CleavageSite=58; ConfidenceScore=5.51e-01
GLLCAILHSQSFFGAPGIAFSFMRPPPELGVMSSDCLVQFSILTHFRSPMNCVFVQVSSTHEFGAMRSDCLVQFSILNLFGAP

SEQ ID NO: 134650 - protein, 145 aa, Glycine max
  Coding DNA Sequence Number=SeqID_42965
MSRGSGDLGDVRWGAIAQNQAWLIPTQPGHSQSIMMTVQLIHDRVVMECLEGVWETLEGNERCRFRGTIRLTATSLVHLEQPTCTLQQPVEWILPTPTPYRLVEPVQVIEVSSSEEDLEDDPESYLLNLLWTPLIYQRMMRTHSL

SEQ ID NO: 134651 - protein, 379 aa, Glycine max
  Coding DNA Sequence Number=SeqID_42966
  Homolog annotation: Hit_ID=Q6WAY6; Match level="QueryCoverage=87%, HitCoverage=57%, E-value=7e-38, Identity=31%"; Hit description =Putative uncharacterized protein
MGPLQRQAFRKVYRKILDLAATEVFTEAIVSLAQYYDQPLRCFTFADFQMVPTIEEFEKILGCPLGRRKPYLFSGFLPSLSKIAAVVGDSAKELDRTKQTQNGVVGLPRKYLEGKARDMASQEKWGPFADILALLIFGVVLFPNVDGLVDLAANDAFLAYHHSKESPVVAILADFVRIVCCLPALCVWLISHLFQQDTRHPCSLQSYRSCAEKGRVDWDQHLAGIGGSAINWFPRWKEGKEGVLFSCGDYPNVPLIGTRGCINYNPALAIRQLGYPMRGTPTEESLSPFLVRDLGAQGLKVIQRIHKAWRSPLRKDKELRGIRNGVIGGYHGWLRIHMRGLDWLSKLKVIDEENFEAPEEDEEVRALKLELGKARLAKE

SEQ ID NO: 134652 - protein, 232 aa, Glycine max
  Coding DNA Sequence Number=SeqID_42967
MERSMIDAASGGALGDMTPAEARNLIEKMASNSQQFSARNDAIVIRGVHEVATNPSASSETKKLEGKLDALVNLQPGAIEQPEAYAANIYNRPPQPQQQNQPQQNNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKN

SEQ ID NO: 134653 - protein, 106 aa, Glycine max
  Coding DNA Sequence Number=SeqID_42968
MFILEDYTSSPSEGYTPSPWVLVTLTVRGLHVLAFRGLHVLANGGLHTLTLKGLHVLANRGLHALTFRGLHVLANRGLHALTLRGLHVLAIRGLHALTYRGLHILA

SEQ ID NO: 134654 - protein, 67 aa, Glycine max
  Coding DNA Sequence Number=SeqID_42969
MTSKVILMMPKNQQLSKFQRLKNLVSRIKIQESRIKNNQDQDSRFKIQESREDSIKISTKKVFQNIE

SEQ ID NO: 134655 - protein, 69 aa, Glycine max
  Coding DNA Sequence Number=SeqID_42970
  Homolog annotation: Hit_ID=A0PAV3; Match level="QueryCoverage=55%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTAGPEKKFPW

SEQ ID NO: 134656 - protein, 152 aa, Glycine max
  Coding DNA Sequence Number=SeqID_42971
MARRRQIMVILRPFRQSRGGGPDDMQRQIMHLPHPFAIQTQLCHTDSTQRQISGHSAQPFVIAEAAGPMTCRDKLWSSAHPFASDTVVPMAPDLAKTKLCLIFTFLFISRGGGPDNKTSKEGQLSYPNFVRGPLLDDMQLLFGPCEVLGTHH

SEQ ID NO: 134657 - protein, 45 aa, Glycine max
  Coding DNA Sequence Number=SeqID_42972
MGAKYLEVVKGGSHPNNGWSPDEIRLECLNYHMYDKELYAVVRAL

SEQ ID NO: 134658 - protein, 93 aa, Glycine max
  Coding DNA Sequence Number=SeqID_42973
  Subcellular localization annotation: CTP_CleavageSite=61; ConfidenceScore=5.29e-01
MVKVGTSYVPINVSFSPKVGPGLPAVSAGHQRWQVSPLDQFHTRAGSIKCKAATGVPSPFRAELTVGNGRSVRASLALLRQLAKGGCAARRLS

SEQ ID NO: 134659 - protein, 139 aa, Glycine max
  Coding DNA Sequence Number=SeqID_42974
  Gene Ontology: Biological process=transposition, DNA-mediated
  Homolog annotation: Hit_ID=Q1J7G7; Match level="QueryCoverage=33%, HitCoverage=80%, E-value=8e-16, Identity=75%"; Hit description =Transposase
ASGDAAKLTDLVYDGVFEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIFTSTPYAPMNP

SEQ ID NO: 134660 - protein, 117 aa, Glycine max
  Coding DNA Sequence Number=SeqID_42975
MREREMITTIDTLPVFYYEKMVGYMPSSFVDLVFAGERIEVRLRRGKFDYVASMISGNRRPRAGGEQKKEGDAHAKIVVPTWPSSPQTPHNPMGVPQCRNMPSIREAVAGIDGEVFM

SEQ ID NO: 134661 - protein, 274 aa, Glycine max
  Coding DNA Sequence Number=SeqID_42976
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKSWPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGIRSTGGKAPRKQLATKAARKSAPATGGVKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134662 - protein, 115 aa, Glycine max
  Coding DNA Sequence Number=SeqID_42977
  Subcellular localization annotation: CTP_CleavageSite=42; ConfidenceScore=5.88e-01
MASSTSSGVTSPCTTPNSLVTITKLPRARRSTPSRLIGSSVSGTTIAGDAAATASTLTPSSRATSISFARTTPMISSSSPRHTGNRLCGGREQLLANFIHTQVSIDPADLSARES

SEQ ID NO: 134663 - protein, 189 aa, Glycine max
  Coding DNA Sequence Number=SeqID_42978
FVWGPYTATVMAALPPICVIGSVAWRKTKMFVDPNNTNAATLGEVVETLHYMVSPQGRNTWTVDDLVPYVEKLAIISEEQERITEPVSHGPASDREFPAQEFHILRSSVETQSIGRRREPVEAEEYSQQMMERGHGMYYTPATFSQYPSQMYQYPFEGHHTDTSASEHSFGGVAETQPHFSWPTITPSQ

SEQ ID NO: 134664 - protein, 147 aa, Glycine max
  Coding DNA Sequence Number=SeqID_42979
  Pfam annotation: Domain name=Transposase_23; Domain location=5-58; Score=-17.5; E_value=0.098; Accession=PF03017.5; Description =TNP1ENSPM transposase
MASFSQLQSEMQSQAPPEPLVGPGPSGPRVSVDEVKDADAPVPVPTAEVSLVGPALHTFLAWLTHLIKSLSHQVAVSPPKPPPKPDPEVDDPLYLMTLTIPELFLRPYKLFLTRFPPVHKARRPLRNCTRWSMSQHISVTVVDSASH

SEQ ID NO: 134665 - protein, 99 aa, Glycine max
  Coding DNA Sequence Number=SeqID_42980
MSVFAAIRLFVLQTAKKNVYTDNHSGISRQRDSNGAEDDVSLCVLSGFSSYRQQKRMFIRITTRVFSPRQRDSNVSMTDLVSAEDDLNLRVSTGLSGRD

SEQ ID NO: 134666 - protein, 53 aa, Glycine max
  Coding DNA Sequence Number=SeqID_42981
MPAGSTLEDPTCDAILPRKGPVTRAMSKRLQEDWARAAKEGPRVLMNLRGSIL

SEQ ID NO: 134667 - protein, 135 aa, Glycine max
  Coding DNA Sequence Number=SeqID_42982
  Subcellular localization annotation: CTP_CleavageSite=62; ConfidenceScore=5.15e-01
MLVRMICTRLFAAAQVKSCPGMHSSCVIASLSGCARTVGPPPISGGGPRTVWIWSPLKVRTRSPLKARTCSPLNGEGNYYPRQGRVALSRRGRVVLSSPLMARACNPLKVRTCSPLKVRMCSPLMVRTCSPLKGE

SEQ ID NO: 134668 - protein, 194 aa, Glycine max
  Coding DNA Sequence Number=SeqID_42983
RVRWHAETNYGHSAPFCHPESPGPDDIQSKIMVIPHPFAIQTQSCPMARRDKLWSFCTLLSSRGGGPDDMRRQNLAADPMTCGDKIMVIPHPFAIQTQSCPMARRDKLWSFCTILSSRGGGPDDMRRQNLVIPHPFAIQTQSCPMARRDKLWSFCTLLSSRGGGPDDMRRQNLVIPHPFAIQTQSCPMERRDKL

SEQ ID NO: 134669 - protein, 198 aa, Glycine max
  Coding DNA Sequence Number=SeqID_42984
  Homolog annotation: Hit_ID=A1FYB0; Match level="QueryCoverage=31%, HitCoverage=15%, E-value=2e-07, Identity=53%"; Hit description =NADH:flavin oxidoreductase/NADH oxidase
ELDEARIAEVIAAFAASAVRAERLGFELIELHAAHGYLLHPVPVAAEQPPHRWLWWLAAEPACALLVEVFDAVAVGVRICASDWVDWRLGPGAERSAGPGAGRARLQFPACLQRRPGRAPEDHRRSRLPGAVCGAAIKAKVTHAGHRGGHDHRARAGRIDPAPSPRRCRGPGARHPLRPALAVARHRRTARQRGTGAA

SEQ ID NO: 134670 - protein, 149 aa, Glycine max
  Coding DNA Sequence Number=SeqID_42985
  Gene Ontology: Mol. function=aspartic-type endopeptidase activity; Biological process=RNA-dependent DNA replication
  Homolog annotation: Hit_ID=Q6WAY3; Match level="QueryCoverage=76%, HitCoverage=6%, E-value=5e-12, Identity=31%"; Hit description =Gag/pol polyprotein
GSPVMLGNGYEPGMGLGKNNGGRTRGNRGKFGNFISAGLGHEGQVVAICEDDSPSGSDLVRSCPPGFRLGNWRVEERPDIYATSIIDEDVGLPPELEKIVAHEDQEMGPHQEETKLVNLGTSSGKKEVKIGTGMTTPICEELTALLKDY

SEQ ID NO: 134671 - protein, 161 aa, Glycine max
  Coding DNA Sequence Number=SeqID_42986
  Homolog annotation: Hit_ID=Q1J7G7; Match level="QueryCoverage=26%, HitCoverage=61%, E-value=1e-07, Identity=65%"; Hit description =Transposase
MVKVGTSYVPINVSFSPKVGPRAFPVFYSAQSASGDAAKLTDLVYDGVFEVLQWLLFLSAVPPVQLLTGVVRNGKSTAGTSALASVAVTLRVTTTPAALNAPLQGASHSPFRLRNCWEGRSVRASSLLRQLAKGGCAARRLSWVTPGFSQSRRCKTTASEL

SEQ ID NO: 134672 - protein, 69 aa, Glycine max
  Coding DNA Sequence Number=SeqID_42987
MGIHRTTKQSPFEEEPTDLRSNPLQGGGDDTILPRKGSVTRAMSKRLQEDWARAAKEGPRVLMNLRIDF

SEQ ID NO: 134673 - protein, 242 aa, Glycine max
  Coding DNA Sequence Number=SeqID_42988
MIMRRQDIYSSQEEATTSPSSSESEEAEGEKSSEEIYPQEEGQPSVVKEKCKEVSVSSKSLAKKETHFTIKTNIKETFPLRQPPHFLFCKKTLASIATPLGLEFIPQVKKLLDEGLVRKSLNLCAFLVPKIGIIRHQVPKIGGMMNVLSGATLFCKITRTPNIFMVCVHRDPLGSDQRVPMNPKRIKVIPEWLTPPSIRKIWGFHDLTNFYKRFVPYFSILVAPLIELVLREGAQSMKNLEI

SEQ ID NO: 134674 - protein, 53 aa, Glycine max
  Coding DNA Sequence Number=SeqID_42989
MGSSFTVLIKDAKIPKGEGKINGVLCFLKINGSGMEKKKDDWRLHFKERMSQE

SEQ ID NO: 134675 - protein, 88 aa, Glycine max
  Coding DNA Sequence Number=SeqID_42990
MAYTHIPDSTSDSPQISASPYQLDLAPYASEPYNAQWNAPGLLRDKHTLRSSRILREMEVDEPWIGLWLPLNYQVDMGASQHRTLELG

SEQ ID NO: 134676 - protein, 138 aa, Glycine max
  Coding DNA Sequence Number=SeqID_42991
  Homolog annotation: Hit_ID=Q84VH5; Match level="QueryCoverage=65%, HitCoverage=13%, E-value=2e-40, Identity=94%"; Hit description =Envelope-like protein
MLSQHPNMLNYTDSVIKRESPLSLHYKLFEGTHVPDIVSTSGKAASGAVSKDALIAELKDTCKVLEATIKATTEKKMELERLITRLSESGIDDEEAAEEEEEAAEEDKAAAEEEEEAAEEEEDAAEETESDDDSEATP

SEQ ID NO: 134677 - protein, 157 aa, Glycine max
  Coding DNA Sequence Number=SeqID_42992
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=5e-25, Identity=56%"; Hit description =Putative uncharacterized protein
  Subcellular localization annotation: CTP_CleavageSite=51; ConfidenceScore=5.51e-01
MTMITPSSKLTLTKGNKSWYRAPPRGRRKQIQSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134678 - protein, 371 aa, Glycine max
  Coding DNA Sequence Number=SeqID_42993
MASRKLSAKRSRRDATAEGTSATPEFDSHRFRSAEHQQRFEAIKGWSFHRERRVQLRDDEYTDFQEEIARRRWTSQVTPMAKFDPDIVLEFYANAWPTEEGVRDMRHPQPVPGRPASVRGGPGDFARTAAGRRVRIMRTSMTTLTQMLMMLLLSNVLPSDHNSDLPLPKCQLVYAILTRMSVHVAQLITDAIYLFTGMPPTRHPLDPDKFNRALGFPALITGLCQSFGVPITPSKVIRPPITRAFIEKYCTPRQAQSDALQAADAPPPPHQADPAGSFGTERYLQHLVRQQAANHRGQVQIHECLYQLSLSQQSQGFAPFACPTLDQFRAEVAWPRDWPEAPAEAPGDAEEARMDEEMTNLLGFLGGSGAT

SEQ ID NO: 134679 - protein, 124 aa, Glycine max
  Coding DNA Sequence Number=SeqID_42994
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=70%, HitCoverage=74%, E-value=2e-24, Identity=65%"; Hit description=LacZ protein
  Subcellular localization annotation: CTP_CleavageSite=20; ConfidenceScore=5.28e-01
MSFVKTITVFFTFSRLSKSVVMQRQSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRS

SEQ ID NO: 134680 - protein, 81 aa, Glycine max
  Coding DNA Sequence Number=SeqID_42995
MGGMKGINPLVNEFWIKPLNGMRRKRFVYCIKRCSNSFEKIEEEEMEEGICVLPVWNVLWLHQTFRPFFEPIRAGVMSLKY

SEQ ID NO: 134681 - protein, 147 aa, Glycine max
  Coding DNA Sequence Number=SeqID_42996
MMPECLNRVVGIPRKHLEEKAKALADQGEWALFIDVLALLVFGAVVFPTVDGLVDLATIDTFHTYHHSKESLVMAVLANAYDTFNRRCEKSGARIVCCTPTLYVWMVSHLFHHESRPVYPLQGHHICPEKGKPPLGAPLGQYGRGIR

SEQ ID NO: 134682 - protein, 153 aa, Glycine max
  Coding DNA Sequence Number=SeqID_42997
MHRSPTGKLVPLDLEIEATLRRNRAGRRRKLLQDRTVASILEEEAQSFDSTSSDSLSSRESAIYLLEASVMADEHQQKGEAKKWLHSFKGNSLETWEQVVEKEREKRKEKASDKGMEVPYPVVQSKKDKDRHLARFLDIFRKLEITMPFGEAL

SEQ ID NO: 134683 - protein, 104 aa, Glycine max
  Coding DNA Sequence Number=SeqID_42998
MKSGDMRGYLMVTRIIRQPGANEPVDARRLTLSSTPFVVLTREGQRVRWQAEIPYGHLHLSSTEGNEFDGVKMMLVLLSSSGNIQAQRRARFFSVGQGRSSAMA

SEQ ID NO: 134684 - protein, 212 aa, Glycine max
  Coding DNA Sequence Number=SeqID_42999
  Homolog annotation: Hit_ID=A0ST23; Match level="QueryCoverage=11%, HitCoverage=51%, E-value=7e-07, Identity=100%"; Hit description =Putative reverse transcriptase
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLAYRYRRPRGGARYQLLFPLVRVNFELGVIMVIAVSFGKPVVPAALMNRPTRGERRFAYWALAECILAYYVGTDEGVSEVLHVAGEKRLHRAAAKPFFHRLRPPDSITKSDAQSVVAKPDRTIKIPG

SEQ ID NO: 134685 - protein, 283 aa, Glycine max
  Coding DNA Sequence Number=SeqID_43000
GLVDKPSGGRHVFQRLGPAWPTRLDGINRSPSMIGKRARHCSVEWPRIFPWYAQVASGLYHFGKGGWDGKRSSYVIGIGVNFGLGGKFLIALEPGPKWALPAGRVGVGAVAWGVSLWIGVGALACTGAKLEESPARAEKLGCSDPSSVGTCGGEVIELPSLQAHFDSFPDEYRVCEAGGHVPPTLSVLFKGLVFLFNHILQLSPIGSHIGVVLILPKEGNNQILPSADVGSFQISVPDDRGSRQAILEEVHQQLSIPRMRPHLATIHFEMVLRTSRPFVPVKI

SEQ ID NO: 134686 - protein, 97 aa, Glycine max
  Coding DNA Sequence Number=SeqID_43001
MGWIQVLRSSICILMNFIITKKTPRHPYNTRSRKKDNEEGVQEQMKADLSALKDQMASISEVMLKLQKTIEDKATTTASSTIREAEPVDVPSFSSIF

SEQ ID NO: 134687 - protein, 73 aa, Glycine max
  Coding DNA Sequence Number=SeqID_43002
  Subcellular localization annotation: CTP_CleavageSite=32; ConfidenceScore=5.06e-01
MGSKSTLRLMRTLGPSLGSLAQSTWSLLPNALAGRVGSMLELYLTKATQGSRLVSYLPKYHPYVLTSNDMSEW

SEQ ID NO: 134688 - protein, 253 aa, Glycine max
  Coding DNA Sequence Number=SeqID_43003
  Homolog annotation: Hit_ID=Q2HW90; Match level="QueryCoverage=92%, HitCoverage=61%, E-value=2e-26, Identity=28%"; Hit description =Putative uncharacterized protein
MGINQTGKRFYQVKIKGLDITSIKGLGWLMGPLQMQAFRKAYGKILDLTIVEISMEAIVSLTQYYDPPLRCFTFGDFQLVPIVEEFEEILGCPLGGRKPYLFSGFLPSLSKIVVVEWVPFMDVLALLIFEVVLFPNMDGLVDLAAIDAFLAYHHSKESPVVAILADLFDTFDQRVDWDQHLAGIGGRTINWFPRWKEGKEGVLFSCGDYPNTPLIGMRGCINYNPALDIRQLGYLMRGAPTEESLSPFLVRDF

SEQ ID NO: 134689 - protein, 80 aa, Glycine max
  Coding DNA Sequence Number=SeqID_43004
MSVKNLVGCLGVHDKTNHTIGDQSGSQCFARMLQPYGIQHRLKGALKPCDPHRHTLEDHIHSILNHNGIQTQKHVITHQS

SEQ ID NO: 134690 - protein, 104 aa, Glycine max
  Coding DNA Sequence Number=SeqID_43005
MFIRITTWVFPPVNVTQMLFVLKTAKKNVYTDNHSGISARQRDSNLSMTDLVSAEDDTAKKNVYTDNHSGISARQRDSNVSMTDLVSAEDDVNLPRVNWLVGRD

SEQ ID NO: 134691 - protein, 124 aa, Glycine max
  Coding DNA Sequence Number=SeqID_43006
  Subcellular localization annotation: CTP_CleavageSite=9; ConfidenceScore=5.51e-01
RSHPQDHPVDPKKSNRTLGFPALVTGLYQSYRGSRLTVPPQRTTLLPNKSNRVPPLEVSSSITRVSVSSTGVPVTSSQGHQALLLTLDLSSRSTARPPRQARQGKLHISILEDGSANRHTACTP

SEQ ID NO: 134692 - protein, 46 aa, Glycine max
  Coding DNA Sequence Number=SeqID_43007
MAARKVKLSGKPGPLCPMKYKRLEKEIHFDQWTPIWCGDNIGLRYE

SEQ ID NO: 134693 - protein, 71 aa, Glycine max
  Coding DNA Sequence Number=SeqID_43008
MGLRKRGRDWRIALSNHYAWLQTRGWSMNENVIHGAPKQGRKWRIALSNHYARLQKMGGGWMNENAIDGAP

SEQ ID NO: 134694 - protein, 53 aa, Glycine max
  Coding DNA Sequence Number=SeqID_43009
MYVVVVLKDERKRGWGHDRPIVALLCAKQAGNVAARQPRILCILQLSFTICLF

SEQ ID NO: 134695 - protein, 112 aa, Glycine max
  Coding DNA Sequence Number=SeqID_43010
TLASIATPLGLEFIPQVKKLLDEGLVRKSLNPCALLVPKIGIIRHQVPKIGGMMNVLSGATLFCKITRAPNIFMVLKWDTLGLSYFLVGIINMKIQKKVLRKKAQSFKNPGI

SEQ ID NO: 134696 - protein, 132 aa, Glycine max
  Coding DNA Sequence Number=SeqID_43011
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=64%, HitCoverage=72%, E-value=2e-24, Identity=70%"; Hit description=LacZ protein
MLVQLGEELGLLTSLNEAISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 134697 - protein, 410 aa, Glycine max
  Coding DNA Sequence Number=SeqID_43012
  Gene Ontology: Mol. function=transcription factor activity; Cellular component=intracellular; Biological process=regulation of transcription, DNA-dependent
  Homolog annotation: Hit_ID=A7MRF9; Match level="QueryCoverage=16%, HitCoverage=62%, E-value=2e-19, Identity=68%"; Hit description =Putative uncharacterized protein
  Pfam annotation: Domain name=HTH_5; Domain location=301-340; Score =8.1; E_value=0.059; Accession=PF01022.11; Description=Bacterial regulatory protein, arsR family
MGGQAAATQRRGIDVFGGETAAIGVDLVVIGEGIVFRRDRRAVLQQKISQQTAVTDQQHGMREAQRRIADADFHRAQLRFGPRIPVNILDAFNHAGGVQPFVVGVEFAPAVDVFQASVVGEGILRAETGAGKARIDALRMAQVHRFVPVVDAEVDVLAEHAGQLGKIAKAAGQLPVARVVADDLLAPVVAQMAAAAADVTAQALRAAPDGMGQGAQLGVQLIEIAVHRAVQLHHRFGELMFDAPAVADRADHPVGPIRKIVVLVIDQLQLYFGADGEPFRTFECERHGASFLQEQHKDKLTGVRHDVIDAAEALSGALALPQPKISRHLAMLRESGLLLDRRDGKWIYYRLSPHMPAWAAGIIEQAYQCRAEQMMELGQRAAKGCPSDLYSDVGLGYLATERAGHWLERG

SEQ ID NO: 134698 - protein, 159 aa, Glycine max
  Coding DNA Sequence Number=SeqID_43013
MAPTRHPLDPDKSNRALGFPSLITGLCQSFRVPVAPTKAQGDAPQAAGAPPPPHQAGQAGAFDMEQYLWHLVRQQAANHRAHVQTHDCLYQMSLSMQSQGFASFSCPTPDQFRAEVAWPGDWPEAQAGEAPPEAPGGGEEAHEDEEMVDLLDFLGRSGD

SEQ ID NO: 134699 - protein, 49 aa, Glycine max
  Coding DNA Sequence Number=SeqID_43014
  Homolog annotation: Hit_ID=O64438; Match level="QueryCoverage=73%, HitCoverage=15%, E-value=3e-13, Identity=94%"; Hit description=ARG10
MFCLFQHITRCFYPTAVGGLRCYENPKNKITAVPAEEEEIWGAFFKETR

SEQ ID NO: 134700 - protein, 257 aa, Glycine max
  Coding DNA Sequence Number=SeqID_43015
  Gene Ontology: Mol. function=transcription factor activity; Cellular component=intracellular; Biological process=regulation of transcription, DNA-dependent
  Homolog annotation: Hit_ID=A6T9L1; Match level="QueryCoverage=61%, HitCoverage=49%, E-value=9e-56, Identity=65%"; Hit description =Putative bacterial regulatory protein, MarR
  Pfam annotation: Domain name=Acetyltransf_1; Domain location=99-166; Score=20.3; E_value=0.0074; Accession=PF00583.15; Description =Acetyltransferase (GNAT) family
MRVIEALAHLDSAQQQIVAEGLTAYSWALERCRQQPVTSRPNDITIVTGYQPGMIGRIAQMHGEYYARHYGFGHFFEGKVASGLAEFSGRLNNQRNQIWLAVKNGVIVGSVAIDGEDLGNNEAHLRWFILGDGCRGNGVGRRLLTEAINFCDNQRFDAAFNSDGYLSPQSPDATAPVAAASDASAYAADRPPIAVPASPDVPANPLAGRRRAAPAAAFASPGFEGARCRADGRTPRRRRATRLTRFHQLTRSGYSSG

SEQ ID NO: 134701 - protein, 381 aa, Glycine max
  Coding DNA Sequence Number=SeqID_43016
  Gene Ontology: Mol. function=helicase activity; Biological process =viral genome replication
  Homolog annotation: Hit_ID=Q2A9E0; Match level="QueryCoverage=99%, HitCoverage=25%, E-value=7e-80, Identity=42%"; Hit description =Putative uncharacterized protein
MFAFTSPGIKFDKSYNAGKGPPTFRIHGQTHHLIGSLLPMPNNPPKFAQLCIYDTDNEIINRLSQNPLVFILMSHMMHDMLDEHIIIAIKDMLDHNHYAQRFQMARDKLHFAAVPDLKMKLISQRQTDGRLYNLPTTTKVAALIVGDEHSVDKRDIIIEKQSGLLKRIHELHPAYLPLQYPLLYPKGEDGYRLNIPHKDHANIHAAKRKQVTLCEYFCYRLQSRTNEAQTILHSRRLFQQWIVDGYCMIESQKLNYVKQHQQQLKVDKYINLTGSNDHPEKLGRDRGKRIILPSSFVGSQRYMEQLYFDGMTICGHLGFPDLFLIMTCNPTWPEIQRKVTQSNLTPNNCPDIITRVFKIKLNQLLNDLKHGNIFGNIIGCK

SEQ ID NO: 134702 - protein, 172 aa, Glycine max
  Coding DNA Sequence Number=SeqID_43017
  Gene Ontology: Mol. function=DNA binding; Biological process =regulation of transcription, DNA-dependent
  Homolog annotation: Hit_ID=A4A4J6; Match level="QueryCoverage=52%, HitCoverage=87%, E-value=1e-21, Identity=56%"; Hit description =Protein of the plasmid stabilization system
  Pfam annotation: Domain name=Plasmid_stabil; Domain location=81-171; Score=26.3; E_value=0.00011; Accession=PF05016.5; Description =Plasmid stabilisation system protein
  Pfam annotation: Domain name=RHH_1; Domain location=8-46; Score=27.5; E_value=5.1e-05; Accession=PF01402.12; Description=Ribbon-helix-helix protein, copG family
  Pfam module annotation: Pfam domain module=Plasmid_stabil::RHH_1; Domain location=81-171::8-46
MLGAIMSTTTIRIPDELKARVTAVAEQAGVTTHSFILQAIAEKTQQEELRRDFENEAEKRYAKIIATGETVSWKEMRGYLENYAAEVRDDIERILAHLAHYGAADSGRRIQEIIQAIAVLEHNPLIGRALGAGLRELIIGQQARGYLALYKYIPDIDTAFVLAIRSQKEQGY

SEQ ID NO: 134703 - protein, 152 aa, Glycine max
  Coding DNA Sequence Number=SeqID_43018
MVKEECKELSVSSKRLAKKESHFTIKTNIKETSPLRQPPHFLLCKKTPVSIVTPIALEVIPQVKELLDEGLVCKSLNPCALLVPKRGIMRHQIPKIGGMMNVLSGATLFCKITHAPNIFMICVHRDSLGVPINPKRIKVFLEWSTPPSIRKI

SEQ ID NO: 134704 - protein, 50 aa, Glycine max
  Coding DNA Sequence Number=SeqID_43019
MKETLKVVGPLLLDSNSSRDGINPPFQFPIWKLTNKETKRQAITKDQKMK

SEQ ID NO: 134705 - protein, 68 aa, Glycine max
  Coding DNA Sequence Number=SeqID_43020
  Subcellular localization annotation: CTP_CleavageSite=37; ConfidenceScore=5.33e-01
KPSPSPILTLFVQGLLAQHPMGRRSLTRTPSGILGCLAAALSVCPALGKGRRSIGRDPSLYLRPSLST

SEQ ID NO: 134706 - protein, 82 aa, Glycine max
  Coding DNA Sequence Number=SeqID_43021
MVKKRLSFEMPKVAVGLSAYPPLSAASTRLAQRRIWQSISIKVGTHLLRLGTEFLEALVHNIPHWLFWEKSPRSSKEEQLVH

SEQ ID NO: 134707 - protein, 89 aa, Glycine max
  Coding DNA Sequence Number=SeqID_43022
MQRRSTAGDLIPIDLEINATCRRRNQERIRTFMQDLEAATIPEEEPQSSKASSSFPIARHSHFDPIEDHIMAEEPRRVTLKDYSSSNVP

SEQ ID NO: 134708 - protein, 55 aa, Glycine max
  Coding DNA Sequence Number=SeqID_43023
MGEAEKVQGKMKAKSGGHKRANGHNDKGHDEHEEDNGSQCGKDLGSTDGPMMCKF

SEQ ID NO: 134709 - protein, 149 aa, Glycine max
  Coding DNA Sequence Number=SeqID_43024
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
  Subcellular localization annotation: CTP_CleavageSite=43; ConfidenceScore=5.14e-01
MKHFTDTLISANIGKGKCIPSPISKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134710 - protein, 241 aa, Glycine max
  Coding DNA Sequence Number=SeqID_43025
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDDGSSNADITTQQVFGWLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134711 - protein, 104 aa, Glycine max
  Coding DNA Sequence Number=SeqID_43026
DQVIKRCIPDHETDSILRFCHSSAPGVAKVIWVFKRQLAKCLTVAFIGPHLKMREEEFVALDLEQIALESYGMQLICIKMGGSQDSTELRALRSMDTDLTFRQI

SEQ ID NO: 134712 - protein, 231 aa, Glycine max
  Coding DNA Sequence Number=SeqID_43027
MEAMKEQMATMMEAMMIMKKIMEASAVAVAATSTVAKVNLMPPSGLDQMNHPTSAMVGKDLGSTSSPHYVQSQNKHAFPLYGLPPNYTPPNVAYTPSENVNNSTPILIESRQPQNDHAHVSQPMGETHEMPHHNLADFEPCLRYATEGQAIDGIPLQNPLEGPQYHPQLHFLHSTTSKNPHAMAEMGKLDHLEERLRAIKGGEDYAFANLEELFLVPNIITPPKFKVLDFD

SEQ ID NO: 134713 - protein, 153 aa, Glycine max
  Coding DNA Sequence Number=SeqID_43028
  Gene Ontology: Mol. function=protein kinase activity; Biological process=protein amino acid phosphorylation
  Homolog annotation: Hit_ID=Q2A9E0; Match level="QueryCoverage=97%, HitCoverage=10%, E-value=4e-31, Identity=48%"; Hit description =Putative uncharacterized protein
  Pfam annotation: Domain name=DUF889; Domain location=88-153; Score= -139.7; E_value=0.054; Accession=PF05970.5; Description=Eukaryotic protein of unknown function (DUF889)
MVVSSGIASLLLPGGRTTHSKLKIHVPIFEDSTCNIHQGTQLAGLLNETSLIIWDEAPWLTNSFLKHLIKVYEMLLRQNQVLIKSLVILPVIPRGSRSDIVNATINSSYLWNNCHVLTLSKNIRLEANIDAKNREETSAFAQWILDVGDGIVG

SEQ ID NO: 134714 - protein, 67 aa, Glycine max
  Coding DNA Sequence Number=SeqID_43029
MSALSDLSSAKCIPDMNSSGMDKEEREETPLQGEDSLEEAHHHRRPWIRAWRKKEMNEGRGREEHEI

SEQ ID NO: 134715 - protein, 27 aa, Glycine max
  Coding DNA Sequence Number=SeqID_43030
PQGPTNSAHFPFLEDAPASPASPSRRR

SEQ ID NO: 134716 - protein, 141 aa, Glycine max
  Coding DNA Sequence Number=SeqID_43031
MPYVEAAEESLETAFQSFEVVSISSVDSLFGQPCLSDAAVMMARVMLGNGYKPTQADMKRSIAGRKNSGQSSRWRQESEGSPPCHISRSFISAGLGDEGQVFAICGDDVPSTSDLVRPCPPDFQLGNWRVEERPGIYATSI

SEQ ID NO: 134717 - protein, 36 aa, Glycine max
  Coding DNA Sequence Number=SeqID_43032
RLTSSSAPFVPPGTTGHLYAEMLWSPATLVYREERN

SEQ ID NO: 134718 - protein, 44 aa, Glycine max
  Coding DNA Sequence Number=SeqID_43033
MGATDIIIDKQEFKTLVTSHPAGSPDPECPPHLSNVAQEWLEEW

SEQ ID NO: 134719 - protein, 58 aa, Glycine max
  Coding DNA Sequence Number=SeqID_43034
MFFIFNIALKGLDDTPQPKSKAGARWIVVKCNRKKGSTEYGYYVIHWMSTNNLRNFQE

SEQ ID NO: 134720 - protein, 32 aa, Glycine max
  Coding DNA Sequence Number=SeqID_43035
MKTKGINEALGLNPELGLGLNPELSLDLKRAD

SEQ ID NO: 134721 - protein, 139 aa, Glycine max
  Coding DNA Sequence Number=SeqID_43036
LKCLNEKCSWERKLRAYSRHRLQDPNGQIVDKCLVKLQTKFKDNPTVNEGCTVFLPRQLHVASSTSFIKRLPQKASSDQGVPMNPKRIKVIPEWPTPPTPLIEFVRNHVPSWEDAQEMGVERRSLEYEEPQDLRSNPFQ

SEQ ID NO: 134722 - protein, 154 aa, Glycine max
  Coding DNA Sequence Number=SeqID_43037
MIRGDTLWLFAPFCHPEAAGPMTSRDQVWSFCTHDTRRYLMVIRTHSFAICKTERLIACRGLTQSSAPFVPPGTTKSFTCGNFMVARDSCQPRGAKLVSYADFRGPLLDDMRPFFGPCEVLGIHHQAVCEILGTTSHGHPRLSSTERSEISVIH

SEQ ID NO: 134723 - protein, 74 aa, Glycine max
  Coding DNA Sequence Number=SeqID_43038
MPFQRQLDKETFLCTLCIAANKPVDTRRFTSSSAQTISAILTLESRDRRRYPSGYPFKISFAIYETQSMIARRD

SEQ ID NO: 134724 - protein, 75 aa, Glycine max
  Coding DNA Sequence Number=SeqID_43039
MDPWVLVPSPLKDYTSSPSEGCMPSPSEDYTSSPSEDYTSSSSEDFMSSSSEDYTSSPLEDYKSSPSEDCTSSPS

SEQ ID NO: 134725 - protein, 267 aa, Glycine max
  Coding DNA Sequence Number=SeqID_43040
  Subcellular localization annotation: CTP_CleavageSite=61; ConfidenceScore=5.78e-01
MISTWPASAASCNALRRWRSRASARALCLSSSCTPAGSSSSVAAAASSTGVPSVGSLRAPRSSRKRARRQLPTWQATASGDQPSLFNASTSAAASRISAATPGSELRAAWCSGVLPSLSTARESAPLASRVITASGRPCQLSRVTASSGVMPPVRRIHIDAAGDQFAQQAQVRQHRRQHRQAALFAPVRVRQRIRIGTGLQQLQAPVDAAMAGGFIQCRGQFLRCHRLQRRGFGRGGEHRFVLVAGGGQRARAPRPQRCRRDPLQQQ

SEQ ID NO: 134726 - protein, 102 aa, Glycine max
  Coding DNA Sequence Number=SeqID_43041
MGFVHRCLGALGIVLFPNEDGLVDLAAIDAFLAYHHSKESPKMREERRKDYLLHTRSLCMAGLTPLFVMKVDPFVPCKVTAYVSTKGRPIGSNSWKYGRGIH

SEQ ID NO: 134727 - protein, 95 aa, Glycine max
  Coding DNA Sequence Number=SeqID_43042
MVKVGTSYVPINVSFSPKVGPGLPGINRDTKIYLFCEVIFRHSCPSCSATDGVAAQLLGRAIGAGLFAITPAGERGMCCKTIKLGNARVFPVTTL

SEQ ID NO: 134728 - protein, 86 aa, Glycine max
  Coding DNA Sequence Number=SeqID_43043
  Homolog annotation: Hit_ID=A5BEV8; Match level="QueryCoverage=87%, HitCoverage=9%, E-value=1e-08, Identity=36%"; Hit description =Putative uncharacterized protein
MTFFPLRNQPPPDSSVHRMLCVSHVFGNHFVQVYLKDRCPLPPLALLWSTNCYSQAKQWPTSYISRMQQYTSLMSFKRDYVDLNED

SEQ ID NO: 134729 - protein, 176 aa, Glycine max
  Coding DNA Sequence Number=SeqID_43044
MKPRGYIESDHVQDDVPYQVEEMSHVNEVMEVESIFGLQDLRGGDEEVNPANLLKNEEESTNSNGESNNIEQDNEGELEDDDFEICHQVALTLLDPRHMTQVGKGQLGLPMLHLHHLHLRLKLDHLHLMLMNVDHLQYLHPHHLHPPLMHMDCPQYLYPHLPHPLLWATCLQMKML

SEQ ID NO: 134730 - protein, 25 aa, Glycine max
  Coding DNA Sequence Number=SeqID_43045
MARTSSPLKARASSPLKVRTCSPLK

SEQ ID NO: 134731 - protein, 363 aa, Glycine max
  Coding DNA Sequence Number=SeqID_43046
  Gene Ontology: Mol. function=oxidoreductase activity, acting on NADH or NADPH; Cellular component=plasma membrane; Biological process =electron transport
  Homolog annotation: Hit_ID=A6T9X6; Match level="QueryCoverage=84%, HitCoverage=42%, E-value=1e-162, Identity=91%"; Hit description =Electron transport complex protein RnfC
  Pfam annotation: Domain name=Complex1_51K; Domain location=171-363; Score=248.8; E_value=1.2e-71; Accession=PF01512.8; Description =Respiratory-chain NADH dehydrogenase 51 Kd subunit
  Pfam annotation: Domain name=Fer4; Domain location=15-38; Score=26.2; E_value=2.8e-05; Accession=PF00037.18; Description=4Fe-4S binding domain
  Pfam module annotation: Pfam domain module=Complex1_51K::Fer4; Domain location=171-363::15-38
ACPVDAIVGATRAMHTVMSDLCTGCNLCVAPCPTQCIDLRPVAQTTETWKWDLQAIPLFSAFRKDKIWDFNGGIHPPEMKTQSNGTPLRQVPLPQRFVIPLKQHIGAEGELCVQPGDKVLRGQQLTRGFGRMLPVHAPTSGTVTAIAPHSTAHPSALAELSVIIDADGEDCWIERDGWSDYHNKSREELIERIHQFGVAGLGGAGFPTGTKLRGGGDKIDTLIINAAECEPYITADDRLMQDCAAQVVEGIRILAHILQPKQVLIGIEDNKPQAISMLRAVLSDAHGIALRVIPTKYPSGGAKQLTQILTGKQVPHGGRSSDIGVLMQNVGTAYAVKRAVIDGEPLTERVVTLTGEAISRPGN

SEQ ID NO: 134732 - protein, 85 aa, Glycine max
  Coding DNA Sequence Number=SeqID_43047
MEEGQLCEQQPEREAITQRVYAKYRIRDAPTSPFDGDLLFLITGGPLGTIPSSSSEGLHPPTEVLHPHLAQGARPRLQRTTRLQL

SEQ ID NO: 134733 - protein, 65 aa, Glycine max
  Coding DNA Sequence Number=SeqID_43048
MALGLWCILKQWGMPHSCLNMRPPSARQRIKLKVLMMPKDYMNHMLLKDLLKTKQLIKMDDQDSL

SEQ ID NO: 134734 - protein, 51 aa, Glycine max
  Coding DNA Sequence Number=SeqID_43049
MAFVDNWVVGKEETHIGPFTGKDQILKALKNTGHVSTIIVIISFSVFGGAT

SEQ ID NO: 134735 - protein, 54 aa, Glycine max
  Coding DNA Sequence Number=SeqID_43050
MTGHLMMLLSESDRVYPLCGVLCHVLLSAPVLFFTDMVRLHMMSHMLEMERLSL

SEQ ID NO: 134736 - protein, 111 aa, Glycine max
  Coding DNA Sequence Number=SeqID_43051
MIVNQQVKITLTHLGTKFVLHPQTPSQEAKDQLTMKDKRDEEEKLEKQKKKKDSKALSSKTRGKEKEEKDSSKKIVKKENHFATKRILKEHSFLNNLSTFSYQGKHPLALP

SEQ ID NO: 134737 - protein, 172 aa, Glycine max
  Coding DNA Sequence Number=SeqID_43052
MRSWVRGQWIPFDVDALSQFLGYPLVLEKGQECEYSQRRNQADGFDEEAIAQLLCIPGMPPTRHPLDPDKTNRALGFPALITGLCQSFGVPIAPSKIHECFYQLCLSQQGQGFVPFACPTPDQFCAEVAWPGDWPEAQAGEAPAEAPGDAEEARMDEEMTDFLGFLGGSGAT

SEQ ID NO: 134738 - protein, 146 aa, Glycine max
  Coding DNA Sequence Number=SeqID_43053
  Homolog annotation: Hit_ID=A5B963; Match level="QueryCoverage=80%, HitCoverage=15%, E-value=4e-11, Identity=27%"; Hit description =Putative uncharacterized protein
MQKINKRHIQLGDSRCPFCGIEEESAGHLFFLCSKILPIWWESLSWVNLSGVFPNQPRQHFLQHIYGVTEGMRSSRWKWWWMALTWTIWKHRNTIIFSNGSLNANRILDDAIFLLWTWLTNLEKGFNMHYNYWSTNIRAGFLNRIG

SEQ ID NO: 134739 - protein, 204 aa, Glycine max
  Coding DNA Sequence Number=SeqID_43054
  Homolog annotation: Hit_ID=A2Q4L4; Match level="QueryCoverage=43%, HitCoverage=9%, E-value=9e-08, Identity=32%"; Hit description=RNA -directed DNA polymerase
GELWARILDSKYGGWRGLDAATSDNNVSLWWGDLKLALHHPQHETALQGGIAWKADNGWEWNFKWRRHLFDSELGMVDCFLNDVAGSCIQPHRRDEWFWKPEPSRQYSIRSAYDVLKGEKVEGDGVRATKGKIANKVKLEEETVMELSRRNLGSTSPSMRYVCLTEFVITDGGVGSCLSHGRWIGGTTVSVARIRVAVEGDGRK

SEQ ID NO: 134740 - protein, 29 aa, Glycine max
  Coding DNA Sequence Number=SeqID_43055
MLSFGVPMHTKQKIGVPMHSKQKTVFSVS

SEQ ID NO: 134741 - protein, 516 aa, Glycine max
  Coding DNA Sequence Number=SeqID_43056
  Gene Ontology: Mol. function=transcription regulator activity; Cellular component=nucleus; Biological process=regulation of transcription
  Homolog annotation: Hit_ID=A2Q5K3; Match level="QueryCoverage=98%, HitCoverage=92%, E-value=2e-72, Identity=40%"; Hit description=Helix- loop-helix DNA-binding
  Pfam annotation: Domain name=HLH; Domain location=300-349; Score =61.4; E_value=3e-15; Accession=PF00010.17; Description=Helix-loop -helix DNA-binding domain
MDDDDEEYPIPVSKKPSTQNDEIMELLWQNGQVVMQNQNQRPFRKQPPTTDGDGPIPAREIRSSEAENYNSQHLFMQEDEMASWLHYPIHEDPPPFDHHDFCADILYPPPNATASQNQSSASVQSSVRTTELQHPAPRPPIPPPRRQEHTLSRIHNFTHFAKHGNASSSSKAAAPAQPTVATAEHVETGRASVSAAAGKTPASDGGRETATCDVTVTSSPGGSSGSAEPVQREPVVNRKRKGREQEESEYQSEIQDLLTKEHGGLDLMDWSDSCAHDVDFESPEAKKQVRGSTSTKRSHAAEVHNLSERRRRDRINEKMKALQELIPRCNKSDKASMLDEAIEYLKSLQLQVQMMSMGCGMVPMIFPGIQQYMPPMGMGIGMGMGMGMEMGMGMNRSVMPFPNMLASSTLPAATATAHLGPRFPMPPFHMPHVATPDSSRMQGANHPDNNMLNSLGTLDPDQSCIPNFTDPYQQYLSLQQAQLQLMQTMNQPNVSKPSTSRGQENPEKHQSGKVSL

SEQ ID NO: 134742 - protein, 194 aa, Glycine max
  Coding DNA Sequence Number=SeqID_43057
  Homolog annotation: Hit_ID=Q2HVT9; Match level="QueryCoverage=44%, HitCoverage=82%, E-value=7e-20, Identity=54%"; Hit description =Putative uncharacterized protein
  Subcellular localization annotation: CTP_CleavageSite=60; ConfidenceScore=5.62e-01
MVLAIAVGGSYMDCVSPVTMAVPSSSATFSPVTMAAPFQLSSLLAIADGGTAISLTQLTTSMEEQTLLVKSLKTDSDRAELASFLNMFLWLSNFIRSWPLLIYAATWVTVMTFTVAVASLSTEVAFVSAISSSEKCKSDGSLVRVRVPVEETPCFPAHLFTKSHIDVIVPPIFAALVVAASACVVKVVGLWEHD

SEQ ID NO: 134743 - protein, 86 aa, Glycine max
  Coding DNA Sequence Number=SeqID_43058
MKLRPAHRGTHQCIGEENGLWLSLMRLKSSMDWTCFSSSVFWLWGIGKGGKVWGKGWLSERRVGEVRSVEGDEDGAGPKWNKAETA

SEQ ID NO: 134744 - protein, 88 aa, Glycine max
  Coding DNA Sequence Number=SeqID_43059
  Gene Ontology: Mol. function=nucleotide binding; Cellular component =chloroplast; Biological process=response to stress
  Homolog annotation: Hit_ID=A2XJ31; Match level="QueryCoverage=84%, HitCoverage=17%, E-value=5e-22, Identity=63%"; Hit description =Putative uncharacterized protein
MTVLIPRNTIQSQQRKSRVYKGERTRTGDNNLLAKYELSGIPPAPRGVPQITVCSDIDGNDILNVSADDKTTEQDHHYQRQGGHTYRL

SEQ ID NO: 134745 - protein, 239 aa, Glycine max
  Coding DNA Sequence Number=SeqID_43060
  Homolog annotation: Hit_ID=A5AEC9; Match level="QueryCoverage=96%, HitCoverage=88%, E-value=6e-15, Identity=30%"; Hit description =Putative uncharacterized protein
MDTRSPVNAVHDNIISKLEVTFSESLHIHDAQNSEHASEGDHIGNCDVGERNLREGFELQETKLEIKCLKECSTFPYPDMMLPSSSSDEEADASSPSKQSPRQNYSCSVSLPAPRKLVSAMKGSREKERGSQMKLTVKWAPDVYDPVPTLLSHTVKNKKQQKPRIKKSEKKNGKKGQKVSYSKRGSSKDKQYRNRWFYSHDEVFEASSDNAANHDSYCGTSYYLETSLTKVHWSIGEAL

SEQ ID NO: 134746 - protein, 33 aa, Glycine max
  Coding DNA Sequence Number=SeqID_43061
MAPAEAEKKPAERGGGWRKKEGCGEGGLKMEAK

SEQ ID NO: 134747 - protein, 75 aa, Glycine max
  Coding DNA Sequence Number=SeqID_43062
MTVTLMAEPIITLVTRVIMVTNNDNGRIVGYYDEHDNNSDNSGHDVCSNNDDDDNNDRGDKNNNGDKSDNEVVAI

SEQ ID NO: 134748 - protein, 344 aa, Glycine max
  Coding DNA Sequence Number=SeqID_43063
  Gene Ontology: Mol. function=transferase activity; Biological process= D-ribose metabolic process
  Homolog annotation: Hit_ID=A7Q1H4; Match level="QueryCoverage=95%, HitCoverage=99%, E-value=1e-102, Identity=54%"; Hit description =Chromosome chr7 scaffold_44, whole genome shotgun sequence
  Pfam annotation: Domain name=PfkB; Domain location=24-334; Score =65.4; E_value=1.9e-16; Accession=PF00294.15; Description=pfkB family carbohydrate kinase
AEEQKLNFGTQMMSSDSVLPLPENPIIVGFGGVGVDFLAVVPSFPKPDSKIRTTEFTFQGGGNNGNTMTCAARLGLKPRIISKVSNDGPGKTMLEELEAEGVDTSFFVVSKEGTSPFSYVIVDNQTKTRTCIFTPGYPEMVPQDLPRANLLSALDGARMVYFDARMPDSALVIAQEAWTEASSIPRALVSIILRLPRLKFAIVTLGKDGCIMLERCVDDEGSHIEEMDVESCLTTLKERKDDSTAMPTCIASPVTKLRAKGIEESVCGRLYYGASEKIPPSELMDTTGAGDAFVGAVLYAICANISPEKMLPLASYVAAANCRALGARRGLPYSNNPCLASFTE

SEQ ID NO: 134749 - protein, 803 aa, Glycine max
  Coding DNA Sequence Number=SeqID_43064
  Gene Ontology: Mol. function=microtubule motor activity; Cellular component=microtubule associated complex; Biological process =microtubule-based movement
  Homolog annotation: Hit_ID=Q0WQJ7; Match level="QueryCoverage=99%, HitCoverage=72%, E-value=0.0, Identity=60%"; Hit description =Putative kinesin heavy chain
  Pfam annotation: Domain name=Kinesin; Domain location=78-413; Score =576.7; E_value=2.2e-170; Accession=PF00225.14; Description=Kinesin motor domain
  Subcellular localization annotation: CTP_CleavageSite=45; ConfidenceScore=5.51e-01
MMPLTPDQSNKKVGSSMSASPSPFLTPRPERRRPDSRGSDWGSNRQDKDKETNVQVLLRCSHGFKLWPATTIAVAASRPLSDDELRSNVPRVVTCYENKREVSVMQTLANKQVDRVFTFDKVFGPKSQQRSIYEQAIAPIVNEVLDGFNCTVFAYGQTGTGKTYTMEGGMRNKGGDLPAEAGVIPRAVRQIFDILEAQNADYSIKVTFLELYNEEITDLLSPEDNSRPTDEKQKKPITLMEDGKGSVFVRGLEEESVYSLNEIYTLLERGASKRRTAETLLNKRSSRSHSVFTITVYVKETVIGDEELIKCGKLNLVDLAGSENILRSGAREGRAREAGEINKSLLTLGRVINALVEHSPHVPYRDSKLTRILRDSLGGKTKTCIIATISPSAYCMEETLSTLDYASRAKSIKNKPEANQKVSKAVLLKDLYMEIDRMKEDIQAAREKNGVYISHERFAKEEAEKKSNVSCNLFIQSRNEKIEQLENDLSLSEKQVASFRELYLTEQEQKLELESELKDCKVNLEKTSNTLHGLQENYKLLVSTLKEKEHTISKLLKSENALIERAKEMCTDLQNASDDINLLSSKLDHKERLEAENQKTILNFGSLLNGSLKDLHTTITGCVSQQQKQLRSMEDHVSSYLASKNDAAQTLESRINKMTGIYTSGVETLKELANTLHMKASSDMEQIQSKVSSQTLAVENALTKLSLCCVPQQFLATAVHEAKDVICNIQNSIDEQKQLLAFSLQQQEEGFQQSLTSARVVSEAAVNFFDDIHLRSSRVMKILEESQNERFQQLTNFEKKFKV

SEQ ID NO: 134750 - protein, 288 aa, Glycine max
  Coding DNA Sequence Number=SeqID_43065
  Gene Ontology: Mol. function=structural constituent of ribosome; Cellular component=intracellular; Biological process=translation
  Homolog annotation: Hit_ID=Q53U38; Match level="QueryCoverage=45%, HitCoverage=97%, E-value=2e-51, Identity=85%"; Hit description =Similar to 60S ribosomal protein L35
  Pfam annotation: Domain name=Ribosomal_L29; Domain location=160-229; Score=60.5; E_value=5.9e-15; Accession=PF00831.14; Description =Ribosomal L29 protein
MMVVDLINLQQNRLNDVVANELEPRVPEQMHQVLFSSREEIVDHDDVVTASDEFVDEVAPDEARAAGDDDSLPPAADPDRNAARARPCAAEAGKPGSREECVGRLGWAHAGESGLDDEEGGADEDADEDEQEALLAEEVVDGSGERSGVLDGFGGVGIKVYELRNKTKAELLNQLKDLKAELALLRVAKVTGGAPNKLSKMYCSDYCYAGIAKVVRLSIAQVLTVISQKQKAALREAYKKKKYLPLDLRPKKTRAIRRRLTKHQASLKTEREKKKELYFPLRKYAIKV

SEQ ID NO: 134751 - protein, 356 aa, Glycine max
  Coding DNA Sequence Number=SeqID_43066
  Homolog annotation: Hit_ID=A5BAR8; Match level="QueryCoverage=80%, HitCoverage=80%, E-value=7e-55, Identity=45%"; Hit description =Putative uncharacterized protein
MATKQVTTTMVHVDDDDYIDMELCNSSPNFFSYSLSSPPSNREFEFQMSEKESLTSPADDLFYKGKLLPLHLPPRLQMVQKLVENSSTNAKFEYIKSDSPSTNANTPFESNISPSESRRVSSDVSPNEYQLGWFSDINKYNLSGGDLPKKSLPKKLKQMKQFWLGLRLKASRAYLKTLFNKSGCSDKFCASAASNNNMGAEKKSLKCKECQNKYMKVARRNPFESFYDSKDQATCSVVKSIRREMLEVVEDDFCDHRRSFSGVGQRHCSTKASSLSTSSSGSSSSSSSFSFSSAGYYDLQLFKRSISANYELESSIQGAIAHCKQSQQQCGSKNGSDDRRICSQFATKMQLVRVNE

SEQ ID NO: 134752 - protein, 102 aa, Glycine max
  Coding DNA Sequence Number=SeqID_43067
MAHQEMKLSVVGLAGGEIVAGTVGVEVVELHVDGHSDGGFRGTVGEEEAIFIGDGDGVGMAEGWGRKKPSRERFAWWDGTTTDTDTDTDGGLVVVCGKDYLI

SEQ ID NO: 134753 - protein, 442 aa, Glycine max
  Coding DNA Sequence Number=SeqID_43068
  Gene Ontology: Mol. function=receptor activity; Cellular component =integral to membrane; Biological process=ion transport
  Homolog annotation: Hit_ID=Q9C5T6; Match level="QueryCoverage=93%, HitCoverage=94%, E-value=1e-152, Identity=65%"; Hit description =Putative uncharacterized protein F11F8_41
  Pfam annotation: Domain name=Lung_7-TM_R; Domain location=131-419; Score=147.5; E_value=3.8e-41; Accession=PF06814.4; Description=Lung seven transmembrane receptor
MGITASTNAVATLLLLFFFISPSAAEIKTLTITSDTRPMILLEKFGFTHTGHVSISVSSVFVVASGGSQPDPSRLGFFLLSEESLLQVLIEIQQNPSFCVLDSRYTTHLFTFRELSPPPSASANHTSPVTIPNEYSLFFANCAPETSVSMLVHTELYNLDADSEHSRDYLSAGQTQLPTLYSLFSFAYFAFLALWIYICYSNKLSLHRIHLLMAALLLMKALNLLSAAEDKHYVKVTGTPHGWDVLFYIFQFFRVVLLFTVIVLVGTGWSFLKPFLQEREKKVLMIVIPLQVLANVASVVIGETGPFIKDWVTWNQVFLLVDIICCCAIIFPIVWSIRSLRETSKTDGKAARNLAKLTLFRQFYIVVIGYLYFTRIVVFALKTIAAYKYQWVSNLAEEAASLAFYVVMFYMFRPVERNEYFVLDEEEEEAAEIALRDEEFEL

SEQ ID NO: 134754 - protein, 866 aa, Glycine max
  Coding DNA Sequence Number=SeqID_43069
  Gene Ontology: Mol. function=molecular_function; Cellular component =nucleus; Biological process=regulation of fat cell differentiation
  Homolog annotation: Hit_ID=A5AI91; Match level="QueryCoverage=100%, HitCoverage=99%, E-value=0.0, Identity=56%"; Hit description =Putative uncharacterized protein
  Pfam annotation: Domain name=LNS2; Domain location=691-822; Score =67.4; E_value=4.9e-17; Accession=PF08235.4; Description=LNS2 (LipinNed1Smp2)
  Pfam annotation: Domain name=Lipin_N; Domain location=1-105; Score =191.7; E_value=1.9e-54; Accession=PF04571.5; Description=lipin, N -terminal conserved region
  Pfam module annotation: Pfam domain module=LNS2::Lipin_N; Domain location=691-822::1-105
MNVVGKVGSLITQGVYSVATPFHPFGGAVDVIVVQQQDGTFRSTPWYVRFGKFQGVLKGAEKFVRINVNGVEANFHMYLDNSGEAYFLKEVDDDKVVDSIEAVQDSIDKKNGYLSNVHRLDHSISDSGVLQLKDESDSLVLPQLQRAESDVDRRFYEFPDDRSSLEDSVELSEYESNSYESLEGDNFGESQGSHPEMVLVSVDGHILTAPISESEQTEENVQLKTPQFHLGPGEETDLCEGNGEFSTGESAWAADYINQLGAQTTNVQSRRCDTNGDDNTSKLLLEVCQGEEAHICLAQDTVEIKNQEDHMKTDSEEAASGIKRENVFKSCLELQDFGQQAGNADLQNIGSSLKIQNSVEESNASHPAVDENEQESIAISKNGDELSPPSGSASSNGHRSPKSELETQEVEKNASGEVETASGSHSVTTYSEQNDEHVDKTVTNDELDDNQQTPALKDVRATSEVVEPQTETSNKGDQSHLGLGFEISLCGHELKVGMGSVAAAEAFEAHRISVVDFTSSAPSIIKNQNLVIKFKERYMTWEKAAPLVLGMAVYSLDLPVESKDTIPVEQDHALKSRDDDLGSSSSGRRWRLWPIPFRKVKTFEHTNSNSSNEEVFLDSESGSLIEPTPASSTQGSPHKQFLRTNVPTTKQIASLNLKEGQNLVTFSFSTRVLGTQQVDAHIYLWKWNARIVISDVDGTITKASPGAAVKLCLGDLLVMGSNPETASLHMQGASPGAAVKLCLGDLLVMGSNPETASLHMQGAPHEFKIACLEDIKRLFPSDYNPFYAGFGNRDTDELSYRKIGIPKGKIFIINPKGEVAISQRIGAKSYTSLHTLVNDMFPPTSLVEQEDYNSWNYWKTPLPDID

SEQ ID NO: 134755 - protein, 326 aa, Glycine max
  Coding DNA Sequence Number=SeqID_43070
  Gene Ontology: Mol. function=endopeptidase inhibitor activity; Cellular component=extracellular region; Biological process=response to biotic stimulus
  Homolog annotation: Hit_ID=A7PSV1; Match level="QueryCoverage=45%, HitCoverage=60%, E-value=2e-34, Identity=46%"; Hit description =Chromosome chr8 scaffold_29, whole genome shotgun sequence
  Pfam annotation: Domain name=SCP; Domain location=188-309; Score =66.8; E_value=7e-17; Accession=PF00188.17; Description=SCP-like extracellular protein
MKKKRSSKFGREVLPGKEVKNMREMKRRRGTLELGMDMVRTGMQENGGCSWKKGFECGRLTGSRCDSLTSRLPLQPSSTPTSFPIDSNAPQRSSPQTPPATSFPADSNAPQQPSPQTPPATSFPADSNAPNLPSPSSENRSLQGVGRHKGGHHSGRRKRVNTRKYFGYVPQTNDTSFTNQTALAQEFLHAHNWIRKQYNLPEYTWDEKLASYARGYLMQRYEDCKLVHSNSNYGENVFWGKKLHWSPSDATYYWYQEKQWYNFQTLSCAPPPKACGHFTQVVWRDSQRIGCALQHCHNPSLGMLIACEYDPAGNYENEDPLKQHER

SEQ ID NO: 134756 - protein, 365 aa, Glycine max
  Coding DNA Sequence Number=SeqID_43071
  Gene Ontology: Mol. function=phosphoprotein phosphatase activity; Cellular component=nucleus; Biological process=multicellular organismal development
  Homolog annotation: Hit_ID=A7PSU5; Match level="QueryCoverage=99%, HitCoverage=97%, E-value=1e-149, Identity=70%"; Hit description =Chromosome chr8 scaffold_29, whole genome shotgun sequence
  Pfam annotation: Domain name=PP2C; Domain location=35-317; Score =115.1; E_value=2.1e-31; Accession=PF00481.12; Description=Protein phosphatase 2C
MVRSCWKPIADGDEGDGSGRVDGLLWYKDLGNHLYGEFSMAVVQANSSLEDRGELESGPLSSNHLGPQGTFIGVYDGHGGSEASQFVSDNLFCNLKRLASENQGVSEHVIKRAYSATEESFLSLVKKQWLSKPQIASTGTCCLVGVICNGMIYVANSGDSRVVLGRLERATREIEAIQLSTEHNVNQESVRDELRSKHPFDSQIVVLRQNVWRVKGLIQVSRSIGDAYLKKAEFNRDPLPAKYRLAETFFRPILSCEPSTSSHTLHPDDQFLIFASDGLWEHLTNQEVVSIVSNNPPNGIARRLVKAALREAAKKCEMRLSDLQKIEQGMRRHIHDDITVIVVFLNPKLTENTSLCGSPLSIKGD

SEQ ID NO: 134757 - protein, 194 aa, Glycine max
  Coding DNA Sequence Number=SeqID_43072
  Homolog annotation: Hit_ID=Q5XM22; Match level="QueryCoverage=47%, HitCoverage=66%, E-value=4e-13, Identity=39%"; Hit description =Resistance-like protein HAAS-2
MENVGGNSQGFPSRRQNTSVLTNYFDYVTVKLTSHGKKVEKFRRSALEIEDRVVVIGLSSLITCPLKTGCTLFSNKSATHISVEFLDAFHDLTQSKRFSWGVTALVHMYDNLNVVSKHLTKHLAGYITFLQSWIYKHFLTIANIIADKDYYERKPRACRWKCGKTLPVTTYHRRFDHRAFKEFELISLFSGHIR

SEQ ID NO: 134758 - protein, 63 aa, Glycine max
  Coding DNA Sequence Number=SeqID_43073
MALFEMVGESYGSAMVACKRQPTAFALWAAAKLTAATRYTASRHKPKAQEEDNQATISLNDFA

SEQ ID NO: 134759 - protein, 100 aa, Glycine max
  Coding DNA Sequence Number=SeqID_43074
MLGVRGCIRKNPSPTLARDGANLKLQRWQTWWISLTWCIWHHRNRSVFSNESFNSNKLMEDALFFCWTWLKNLEKGFDIPFHYWSSQIRDGFCNQGGISI

SEQ ID NO: 134760 - protein, 326 aa, Glycine max
  Coding DNA Sequence Number=SeqID_43075
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=A7Q401; Match level="QueryCoverage=87%, HitCoverage=100%, E-value=1e-108, Identity=71%"; Hit description =Chromosome chr13 scaffold_48, whole genome shotgun sequence
  Pfam annotation: Domain name=ADK; Domain location=98-292; Score =161.1; E_value=2.9e-45; Accession=PF00406.13; Description=Adenylate kinase
MEDAHNEDVGLDKTVGFVGSNNFMEMELGIRKKRNSANHIIMVAVTRLAKRASTFSPQMRRCLSSSEVKSHAPPHDAASFRPFPRREDLSKRCVQWAFLGCPGVGKGTYASRLSNLLGVPHIATGDLVRDELASSDPLSSQLSEIVKQGQLVSDEIIIRLLSKRLVAGEAKGDLGFILDGFPRTIKQAEILEGVTDIDLVINLKLREDVLLEKCLGRRICNQCGGNFNVASINIKAENGSPEIIMAPLLPPENCMSKLITRSDDTESVVKERLRIYNEMTQPVEEFYRSRGKLLEFNLPGGIPESWPKLLHALNLDDYEDKRSAAA

SEQ ID NO: 134761 - protein, 417 aa, Glycine max
  Coding DNA Sequence Number=SeqID_43076
  Pfam annotation: Domain name=Transposase_24; Domain location=164-306; Score=-7.6; E_value=0.0024; Accession=PF03004.5; Description=Plant transposase (PttaEnSpm family)
  Subcellular localization annotation: CTP_CleavageSite=72; ConfidenceScore=5.47e-01
MSSGGADPPRPLSHDSSEKGTSGKKKRYMVRLLLPRDSLTSSTPSLSIVSMRVRSSDVAPAPSPPPTEVRPSPSHLDACFTHLRLRQRLSLCPLGNNFVTLDLHGEQFQKIIKNFFPSIFRENWSGDLRKKMKLRKFLTRNPFINFLRCLGMPEMKIKRAYWIEDRVWNDLLLHWNALEYCSKCAHAKKRASEKGGCKYTSGSISLQDHTIRLLEEFGRSVYIDEVFQQTHLRNDTGQFVNDRSRQKHLWDQSIRDAFMILETLLILINVGMTTSCNIHKDLLIALKMPQRFNRLREELCQLKEKMHAKEENVQKVVDDSLSETDWPSETHPLSETSSSLSGWEILEEDKSEFCTLSPQPARPVMMLSLLALSASILALRNFTYSRSVRHARRASLCVMRSPRTFKTLRLVETKRHN

SEQ ID NO: 134762 - protein, 744 aa, Glycine max
  Coding DNA Sequence Number=SeqID_43077
  Gene Ontology: Mol. function=ubiquitin-protein ligase activity; Cellular component=intracellular; Biological process=protein modification process
  Homolog annotation: Hit_ID=A7PSS0; Match level="QueryCoverage=88%, HitCoverage=99%, E-value=0.0, Identity=69%"; Hit description =Chromosome chr8 scaffold_29, whole genome shotgun sequence
  Pfam annotation: Domain name=HECT; Domain location=394-744; Score =358.7; E_value=9.7e-105; Accession=PF00632.16; Description=HECT -domain (ubiquitin-transferase)
  Subcellular localization annotation: CTP_CleavageSite=29; ConfidenceScore=5.31e-01
AKGTEHARSSSVQVVSQPESPSPLQSPSNASSVPVEIPVILRTSDMMTDLPETQMEEAKLSQPRPGQAVNENAGESSSSGTQGYAEQELQMNTEPNSKLEKQHPASCSNEAGQKLDFYLEGQHLDHKLTLYQAILHHIIKKNADSFSSAKLWSQVHIITYRRDVESEDVIPPECHSSPQHFSDEKVLAYYQHTPFFSDMFSCELVSDLEMSSPIYDILFLLKSLESMNRIIFHLMSRERICAFAQGKVDNLDSLKITVPSVPQIEFVSSKLTEKLEQQMRDSLAVSICGMPLWCNQLMASCPFLFSFEARCKYFRLAAFGQPQVQPSHNGSGTVSDRRLSPGGLPRKKFLVHRDRILESAAQMMDLHASNKVVLEVEYDEEVGTGLGPTLEFYTLVCQEFQKSGLAMWREDDSSFTLKTNLQAEEIGVHSFYGLFPRPWSSMQDTSGGIQFSEVTKNFFLLGQVVAKALQDGRILDLHFSKAFYKLILGKELSLYDIQSFDPGLGKVLQEFQALVMRKKFMESVSGGNSELQYGLSFRDMSIEDLCLDFTLPGFPDIVLASGTDHTMVNMRNLEDYVSLIVDATVRSGVSRQVEAFKSGFNQVFSIDHLRIFNEEELERMLCGEYDSWAVNEFGDHIKFDHGYTASSPPIVNLLEIVREFDNGQRRAFLQFVTGAPRLPPGGLASLNPKLTIVRKHCSNRADTDLPSVMTCANYLKLPPYSSKERMKEKLLYAITEGQGSFHLS

SEQ ID NO: 134763 - protein, 709 aa, Glycine max
  Coding DNA Sequence Number=SeqID_43078
  Gene Ontology: Mol. function=phosphoprotein binding; Cellular component=membrane; Biological process=signal transduction
  Homolog annotation: Hit_ID=A5BX17; Match level="QueryCoverage=87%, HitCoverage=94%, E-value=1e-153, Identity=48%"; Hit description =Putative uncharacterized protein
  Pfam annotation: Domain name=Pox_A_type_inc; Domain location=159-178; Score=1.8; E_value=46; Accession=PF04508.3; Description=Viral A-type inclusion protein repeat
  Pfam annotation: Domain name=Pox_A_type_inc; Domain location=297-319; Score=6.1; E_value=11; Accession=PF04508.3; Description=Viral A-type inclusion protein repeat
  Pfam annotation: Domain name=Pox_A_type_inc; Domain location=474-496; Score=8.9; E_value=4.3; Accession=PF04508.3; Description=Viral A-type inclusion protein repeat
  Pfam module annotation: Pfam domain module=Pox_A_type_inc::Pox_A_type_ inc::Pox_A_type_inc; Domain location=159-178::297-319::474-496
MGGSGVSLLGVSLKGLCAVCLLGFLLNADPRKCGSGALKERFFSLPFLSTQILLKYADTKSKLFGETPNESILRCFFICMLIGLCLSVSRTGTSEVPQRKSPASPQNARKLKTPGSDTDSVSSSPKPGSKTPKNRSPKVTERKSPRSPISEKKRPGRVQELESQLAQLEEDLKRTKDQLNSSESWKRKAQQEAEEANKQLLAVSKELEESQQQLLELSASEEERLQELRKISQDRDRAWQSELEAVQKQHSMDSTALVSAMNEIQKLKIQLERVRECEAVHISNAESDNAEIEDLRMELDEALTLVEKLKSEVIDCKESESRALEVVGKTQMQLEAANKTVETLQLEGEKASEAYKSLALELEQSRAQVKSLEELVSKLQADLVGGGNKNMLGPVNEAELELAPKNVQNEEINHLKAELVSAKSEAVQLKSALDVSEVRYQEEYIRSTLQIRSAFEQLEHAKSESSQRQGELNEELKRARADIEELREKMMDKESQLQGLSDENEMLVSRIKQNQPSERDSEPVVALKKLDADITELKKRLLDRETELQNVTEENNALKKEIKRVELEKNKIPDEAVASAEAARAAEREALMKLGYITEEADKSNQRVAQITEQLDTAQAANSELEAELRRLKVQSDQWRKAAEAAAAMISSGNNGKFVERTGSLDSSYNSVTAKMSSPYSEDTDDDDSPKKKNTNMLKKIGVLWKKTH

SEQ ID NO: 134764 - protein, 137 aa, Glycine max
  Coding DNA Sequence Number=SeqID_43079
  Gene Ontology: Mol. function=catalytic activity; Cellular component =photosystem I reaction center; Biological process=electron transport
  Homolog annotation: Hit_ID=Q41228; Match level="QueryCoverage=46%, HitCoverage=45%, E-value=1e-27, Identity=92%"; Hit description =Photosystem I reaction center subunit IV A, chloroplast precursor (PSI-E A) [Contains: ...
  Homolog annotation: Hit description=Photosystem I reaction center subunit IV A isoform 2]
  Pfam annotation: Domain name=PSI_PsaE; Domain location=76-137; Score =106.8; E_value=6.6e-29; Accession=PF02427.8; Description=Photosystem I reaction centre subunit IV  PsaE
MFHSKPLSACAALVLFPRLRSPKREPKTHNTDSHKELQEKSSWHQQHLDEPAAAAPATATPPAEAEAKPKPPPIGPKRGAKVKILRKESYWYKGTGSVVAVDQDPNTRYPVVVRFNKVNYANVSTNNYALDEIVEVE

SEQ ID NO: 134765 - protein, 78 aa, Glycine max
  Coding DNA Sequence Number=SeqID_43080
  Subcellular localization annotation: CTP_CleavageSite=20; ConfidenceScore=5.60e-01
MSADSPPHNGAGKLGNANANANANAGFKRSERGRQWCGLQPHMTSFVASSIASLMLLSSLTTISPSNTPLNTTTITTS

SEQ ID NO: 134766 - protein, 181 aa, Glycine max
  Coding DNA Sequence Number=SeqID_43081
  Homolog annotation: Hit_ID=A5BV50; Match level="QueryCoverage=32%, HitCoverage=37%, E-value=3e-14, Identity=61%"; Hit description =Putative uncharacterized protein
MLVLYTRGGASSSGSFSVAQFIFRVHFLMPIGKASNDHLSDTSYMLEESLVNGLLILQVWEVEPGIKYAAPFTLLRLKQENRTKFYPSTVPSIFHVCDLHIALSLLLALILRATVSSRRADFDYEDGYDVRGRSWEPLLNPQPGQPSGSSKGDNSGNHSDFWSVRMREKITDEHAGYISVL

SEQ ID NO: 134767 - protein, 100 aa, Glycine max
  Coding DNA Sequence Number=SeqID_43082
MSQEQAHHHRKPDDDKGDDKKLKGQSKNEFKMFKIESRTLQDSRGKLKNTSRFKRKVDFKIQELREDLIKISMKRFFQKLSSTWIFLKNMFTKEFLLSSN

SEQ ID NO: 134768 - protein, 161 aa, Glycine max
  Coding DNA Sequence Number=SeqID_43083
MPPRKLSAKRSRRNAAVEGTSTASKFDSHRFRSAEHQQRVEAIKGWSFHRERHVQLRDDEYIDFQEEIAHRCWTLLVTPMAKFDPDIVLEFYANAWPTEEGVRDMRSWVRGQWIPFDADALSQFLGDPLVLEEGQECEFSQRRNRADGFDEEAIAQLLCIP

SEQ ID NO: 134769 - protein, 125 aa, Glycine max
  Coding DNA Sequence Number=SeqID_43084
  Subcellular localization annotation: CTP_CleavageSite=32; ConfidenceScore=5.31e-01
MVKVGTSYVPINVSFSPKVGPGLPALRAGSISAASVKPGVPNDADANTHTRRLNCLPLQGCPLSPCQGNLSCNCIKNGNARGSSAALRYYASGAKGRMCCNWRLLCWVTVPGCFPVTKAFCEKKS

SEQ ID NO: 134770 - protein, 143 aa, Glycine max
  Coding DNA Sequence Number=SeqID_43085
MAVQLIHDRVEMECLEGAWETLKGNVRCRFRGTIRFTATSLVHPGEPARTLQRTVEWILPTPTPYRLAELVQVIEVTPSKEDPEEYPEELPPEPAVDALDFLEGDEDPPLEVDSPEDVMSASEADFTEESGPGEMATSGGSSS

SEQ ID NO: 134771 - protein, 165 aa, Glycine max
  Coding DNA Sequence Number=SeqID_43086
MGEVEEVQEKMKADMEAMKEQMATMMEAMMIMKKIMEASAVAVAATSTVAKVNPMPPSSLNQMNHPTSAMVGKDLGSTGGPHDVQIQNEHAFPPYGLPLNYTPPNVAYTPNKNVNNSTPILVESRKTQTNHAHVSQTVEETHEIPHHNPADSEPCLGYATEGQAV

SEQ ID NO: 134772 - protein, 99 aa, Glycine max
  Coding DNA Sequence Number=SeqID_43087
  Subcellular localization annotation: CTP_CleavageSite=44; ConfidenceScore=5.20e-01
MPISPCGSISWSVPSRHRDRARKTSSGPGGAQQGPRVSDSGIALARHPVGPKKSNKVLELPALITGLCQFYGVFVAPNKVIMPPTNRAFIKKYCALRQA

SEQ ID NO: 134773 - protein, 164 aa, Glycine max
  Coding DNA Sequence Number=SeqID_43088
  Homolog annotation: Hit_ID=A0PAV3; Match level="QueryCoverage=21%, HitCoverage=15%, E-value=8e-07, Identity=80%"; Hit description =Restriction endonuclease
MVKVGTSYVPINVSFSPKVGPGLPGINRDTRIYLFCEGGRKENMHSHFRYTRSSLFAIRRPRGVPWLLFLSAVPPVQMTGIVIRVTIRHTSIRAGSIRSVKPGVPGVSSQKCCAGEKSDGQSEYVIRLIYPLPRITDSLRSVVMRRRSESGLPQRGRNSDARNS

SEQ ID NO: 134774 - protein, 159 aa, Glycine max
  Coding DNA Sequence Number=SeqID_43089
ASLTGEKWWVSTNGHSWLGSDNAIPEGVGSWALDPFGPGERVTLGRGLVNQLVAPLVEASQFKYVIRRGIRPRGISIGTSPSDFARRRSRHSPRAMRKDESPARTTRASFPACGSSVITYSDLRELADRSLSGDAPSSMSEPFRNWLGMGVTIPALIQP

SEQ ID NO: 134775 - protein, 163 aa, Glycine max
  Coding DNA Sequence Number=SeqID_43090
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=33; ConfidenceScore=5.87e-01
MPRTAVAISDTAPTSRATTSTTSSQSSQKRPTRAVASSPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134776 - protein, 95 aa, Glycine max
  Coding DNA Sequence Number=SeqID_43091
  Gene Ontology: Mol. function=peptidase activity; Cellular component =endoplasmic reticulum; Biological process=signal peptide processing
  Homolog annotation: Hit_ID=A3BAL3; Match level="QueryCoverage=55%, HitCoverage=25%, E-value=1e-18, Identity=84%"; Hit description =Putative uncharacterized protein
RVPFAIQAAQLLGRAIGAGLFAITPAGERGMCCKAIKLGNARVFPALMCITGSESPVVVVLSGSMEPGFKRGDILFLHMSKDPIRAGEIVVFNVD

SEQ ID NO: 134777 - protein, 67 aa, Glycine max
  Coding DNA Sequence Number=SeqID_43092
AVASGGSNPARLGELGGKHLPYFAINRGGTEALPKRFRNVFREEFRKGFDRSSTYFIRSSSFFDLQR

SEQ ID NO: 134778 - protein, 72 aa, Glycine max
  Coding DNA Sequence Number=SeqID_43093
MKILSSGVVFTLEEGDHFKALDLKNDPFYLGRSLPPISPRRARLLPPEATAFWRNLLEGPSGPGCYLQPPFY

SEQ ID NO: 134779 - protein, 258 aa, Glycine max
  Coding DNA Sequence Number=SeqID_43094
MRSWVRGQWIPFDADALSQFLRDPLVLEEGQECEFSQRRNRADGFDDEAIAQLLCIPGQDFARTVAGRRVQIMRTNMTTLTQIWMTLLLSNVLPNDHNSDLPLSKCQLVYAILTWMSVHVAQLIADAIYLFAEPWDFQGDAPQATDAPSPPHQADPAGSLGMERYLQHLVRQQAANHRVQVQIHECLYQLSLSQQGQGFAPFACPTLAQFRAEVAWPGDWPKAQTEEVPAGAPDDVEEARMDEEMTDLLGFLGGSGAM

SEQ ID NO: 134780 - protein, 101 aa, Glycine max
  Coding DNA Sequence Number=SeqID_43095
MEKSMIDASSGGAFGDMTPVEARNLIEKMASNSQQFSVRNDAIVLRGVHDVATNSSSSAENKKLKGKLDALVNLVTEACHKSEICICTCYCCKNLWPMFFY

SEQ ID NO: 134781 - protein, 184 aa, Glycine max
  Coding DNA Sequence Number=SeqID_43096
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
  Pfam annotation: Domain name=CinA; Domain location=1-100; Score=-4.2; E_value=9.3e-08; Accession=PF02464.8; Description=Competence-damaged protein
MIGVDGATLEAHGAVSEPVVRQMALGALNAAAATWAVSVSGIAGPDGGSAQKPVGTVWFGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134782 - protein, 165 aa, Glycine max
  Coding DNA Sequence Number=SeqID_43097
  Subcellular localization annotation: CTP_CleavageSite=33; ConfidenceScore=5.56e-01
MLIPSTLFWRLKWSWRKRRAYPPNPGTRKSRARGSEAPSSSAAPAPPTSALPSTPAPTPLAPIHLGTSAQSSELIISMLQSLHEGKLLVMQSLQDVVQQRPVMSVEEFSQRVAWPGVQPSRLGGGEASTAQEPQPDQEDDSSEATLTPPEPLIFEDDLVADPVTA

SEQ ID NO: 134783 - protein, 137 aa, Glycine max
  Coding DNA Sequence Number=SeqID_43098
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=89%, HitCoverage=96%, E-value=2e-25, Identity=56%"; Hit description =Putative uncharacterized protein
  Subcellular localization annotation: CTP_CleavageSite=57; ConfidenceScore=5.35e-01
MTMITPSSKLTLTKGNKSWYRAPPRGRRVDIRFGQDRCRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 134784 - protein, 43 aa, Glycine max
  Coding DNA Sequence Number=SeqID_43099
MEDEENEDVGLPLELEKIVAHEDQEMGPHQEETNRIPAARGIH

SEQ ID NO: 134785 - protein, 225 aa, Glycine max
  Coding DNA Sequence Number=SeqID_43100
  Subcellular localization annotation: CTP_CleavageSite=24; ConfidenceScore=5.11e-01
MPTGDSGLMSRQRTSTYCTPRSASAVMGRSQRPGGALGADAGVVLVFDLQHVGVELDPFAVAMRAEFLVVGPGLGDRVVQAAEEGVEIVVAELELRLRLVLVAQVAHAQAGGVGQVQGMVAQALQAVLAIAQEITRQRRRGAEQVHQQPGIAREVADQADVAARTPVLVGAGLGVEHRPQRFGQREVVVDAGDALHGLAVALGQAATVDVLEHAGIGRAVPGDGN

SEQ ID NO: 134786 - protein, 64 aa, Glycine max
  Coding DNA Sequence Number=SeqID_43101
MDEVLEALKKFQNGNYESENLEKGDDDGVISSTSSSEKEKLFNRNRNAGSNLTRKGKLQNVEEQ

SEQ ID NO: 134787 - protein, 91 aa, Glycine max
  Coding DNA Sequence Number=SeqID_43102
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKVGPGLPGINRDTRIYLFCESDLPSQVLQWLLFLSAVPPVQLLTGWCVTAKAPPDISAGKCSGHAARNHHTRRA

SEQ ID NO: 134788 - protein, 100 aa, Glycine max
  Coding DNA Sequence Number=SeqID_43103
  Homolog annotation: Hit_ID=UPI0000ECBAF8; Match level="QueryCoverage =43%, HitCoverage=50%, E-value=1e-17, Identity=100%"; Hit description= UPI0000ECBAF8 related cluster
MRLDEKEQSRHHREGPGKPFIEFLQPGGSTSSRAAATAGGAPIRPIVSRITIHWPSFYNVVTGKTLALPNLIALQHIPLSPAGVIAKRPAPIALPNSCAA

SEQ ID NO: 134789 - protein, 95 aa, Glycine max
  Coding DNA Sequence Number=SeqID_43104
MTKARQKRGKEGQACHPARPGEPGFLEGPKHHGLPNDGCQRPRSGQAKVACCRNLPFCGRARQGSRVRLPKEDNAQSRHQRLFVENVGKTEGNRS

SEQ ID NO: 134790 - protein, 125 aa, Glycine max
  Coding DNA Sequence Number=SeqID_43105
MKQKGKRKKVREGRHVIVKKYKSFVKSKHIFWKQGIDAKSLFSGITEIRMDEFIELIKEHNWEALGCLSAHLAVAMTNFARCFQIIIVTRALWSDRGVRPETNTLTPKFVSPQISRLGSHDKRPH

SEQ ID NO: 134791 - protein, 49 aa, Glycine max
  Coding DNA Sequence Number=SeqID_43106
QFRAESHGPEIGLRPRQGGAAKAPGDGEEARMDEEMTDLLDFLGGSGAT

SEQ ID NO: 134792 - protein, 237 aa, Glycine max
  Coding DNA Sequence Number=SeqID_43107
  Gene Ontology: Mol. function=catalytic activity; Cellular component =integral to membrane; Biological process=metabolic process
  Homolog annotation: Hit_ID=A9CIU4; Match level="QueryCoverage=100%, HitCoverage=45%, E-value=1e-123, Identity=91%"; Hit description =Phospholipase D family protein
AVIVGGRNIGDAYFDAAERANFHDFDILGFGDVVADATEIFDDYWNSAVSVPVRSLLARRPSKLARLRRELDALPKSEAAKPYLERVESQYDRDHFLMSDRMHWVDSVDVLADPPEKAAGKRRKGHNFLMESLLPLLQAASDSLHVTSPYFIPGKQGVEIFLDIAERGVSLAILTNSLAATDVAAVHAGYARYRKPLLSGGVRLHELRSQVDQPNFTLRGSGQASLHTKAFTRDGMT

SEQ ID NO: 134793 - protein, 252 aa, Glycine max
  Coding DNA Sequence Number=SeqID_43108
MRGAPTEESLSPFLVRDLGAQSLKENFEAPEEDEEVQALKLELGKARLAKEKFKSAATHIRKECTELQEENAATARALEQETKRARKEEYGREKFRGALWGSNNELKLRRKERDRSRVHGMILKEELAACARSKRSLAQNLEATEQSMIAIIGQYKEELNQSVAYEQKLVEDFAQVYAEKEARGRVIDALHQEATMWMDRFALTLNGSQDLPRLLAKAKAMAEVCTAPEEIHGLINYCQHMIDLMAHIIRNR

SEQ ID NO: 134794 - protein, 80 aa, Glycine max
  Coding DNA Sequence Number=SeqID_43109
MQEQIEEAKEHRLDENALIPHDEAPCGACRPWIIFINEVLCFLKINGSGMEKKKYDWRCHFKEKMSQEQAHHHKKPWIRV

SEQ ID NO: 134795 - protein, 391 aa, Glycine max
  Coding DNA Sequence Number=SeqID_43110
  Homolog annotation: Hit_ID=Q6WAY6; Match level="QueryCoverage=81%, HitCoverage=61%, E-value=2e-38, Identity=31%"; Hit description =Putative uncharacterized protein
MGTNQTGKRFYQVKVKSLDTTSIKELGRLMEPLQMQAFRKTYGKILELTIAEVSIEAIVSLTQYYDQPLRCFTFGDFQLVPTIEEFEEILGCPLGGRKPYLSSGCLPSLSRIATVVKDSARGLDRIKQTRNGIAGLPQRYLEDKARVMANQGDWVPFMDVLALLIFGVVLFPNVDGLVDLAAIDAFLAYHHSKESLVVAVLADLFDTFDPKRRIDWDQLLAGIGGGTINWFPRWKEGKEGVLFSCGGYPNIPLIGTRGCINYNPALAIRQLGYPMRGAPTEEGMSPFLVRDFGAQNSKAIQRIHKAWETPLRKDQELRGIRNGIIGGYHEWLKVHVRGLDWLTKLKVVSEESFEAPEEDEEVQALKSELGKAKLAKEKFKLDATHIRKECA

SEQ ID NO: 134796 - protein, 147 aa, Glycine max
  Coding DNA Sequence Number=SeqID_43111
MTGRLLAGSLAFESRILHYLIVRILLPRSLNLAQVSEEDLIVMWAFHKGTSVIASFGYIKEHDGSWVKKGARNFGEEGNEEEDSSLLSKIMERFDGLQTFIGERFDTLELQVDMRFNEMESRMTKVEEDVSYICSSFDLPPPLPPSS

SEQ ID NO: 134797 - protein, 196 aa, Glycine max
  Coding DNA Sequence Number=SeqID_43112
  Homolog annotation: Hit_ID=A5BSR3; Match level="QueryCoverage=67%, HitCoverage=39%, E-value=7e-10, Identity=35%"; Hit description =Putative uncharacterized protein
DQDGVKDTVCDKYGIRKEKWAQFCQTHRDPSWEKLLAEKTKKKLQEAAQSGSVDGVIDPPSPVRRHVKWKMARTKKIGEMTNKATKEIAEKINAMYHCVFSVHDSFEEQATQGSFVPHGRQDVLAAAIGHPEHPGRVHAAGAGVTIKQYFGSAPWTSHSASSLPPDELQQLTQQIRDQLEESITEKVTRQVMASFS

SEQ ID NO: 134798 - protein, 246 aa, Glycine max
  Coding DNA Sequence Number=SeqID_43113
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVIFRHSCPSCSATDGVVRNGKKHRRTSALASVAAAQLLGRAIGAGLFAITPAGERGMCCKAIKLGNARVFPVILSPLQQSSFSQSEAASKSDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134799 - protein, 188 aa, Glycine max
  Coding DNA Sequence Number=SeqID_43114
  Gene Ontology: Mol. function=chloramphenicol O-acetyltransferase activity; Biological process=response to antibiotic
  Homolog annotation: Hit_ID=P62577; Match level="QueryCoverage=79%, HitCoverage=68%, E-value=3e-85, Identity=98%"; Hit description =Chloramphenicol acetyltransferase
  Pfam annotation: Domain name=CAT; Domain location=6-170; Score=258.2; E_value=1.8e-74; Accession=PF00302.9; Description=Chloramphenicol acetyltransferase
MEKKITGYTTVDISQWHRKEHFEAFQSVAQCTYNQTDQLDITAFLKTVKKNKHKFYPAFIHILARLMNAHPEFRMAMKDGELVIWDSVHPCYTVFHEQTETFSSLWSEYHDDFRQFLHIYSQDVACYDENLAYFPKGFIENMFFVSVNPWFIMPIVMASMSAECLMNYNSTAMSGRAGRNFFKADIGA

SEQ ID NO: 134800 - protein, 68 aa, Glycine max
  Coding DNA Sequence Number=SeqID_43115
MRVSGFKRLKTEKLKNCRNQRVQKGGSELGLRVADFYKEPTSGTVYGEIKIKKDGNNKVRYIEVLRGK

SEQ ID NO: 134801 - protein, 153 aa, Glycine max
  Coding DNA Sequence Number=SeqID_43116
MTRRLLAGSLAFESRILHYLIVRILLPRSSNLAQALRLNAHLPYPHLVTLFLQHFNIPLDFEPYVPIKRSFLICATVIASFGYRKEHDGSWVKKGAQPIDDEGHLPIGEDSSLLQRILDRFDGLQTYVGERFDALELQVDMRFDKMDSAITKG

SEQ ID NO: 134802 - protein, 81 aa, Glycine max
  Coding DNA Sequence Number=SeqID_43117
  Subcellular localization annotation: CTP_CleavageSite=56; ConfidenceScore=5.50e-01
MSNASALLTKLLSFGTNVRGANTFLKRKYNSRIWNILHDRFPLVFLTFSSFGRRTREPHLARPQKGRLRQLATPLGTVFVS

SEQ ID NO: 134803 - protein, 343 aa, Glycine max
  Coding DNA Sequence Number=SeqID_43118
  Gene Ontology: Mol. function=unspecific monooxygenase activity
  Homolog annotation: Hit_ID=Q9AVH2; Match level="QueryCoverage=66%, HitCoverage=99%, E-value=8e-67, Identity=52%"; Hit description =Putative senescence-associated protein
VGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLLVGKRTAGARVASSPDSDLEAFSHNPTHVGKTNLSHDGLNPAHVPYWWVNNATLGEFYFTMIGRADIEGSKSNVAMNAWLPQASYPCGNLSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 134804 - protein, 101 aa, Glycine max
  Coding DNA Sequence Number=SeqID_43119
MGTNQTGKRFYQVKVKSPDTTSIKELGRLMEPLQMQAFRKTYGKILELTIAEETISFLRVSPLFEQNCNCGQGFSQRFGPHKTDSERHSGPTTEVPRRQGE

SEQ ID NO: 134805 - protein, 143 aa, Glycine max
  Coding DNA Sequence Number=SeqID_43120
MPGQVKVGVEEVKDPDAPVPVPTDEAAVSPAKPPQKSYPKIDDPLYLMTLTILELFLRPYQIKHEDLSEIAHGGQCLNILVLQLWIMHLTKTSMRAGNYDLYGFLEPQSIQRSRQSQFKAESYIKSWMQSSKRDVYLGAYLNG

SEQ ID NO: 134806 - protein, 46 aa, Glycine max
  Coding DNA Sequence Number=SeqID_43121
MPSINCEGWPTPTGTLCSSLPHMPTPFVQGQIVADHAASFCIVPGP

SEQ ID NO: 134807 - protein, 122 aa, Glycine max
  Coding DNA Sequence Number=SeqID_43122
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSRVGAQRTFEKPPCK

SEQ ID NO: 134808 - protein, 42 aa, Glycine max
  Coding DNA Sequence Number=SeqID_43123
TKCQEEPTVNEGWAAFLPRQLHVAFSRSFIKKVPPEASSWLL

SEQ ID NO: 134809 - protein, 216 aa, Glycine max
  Coding DNA Sequence Number=SeqID_43124
AALSESTDTVNYPPSLIRRHMKWKMVHTKKTGQMTSEAAKEIINKIDSQGSFIAHGHQDVLIAAIRRPEHPGRVRAVGAGVTIKQYFGPAPRTSHTSSSMAPKDLEELTQQIRDQLEESITKKGLALPPEPEVGLSTICVSTKKSCVDPSGNDPDTSDLDKCGLYIEENPPRLVALGRVYVGSTNIHNIPLLHDQVKVGVEEVRDAYAPIPVSTKE

SEQ ID NO: 134810 - protein, 92 aa, Glycine max
  Coding DNA Sequence Number=SeqID_43125
GRIILGNGQRSRQGQRQKPIKVLWDGRNERLGSRPIGRHPLLSPGQMESVTTKQPRVVRDGLRPRVRSEAMGHATLPPLSCYSCLNMRPPSA

SEQ ID NO: 134811 - protein, 54 aa, Glycine max
  Coding DNA Sequence Number=SeqID_43126
MHAKKVSQPTLRQESDARLTGASSKEGKRKESLPTFIRGKRRKKWKKTWSTNFK

SEQ ID NO: 134812 - protein, 40 aa, Glycine max
  Coding DNA Sequence Number=SeqID_43127
MEDAPVSLASLARKRGPYTQVHGNLRSRGESMVMLGLRLA

SEQ ID NO: 134813 - protein, 214 aa, Glycine max
  Coding DNA Sequence Number=SeqID_43128
  Subcellular localization annotation: CTP_CleavageSite=24; ConfidenceScore=5.14e-01
MPKSTLEKLPFNASYLKPSSMVVRAFDGARRELPVGTPMDPFSGSRSLYTPSEIEVRSGRAFGHRIGRGRHLGELPMPILYAIYGGRRGVVRNRLPIFRGGKHFLRGLLLWATLPVRYGSNGGPGNVGEWLQARNGFRQGQRSDDESLEGTNTWDPPIDFEQEKNQTEDEENEDVGLPPELERIVVHEGQEIRSHQEETELVDLGTGSGKREVK

SEQ ID NO: 134814 - protein, 71 aa, Glycine max
  Coding DNA Sequence Number=SeqID_43129
MNKASEIFDIDAVLCSGDVGARLIRLYELEEQQPVIPPLSRARGDRCSVKPASRGAPSSRNQEPCAFAQNT

SEQ ID NO: 134815 - protein, 62 aa, Glycine max
  Coding DNA Sequence Number=SeqID_43130
MHGSKLKGGGHMNENAIHGAPKKMWRTHERKRNSWGSEKGVRMENYTKQSLRMAPNSKVEDT

SEQ ID NO: 134816 - protein, 160 aa, Glycine max
  Coding DNA Sequence Number=SeqID_43131
GLHILACRGLHALAFRGLRVLIFIPGPPPDIGGRPTVRAHPEREAITHLLCIPGQDFTRAAAKRRVRIMRTNMTTLTDRAHKTPSGPGEVQQGPGVSSSGCGPLSVLQGACSPSEESHPQRHSVDPEKSSRAPGFPALVTGLCSPTGCPFPPARSRHHDI

SEQ ID NO: 134817 - protein, 104 aa, Glycine max
  Coding DNA Sequence Number=SeqID_43132
  Gene Ontology: Mol. function=sequence-specific DNA binding; Cellular component=intracellular; Biological process=regulation of transcription, DNA-dependent
  Homolog annotation: Hit_ID=A6T8X3; Match level="QueryCoverage=50%, HitCoverage=82%, E-value=7e-17, Identity=75%"; Hit description =Putative uncharacterized protein
MDMSPRTFLRRFQQATGKSPARWLLDERLLRARQQLTDSRLSIDRIAEICGFANATKADPDKMSRFLTEYTQQGWEVKTMAVERRRSALFWSREAYLFVLERAI

SEQ ID NO: 134818 - protein, 141 aa, Glycine max
  Coding DNA Sequence Number=SeqID_43133
  Subcellular localization annotation: CTP_CleavageSite=47; ConfidenceScore=5.75e-01
MGSTPASNPPPPPSPLSPPPSDASSSPSAMKQTHKVSRLRSLSTRPPGAERPVVHVDPAIGKADGPHRKKLRTYLGIVARDKAEFDIPEASHSRTKRKLLQTVGERWRQFKSNLTRKWALTADQDGVEDIVCEKYGISKEK

SEQ ID NO: 134819 - protein, 90 aa, Glycine max
  Coding DNA Sequence Number=SeqID_43134
ASLTGALSKGGKMRGVATNEGISTSHVDKSGALAPTYPPSKRKSDLLEERRTNEERMKNGEERRRTMKNFHRIAYGSVTEALRLDFSSRK

SEQ ID NO: 134820 - protein, 74 aa, Glycine max
  Coding DNA Sequence Number=SeqID_43135
VVELSLVSTWSELTRALESQFGPSPFDCPMAELFKLQQTDDNEDPSSTIVPQGTQEDEIVEFEDHHLSFNALKG

SEQ ID NO: 134821 - protein, 154 aa, Glycine max
  Coding DNA Sequence Number=SeqID_43136
MQSQIQSQGLALPPEPLVGPSGPRVSTKGSYVDPLGNDPETVKVGVEEVKDANTPVLVPTDEVSLVGQAIDTFLAWPTHLVKSLSQQTTVSPAKPPQKSDPEVDDSLYLMTLIIPELFLRPYQLTWDATVFGVFNLDFLLYIKHEDLSEIAHSG

SEQ ID NO: 134822 - protein, 155 aa, Glycine max
  Coding DNA Sequence Number=SeqID_43137
MDGSSLTSSLQQGIWEDLGSGNDRSEAIPLAGFYPSMPRIAKVVKILEQELDQVKQHRNGVVGIPRKRLEEKVEALANQGEWASFIHILARLAFGTILFPNVDGLVDIAAIDTFLAYHHSKESPIIAVLADAYDTFDLRCEKSSARIVYCTPALY

SEQ ID NO: 134823 - protein, 62 aa, Glycine max
  Coding DNA Sequence Number=SeqID_43138
VDPWVLVPITFRGLHVLANRGLHALTSRGLHVLALRGLHALTLGTSYPHRQRTTRPRLERTT

SEQ ID NO: 134824 - protein, 34 aa, Glycine max
  Coding DNA Sequence Number=SeqID_43139
MALYSDVFCLSNAEKGRRSVGRDPILYLHSSLST

SEQ ID NO: 134825 - protein, 251 aa, Glycine max
  Coding DNA Sequence Number=SeqID_43140
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=36%, HitCoverage=84%, E-value=6e-44, Identity=95%"; Hit description =Chromosome undetermined scaffold_79, whole genome shotgun sequence
  Pfam annotation: Domain name=Complex1_49kDa; Domain location=61-251; Score=-4.9; E_value=2.4e-12; Accession=PF00346.10; Description =Respiratory-chain NADH dehydrogenase,
  Subcellular localization annotation: CTP_CleavageSite=39; ConfidenceScore=5.16e-01
MDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQVVFERRHMIRGFLFYPEGHALSENDYAGYLTKIANFAGKMTTGSSVYSTSIHHFELYTEGFSVPAPSTYTAVEAPKGEFGVFLVSNGSNRPYRHKIRAPGSAHSQGLDSLSKHHMPADVVTIIGTQDIVSGEVDR

SEQ ID NO: 134826 - protein, 186 aa, Glycine max
  Coding DNA Sequence Number=SeqID_43141
  Homolog annotation: Hit_ID=Q6WAY6; Match level="QueryCoverage=97%, HitCoverage=29%, E-value=2e-23, Identity=37%"; Hit description =Putative uncharacterized protein
RGEWAPFIDILALLIFGGVLFPNVNGLVDLAAIDAFLAYHDHKESPVVAMLADLYDTFDRRCEKSSTRIVCCTPTLYVWLVSHLFCQEVRHACPLESHRLCTEKRGANWDQLLANKEGASVNWFPRWKEGRTGVLISCRGFPNVPLMGTRGCISYNPVLAIRQLGYPMRGAPLEEELALVIFTRFQ

SEQ ID NO: 134827 - protein, 233 aa, Glycine max
  Coding DNA Sequence Number=SeqID_43142
DYTSSISEHYTSSPSEGYTLSSLEGFTPTPSKDYTSSTSEDYTFSTSNDYMSSTSEDYTSSPSEGYTLSLAFIPGPPSGPGGGPPMQVQPEEEAIVQLLCIPGQDFTRAAAKKQVRIMRTNMTTITQIWMTLLLSNILPSDRNADLPLQKDRAHKTPSGPGEVQQGPRVSNFGYGPLSVLQGALPPGKAMPSRHRDRAHKTPSGPREVQQGSGVSSSDYEPLSVLRSACHPQQ

SEQ ID NO: 134828 - protein, 147 aa, Glycine max
  Coding DNA Sequence Number=SeqID_43143
EVLISKVYEHPVLADSARMGQHVFEYDADSAAAQDYMALYFELQDTNNIAKAIIAIINIAHQKPSGSFSQGICSKFIPKIPAINVAGIKSMATTAVEYFTQRPYCAPQLYGDMFEAVIFKLLGIFIDGFKDLKSFAHWLKLPEAIPG

SEQ ID NO: 134829 - protein, 19 aa, Glycine max
  Coding DNA Sequence Number=SeqID_43144
LQPFFDVLRSFVIVLRSLT

SEQ ID NO: 134830 - protein, 184 aa, Glycine max
  Coding DNA Sequence Number=SeqID_43145
RIPHNGLTNEITLTHLGTKFVLHPQTPSQVAKDQLTMKDKRGEEEKLENQKKKKDSKALSSKAKGKEKEEKDSSKKIVKKENHFATKCDIKRALLLKQSFYLLLSRETSLSTAIPLELEVIPQVKELLDEGLPMDPKRIKVIPEWPTPPTPLIELVRNYILSWEDGQERGVEERIHELQEPLDL

SEQ ID NO: 134831 - protein, 173 aa, Glycine max
  Coding DNA Sequence Number=SeqID_43146
MKVEIYHTELDEFKAELDRRNFYKRLTNLVDSSLDLALVKEFYANLYSSEDPSPKQVRVRGHLVRIDADSLNTFLETPVILAEGCPQIIKRLGLPCIPSQGFVFNSEGHLGKILRKDLTTLAQVWSVLSYSNRAPTSHTSDLTVDIARLIFGLVSQMDMNVGALISGQITSIA

SEQ ID NO: 134832 - protein, 120 aa, Glycine max
  Coding DNA Sequence Number=SeqID_43147
  Homolog annotation: Hit_ID=A7HJU5; Match level="QueryCoverage=34%, HitCoverage=17%, E-value=6e-15, Identity=100%"; Hit description=3 -oxoacyl-(Acyl-carrier-protein) reductase
MAEKAALKRLGEPIEVAYVYLFLASDESSFVTGQVIGVDGGARYQLLFPLVRVNFELGVIMVIAVSFGKPVVPAALMNRPTRGERRFAYWALAECILAYYVGTDEGVSEVLHVAGEKRLH

SEQ ID NO: 134833 - protein, 442 aa, Glycine max
  Coding DNA Sequence Number=SeqID_43148
  Pfam annotation: Domain name=Transposase_23; Domain location=137-207; Score=-9.0; E_value=0.011; Accession=PF03017.5; Description=TNP1ENSPM transposase
MARTKKIGEMTTEAAKEIAEKIDSFEEQASQGSFIPHRRQDVLIAVIGCPKHPGRVCAARAELQQLTQQSRDQLEESIIEKVTRQLMASFSQMQSQFQSQMQSQGLALPLKPQVGPSGPRVSTKESCVDPSRNDPKTGDSDRCGLYIEANPAHLVALRRVYEGSTVVHNTPLLPSQVNVGVEEVKDPNAPVLVPTDEVSLVGQAIHTFLAWPTHLVKPLSQQAIVSPAKPPQTLDPEVDDPLYLMTLTILELFLRPYQVTWDAAVFEVFNPDFLIYTKYEDLSEIAYSGQCLIISVLQLWILHLTKTSMRAGNSDLYGFLEPQSIQSGHWQMVVILPKEHLVVWFCSLHNRSDNYLKRIINSALKGLNDAPRPKSKAAARQNGSTEYGYYVMHWMSTIILGSFRNNWEVYFNDPRPLEPERLKALRIQWTQYSLELELRARI

SEQ ID NO: 134834 - protein, 155 aa, Glycine max
  Coding DNA Sequence Number=SeqID_43149
  Homolog annotation: Hit_ID=UPI000065F7CF; Match level="QueryCoverage =83%, HitCoverage=23%, E-value=9e-17, Identity=38%"; Hit description =Homolog of Homo sapiens "Leucine-rich repeats and IQ motif containing 1
MRGTVHKPRANLGEDQKGLYALTFRGLHVLALRTTRLHLQRATRPHLQRTIGPHLKRTTCPRLQRTARPHLPRTTRPHLQRTARPRLQRATRPHLQRTTHPHLHKATRPYLQRAAHPRLQRATCPHLQRTTHPHLHRATCPHLWRNTRPRLQRAA

SEQ ID NO: 134835 - protein, 214 aa, Glycine max
  Coding DNA Sequence Number=SeqID_43150
  Gene Ontology: Cellular component=chloroplast
  Homolog annotation: Hit_ID=A7QL08; Match level="QueryCoverage=17%, HitCoverage=50%, E-value=5e-10, Identity=91%"; Hit description =Chromosome undetermined scaffold_116, whole genome shotgun sequence
MVGAGLKKDLRVSRVVPGGSLNAFLFLLIGVISQRLAMESIDSLPIGWTVGAMIYFTGEVSAQLVELRSCNWVVAITGWMSNCPGGNDSILYLNRSSMDRTWTVVGVGGSPRVSSFGILGKRIKLALANSLMHYLPFNPLSEMWQKEKESMDRPQSSPPRRKLRDHPKDAFGIQGSRTDHRTLFKKRNALAIRSQLSVPGSPVAGSSGTTRILS

SEQ ID NO: 134836 - protein, 69 aa, Glycine max
  Coding DNA Sequence Number=SeqID_43151
  Gene Ontology: Biological process=transposition, DNA-mediated
  Homolog annotation: Hit_ID=Q1J7G7; Match level="QueryCoverage=42%, HitCoverage=41%, E-value=8e-10, Identity=100%"; Hit description =Transposase
VKVGNLLRADQRLIFAKKLDQGFPWLLFLSAVPPVQLLTGWCVTAKAPPDISAGKCSGHAARNHHTRRA

SEQ ID NO: 134837 - protein, 151 aa, Glycine max
  Coding DNA Sequence Number=SeqID_43152
  Homolog annotation: Hit_ID=UPI00006A2D9E; Match level="QueryCoverage =78%, HitCoverage=90%, E-value=8e-10, Identity=15%"; Hit description =UPI00006A2D9E related cluster
GLHVLAFRGLHVLTIRGLHVLTIRGLHVLTFRGLHVLTIRGLHALAFIGLHALTFRGLHTLIFRGLYVLPMRELHVLAFGGLHALAFRGLYVLAIRGLHVLAFRGLHILTFRGLHTLLQRTITSSPLVGYASSPSEGYIALAFRGLPYPRT

SEQ ID NO: 134838 - protein, 167 aa, Glycine max
  Coding DNA Sequence Number=SeqID_43153
  Homolog annotation: Hit_ID=Q6WAY6; Match level="QueryCoverage=92%, HitCoverage=27%, E-value=3e-10, Identity=27%"; Hit description =Putative uncharacterized protein
MGSSQAPSLKRRFYQVKVKSLGVTSLKKLGQLMGQLQRQAFRKAYGKIWDLAMAEVSTEAIASLAQYYEQSLRCFTFGDFQLSPMVEEFEEILGCPPGGRKPYLFSGFYPSLARISKRVQISAQELDHRKQVKNGVVGVPRKCLEAKARILASKGKWVPFIDIVGIL

SEQ ID NO: 134839 - protein, 123 aa, Glycine max
  Coding DNA Sequence Number=SeqID_43154
  Subcellular localization annotation: CTP_CleavageSite=38; ConfidenceScore=5.52e-01
MGSPPASTTPPPPPPSLLHLLSSSSSSYFGRIGFNACREADTQSLTPMIIAEFDIPEASDSRTKRKLLQTAGERWRQFKSDLTRKWALTADQDGVEDTVFDKYGISKEKWAQFCQTRRAPSWE

SEQ ID NO: 134840 - protein, 53 aa, Glycine max
  Coding DNA Sequence Number=SeqID_43155
VEERSLEFQEPLDLRSNPFQGGGNDAILPPQGHWIEDSKKIGPKMQEKTVGFS

SEQ ID NO: 134841 - protein, 211 aa, Glycine max
  Coding DNA Sequence Number=SeqID_43156
  Homolog annotation: Hit_ID=UPI00006A2939; Match level="QueryCoverage =54%, HitCoverage=60%, E-value=6e-07, Identity=32%"; Hit description =UPI00006A2939 related cluster
MDPRVLVPWSSEDYTPRQQRAARPHLKKTVCPHLQRTACPYLQRATRPRHQRTACPHLQRATTPSPSEDCMSSPSEGYTPSPIRGLHVLTFVGLHALTFRGLHVLANRGLHALTLRGLHVLANVGLHALTFRGLHVLANRGLHALTFRGLHILAFRGLHVLTLRGLHVLALRGLHVLALRGLHVLTIRGLDALTSRGLHVLALRGLPALAL

SEQ ID NO: 134842 - protein, 123 aa, Glycine max
  Coding DNA Sequence Number=SeqID_43157
MVGYTPSSFTDLVFASKKIEVDPKRGKFDHPTRTTEKTGANEEGEKEGETHAVTAIPIRPSFPLTQQCHYSANNKPPPYPPPTITPAKVHQPPFLREYDSNATCACHGEAPGRSIEHCRGSEA

SEQ ID NO: 134843 - protein, 106 aa, Glycine max
  Coding DNA Sequence Number=SeqID_43158
MKTISGHCVLVKDISVSKAAKILTKFVSADDGTSHLKQLHKELGSSHSHKKHKRHTTENDNDSGKVVGNSVESVDINKELSLGHVKFDQFKRQQSDSGNADGENFS

SEQ ID NO: 134844 - protein, 135 aa, Glycine max
  Coding DNA Sequence Number=SeqID_43159
HGKESPVVAILAMNDTFDRGCEKSGARIVCCAPTLGYPMRGAPLDESITPFIARGFSDHNARDKELRGSSNGSIGGYHKWLRVRTQGLDWLPNLKIVRDDEVKASEESDEVQALKADLERAWVVEEKFKSIAIKV

SEQ ID NO: 134845 - protein, 173 aa, Glycine max
  Coding DNA Sequence Number=SeqID_43160
  Homolog annotation: Hit_ID=A5ATL8; Match level="QueryCoverage=49%, HitCoverage=68%, E-value=2e-20, Identity=65%"; Hit description =Putative uncharacterized protein
  Subcellular localization annotation: CTP_CleavageSite=76; ConfidenceScore=5.53e-01
SANSVPAAAVRQRMQALSGMIGRKASVGGFLSSPSNPRAQPWTGGGNYQAGVRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 134846 - protein, 93 aa, Glycine max
  Coding DNA Sequence Number=SeqID_43161
MDDYLLQLRGKSHIFILFTLCLIRFLLEINGQVLGISTFEGLIVGSGVGPTVEFKSHKGLHYACRVNVRARSSTRQFPSRKLGGHGRTKSDPL

SEQ ID NO: 134847 - protein, 121 aa, Glycine max
  Coding DNA Sequence Number=SeqID_43162
MALARDFCKETTHGAFWFRIGSKIPLAIYTLGMIAKYLDVLEIPRCAHVQFLVPQNALSMHVCKFSQGDVCDVSNKYTLEVHVNNLGNGPKEACLKRSRKDKAAEGTSSAPEYDSHRFRSA

SEQ ID NO: 134848 - protein, 101 aa, Glycine max
  Coding DNA Sequence Number=SeqID_43163
  Gene Ontology: Mol. function=structural constituent of ribosome; Cellular component=ribonucleoprotein complex; Biological process =translation
  Homolog annotation: Hit_ID=P56791; Match level="QueryCoverage=78%, HitCoverage=33%, E-value=2e-22, Identity=66%"; Hit description =Chloroplast 50S ribosomal protein L2
  Pfam annotation: Domain name=Ribosomal_L2_C; Domain location=34-98; Score=0.5; E_value=1.7e-06; Accession=PF03947.9; Description =Ribosomal Proteins L2, C-terminal domain
MSDSADLDSYIPTRAVLHFWEEVLIDQKEESTSTDMPLGTAIHNIEITLGKGGQLARAAGAVAKLIAKEGKSATLKLPSGEVRLISKKLLGNSRTSGKCWE

SEQ ID NO: 134849 - protein, 127 aa, Glycine max
  Coding DNA Sequence Number=SeqID_43164
MIRGDTLRLSAPLCHPEAAGPMIRGDTLRLSAPFCHPEAAGPMTSRDKIWSFCTLVSSRGSGPDDTRRYLTVIRTLVSSRGGGPDDTRRYLTVIRTLLSSRGGGPDDKQRQNLVILHPCAIQRRRAR

SEQ ID NO: 134850 - protein, 78 aa, Glycine max
  Coding DNA Sequence Number=SeqID_43165
  Homolog annotation: Hit_ID=A5B4I5; Match level="QueryCoverage=98%, HitCoverage=5%, E-value=1e-09, Identity=40%"; Hit description =Putative uncharacterized protein
MKGIKRGNLYILQGTTCIDDGLVAVASKFNKSIPDLTQLWHMRLGHMSEKAIHTTKGTLDYIHADCWGPARVPSLGGG

SEQ ID NO: 134851 - protein, 179 aa, Glycine max
  Coding DNA Sequence Number=SeqID_43166
GYTSLTLRGLHVLTIRGLHALTSRGLHVLALRGLHALTLGTSYPHRQRTTRPRLERTTRLHALTLGTSYPHHQRTTASPSKGHLTSEDYMSSPVKGSCTRLHLERTTRPHPQRVACPHLQRTTCPRLERATRPHLWVLGYPHRQRGYTPSPLIGLTRPSPAEGLHALTFQRTTPPRLER

SEQ ID NO: 134852 - protein, 206 aa, Glycine max
  Coding DNA Sequence Number=SeqID_43167
  Subcellular localization annotation: CTP_CleavageSite=28; ConfidenceScore=5.09e-01
MSPPPLGPHDHSQTHIKLSGWLPLVALVSMNLHTTNSLKLSRTWTFLSLELSDYAEASRKGYIPCGTSRGYIYLGLTENKRGYISCGLVLVEGTSTRFKENKGGVYTGESVIATTSPDDESERSAIPPTGEAGGSAFSSTGESGGAAASSDDASEMIIRGGDGGTTSSSGEGGRFTTRVHGSAGIGSTRAGVGSEGAASLVLTNGS

SEQ ID NO: 134853 - protein, 264 aa, Glycine max
  Coding DNA Sequence Number=SeqID_43168
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMLHISHLHQKLEMIKLSEEGGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134854 - protein, 95 aa, Glycine max
  Coding DNA Sequence Number=SeqID_43169
MTVATCSFAGERGEAHGCPFQRRKDARSRHQRLFVENFGKTDGNRSKMKILSSGVVFTLEEGRQSGAFAPTYPPSKRKSDLRSSSLCMNQVILFT

SEQ ID NO: 134855 - protein, 97 aa, Glycine max
  Coding DNA Sequence Number=SeqID_43170
MERYLQHLVRQQAANHRGQVQIHECLYQLSLSQQGQGFVPFVCPTPDQFRAEVAWPGDWLEAQAGEAPAEAPGDAEETCMDEEMTDLLGFLGGSGAT

SEQ ID NO: 134856 - protein, 222 aa, Glycine max
  Coding DNA Sequence Number=SeqID_43171
MIMRGQDIYSSQDEVTTSPSSSESEEEKGKESSEEIYSQEEGQPLMVMDECKELSVSSKRLAKKESQFEIKTNIKETYPLRQPPHFLLCKKTLVSTATPLRLEFIPQVKELLHEGLVHKSLNPCALLVPKIGIIRHQIPKIGGMMNVLSGATLFCKITRAPNIFMICVHRDSLGNDQWVPMNPKRIKVIPEWPTPPSVRKIWGFHLQKVLQKKTQSFKNLEI

SEQ ID NO: 134857 - protein, 225 aa, Glycine max
  Coding DNA Sequence Number=SeqID_43172
MSVASSFLSLGGTYLHGTAWLFWYENEIGLTTEGYRGVWGAASLINLLGVVTSFKGLNNAWPTRLDDINYSPSMISERVRFHVGLVLLKRQPSDVYQMLDLVFKGQTTFGGVARGFPMVCAGCVRVIPLWERRLVDLPGRYHNHLVGDEGRQEVFVRHWDWGEFWSWPRGKVPYRLEPAPKWALPAGRVGVGAGTWGASLWMGVGALACMGAELGESPARAEKLG

SEQ ID NO: 134858 - protein, 247 aa, Glycine max
  Coding DNA Sequence Number=SeqID_43173
  Homolog annotation: Hit_ID=UPI00006A2D9E; Match level="QueryCoverage =78%, HitCoverage=85%, E-value=3e-14, Identity=16%"; Hit description =UPI00006A2D9E related cluster
MTGPFDESISCFLIRVDPWRIARPQHRRAPRPHLQRTTRPHHQRATRPHLQRATRPRLQKATHPCLQRTTCTLTFVGLHALTFRGLHALTFRGLHVLAIRGLHVLAFRGLHVLTFRGLHAFAIRALHTLTFRGLHVLAYGELHVLSIRGLHVLSIRGLHVLAFRGLHVLTFRGLHAFAFIELHALTFRGLDVLAFRGLHVLAIRGLHDLAFRGLQVLAIRGLDVLAFKGLHVLAIRGLHTLTLRGLH

SEQ ID NO: 134859 - protein, 275 aa, Glycine max
  Coding DNA Sequence Number=SeqID_43174
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSNTPAFVTLLFSFVNSNAPDFGTWNDNKIVLAVLCASILENLRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134860 - protein, 170 aa, Glycine max
  Coding DNA Sequence Number=SeqID_43175
  Homolog annotation: Hit_ID=A5C169; Match level="QueryCoverage=71%, HitCoverage=10%, E-value=2e-07, Identity=29%"; Hit description =Putative uncharacterized protein
MTGRLLAGSLTFDCRIMHYIIVRILLPRSSNLAQASEEDLILIWAFLTGRQIEWAHLVRYRMHKALRANAPLPYPQLVTLFLLHFQIPLDDEPFVQVKRSFAIGAGVVTSFGYRKDRDGQWLKKDTLPQQDERTPSHSPQRDDSSALMNEVLSELRGLRTYVGERFDSLD

SEQ ID NO: 134861 - protein, 92 aa, Glycine max
  Coding DNA Sequence Number=SeqID_43176
MQIATRPTWAFQDVLQKAVPSGRSNLARLGELGGKLLLPFPINRGRREEQKCSTLLVSENHLKLVRKIVSVKKIQAMGASVTLPMTFPWVIS

SEQ ID NO: 134862 - protein, 146 aa, Glycine max
  Coding DNA Sequence Number=SeqID_43177
MAKFDPDVVLEFYSIAWPTEEGVRDMRSWVRGQWIPFDADALSQFLGDPLVLEEDQECEFSQRRNQADGFDEEAIAQQLCILGQDFARTAAGRRVRIMRTSMITLTQMWITLLLSIVLPRDHNSDLPLPKCQLVYAILTRMSVHVT

SEQ ID NO: 134863 - protein, 119 aa, Glycine max
  Coding DNA Sequence Number=SeqID_43178
  Homolog annotation: Hit_ID=A0ST23; Match level="QueryCoverage=21%, HitCoverage=51%, E-value=3e-07, Identity=100%"; Hit description =Putative reverse transcriptase
LDFAIILREGTSTSNGRTASIPYQAYRYRRPRGGARYQLLFPLVRVNFELGVIMVIAVSFGKPVVPAALMNRPTRGERRFAYWALAECILAYYVGTDEVSVKCFMWQEKKAAPVRQQNM

SEQ ID NO: 134864 - protein, 127 aa, Glycine max
  Coding DNA Sequence Number=SeqID_43179
MEGLVDLAAIDVFLAFHHDKESPVVAILAMYDTFDRGCEKSSARIVCALALYVWLVSHLFLQEGCPNVPWMRTWGCINYNPVLAIRQLGYPMRGAPLDESITPFITRGFSDPNAKVLQGVRKAWDAA

SEQ ID NO: 134865 - protein, 156 aa, Glycine max
  Coding DNA Sequence Number=SeqID_43180
MDDSSTIEEIEVHFEFEEVLEAFNEMHEETQRLSILNKKMRSDLKLHITKLASTQSELDKLRQENEKLGSSYKATSCVCPSTSFNMDDYQSLQIEFEKFKNDHYEECMKFQTELFYLKDLFRKMNKGNSDLGKLLSVQKHTTDKTGLGCNKHTTFS

SEQ ID NO: 134866 - protein, 117 aa, Glycine max
  Coding DNA Sequence Number=SeqID_43181
MERVTNNIGDEVTTNQATEEWTRFRDTLAMNIEIESNNVKNKSSGKRKMSSEDTRSYFAWNLKIECVLVNVLRDQRNLGNKGDGNWKIVAYSTAAQILSKRFGVHLMADNVKNRFKL

SEQ ID NO: 134867 - protein, 21 aa, Glycine max
  Coding DNA Sequence Number=SeqID_43182
MGGANSTPGPTWALRNILQKA

SEQ ID NO: 134868 - protein, 83 aa, Glycine max
  Coding DNA Sequence Number=SeqID_43183
MTGRLLAGSLTFESRILHYLIVHILLPRSSNLAQTFVGDKFDAMELQVDMWFDAMESRITKVEEDVSFIRTCFDPPPPPPSSS

SEQ ID NO: 134869 - protein, 50 aa, Glycine max
  Coding DNA Sequence Number=SeqID_43184
MGEIDIPIQIGPHTCNVVFQTLDSCPGSSPINASPEIEVCSGWTFSDSVG

SEQ ID NO: 134870 - protein, 90 aa, Glycine max
  Coding DNA Sequence Number=SeqID_43185
MECPGVFPWYVQVALGSYHFGERGLEDLPGSYYGQLVGDERWQEVLIRHWEWGGILELAPGESSSLRWDCRPGESWLELELGVPPSERVP

SEQ ID NO: 134871 - protein, 114 aa, Glycine max
  Coding DNA Sequence Number=SeqID_43186
MAEKTKKKLEETAQFRSTEGVINPPSPIRRHDSLEEQASQGSFIPHGRQDVLTAAIGRPQHLGRVHAARAGVTIKQYFRSAARSSCSSSSIPHEELEQLTQQIRDQLEESIREK

SEQ ID NO: 134872 - protein, 206 aa, Glycine max
  Coding DNA Sequence Number=SeqID_43187
MEWNAVQRKDKELRGSSNGIIGRYHKWLKAWMQELDWLLKLKVSSEEEVETLEESEEVQALKAKLGKVQAAKERFKTTAIKVRKECDKLRDINVATAEALERESKRDRKEEWGRNKFQGALWGSNNELKLRRAGKDQSRVENMILEDKLKAYQRFAFTLNGSQELPRLLAKAKAMVDVYSTPKEVHGLLDYCQHMIDLMAHIIKNH

SEQ ID NO: 134873 - protein, 310 aa, Glycine max
  Coding DNA Sequence Number=SeqID_43188
MLAIIAKYQEELGLATAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADISWKKNAATAAAVSSAAEADPTLLATTHHPPSNIVGRGRDTLGRDGSPHLGYNRAAYPYGLPPNYSPPILQEDAGHIASTVHEKEPPQQPDEVHKDPQDYARRDVEFYPPIPEGPAPGTLPQPNIAASPIVLSMEGPPPATEERRKLDLLEERLRAVEGFGDYPFADMTDLCLVPDVVIPPKFK

SEQ ID NO: 134874 - protein, 43 aa, Glycine max
  Coding DNA Sequence Number=SeqID_43189
MTEARQKGIQKKNRGGACHPARPGEPGCFLRLLEEETGRPKWA

SEQ ID NO: 134875 - protein, 233 aa, Glycine max
  Coding DNA Sequence Number=SeqID_43190
  Homolog annotation: Hit_ID=Q84VH5; Match level="QueryCoverage=87%, HitCoverage=41%, E-value=3e-28, Identity=62%"; Hit description =Envelope-like protein
MAQKKSTPVTPATSRRSKVAIPSKKRKEISSSESDDDVELDVSTSKRAKKSGRKVPGNVPDAPLDNISFHSGNHSPTLLIFTKPLQKLCFSMATSPKVDSSPVSPSVPSSPSSTKTPSNQEQPEFNIQPIQMIPGPGPVPEKLVPKRQQRVKISENPSFATSPREEDTEMDKKIRSLVNSILKNASVPDADKDVPTSSTPNAEVRSSSSEEESTEERISHRGDPCTKGTRTAL

SEQ ID NO: 134876 - protein, 259 aa, Glycine max
  Coding DNA Sequence Number=SeqID_43191
  Homolog annotation: Hit_ID=UPI0000F2ADE5; Match level="QueryCoverage =29%, HitCoverage=10%, E-value=4e-08, Identity=41%"; Hit description =PREDICTED: similar to PDZ-LIM protein cypher3s isoform 1
GLHVLALEDYTSPPSERYTPSPSLGYMSSPSKGCTTSPLEDNTSSPSEGYTPSPSEDYKSLPSEDYTSSPPKGYMPSPLEGYMPSPLEDYASSPSKDYMSSPSVGYRPSPSKDYTTTRLTLQRATRPRLHRNTCPPFQRVTHLHLQKATHPRLQRATRPHLQSSTRPRLQRTTHLNLQRTTRPPHQRTTHPHFQWTTCPSLQMTTRCRLERTTRPPPLRSAWPYLGRTTRPTLQRATHPRLQTTTRPPLQRATHPHLHK

SEQ ID NO: 134877 - protein, 259 aa, Glycine max
  Coding DNA Sequence Number=SeqID_43192
  Homolog annotation: Hit_ID=A5BKB8; Match level="QueryCoverage=18%, HitCoverage=14%, E-value=3e-18, Identity=93%"; Hit description =Putative uncharacterized protein
IIAIVGLQRGIPSKRESSARVDYVPALCTHRPSLLPIEWSGEVFGLRRREPAEGSLSMPHNQIDPRTCLFIYRREGGDDTAPRAPGLLVLATNTNPGASCAKELKSVKCDLPGARRRCSRGSRHDTTFTYNDSSATDISALASMKNVAKCDTWCELQNPVNHRVFERKLRPKPLGRGHACLGVTHRFPQRKHVTMLLRGVYADLPAEHPPRGWLKSGFMADFAVIKWWMSHARDQSRASRSVLDPSTTLCVHARSQRDL

SEQ ID NO: 134878 - protein, 126 aa, Glycine max
  Coding DNA Sequence Number=SeqID_43193
MASIKFGAVSGEQCPKCKTRGNPSDLQPFDPDIDRTFHRLVRNHFIPFYHSEHSITGESVHSVIGDFEHPDLEHYNFEHSDSEHSDFAHSENMGQPPPRERTLREMAAPDFTYESLCLKSPERIPI

SEQ ID NO: 134879 - protein, 49 aa, Glycine max
  Coding DNA Sequence Number=SeqID_43194
MVWRLQSPFLLLHSAAIDLQEAKDSIDEEDPRPTSSIWSYIMWYQSIIV

SEQ ID NO: 134880 - protein, 81 aa, Glycine max
  Coding DNA Sequence Number=SeqID_43195
MVQPKPSAGLKGKPHQHALTHHAFLYFNKQKLGPPRPKSCFGIYPNSRKLHFTEHLVGALLGTNNKGMGAMWLAPSSQYTT

SEQ ID NO: 134881 - protein, 148 aa, Glycine max
  Coding DNA Sequence Number=SeqID_43196
MVSRGGDKSDECLFHLRELHDMETCPAVEELLQRLMDWGQLEVSERGREEPQICSHLAERKAPPTPKALVICFTRNMTSPRSEYPPAVPKPTPFSYQSNKAVPWKYTPPTFGEGAATEVDSLSAKVTNITGCLLPLTRQNYPPRGKHP

SEQ ID NO: 134882 - protein, 120 aa, Glycine max
  Coding DNA Sequence Number=SeqID_43197
MEEDQWMYDSIMSEEVDINDENEDDAGVNEEEHVDCSKAFNTSQWARSVAHEIGFVAVIMRSDKNTGMRGRTSFVLIGCERSDQYRYRKKDFVRRDNDIRKYGCPFKLHGKPVVGGQGWM

SEQ ID NO: 134883 - protein, 66 aa, Glycine max
  Coding DNA Sequence Number=SeqID_43198
MNENAIHGAPKRLRMENCTKQSTSRSSKLEGGGHMNDNAIHGAPKRLRMENCTKQSLRIAPKVEDT

SEQ ID NO: 134884 - protein, 278 aa, Glycine max
  Coding DNA Sequence Number=SeqID_43199
  Homolog annotation: Hit_ID=A4LDZ4; Match level="QueryCoverage=47%, HitCoverage=43%, E-value=5e-18, Identity=42%"; Hit description =Putative uncharacterized protein
GWCAGGGYDAHDATVIVLSRSAVELDTLLPTSGGGSVRAAVEAMEHYQWEVGCEDADYEDDPQQRTRHDGKERQGRGSAHVCTGPAEYQAGEARASPGHHAAAPGCVPRQGGPLRARSRHRLARAAGLNAGPIPQPLKGIPMAKSMKQMLLLAMVQTAAGTAATPTAAANAILCRALMPEPITADQVARDLIRPYKGNSGKLTAGEHRKLSCEVEIAGSGTPGVAPAYGDLLQACGFAETVTAGTDVQYTLVSGGEPLLTLYGYLDGTLFKLVDAKGT

SEQ ID NO: 134885 - protein, 114 aa, Glycine max
  Coding DNA Sequence Number=SeqID_43200
VNSRGGGGVPIAHCQPSSGYCGVSPCACLGAQYFLMKARLVGGLMTLLGATGTPHPVGLTEARNQSWKPQGPVGLLWVHWFSHMHTYLCRNGTDQLILLQGEIGIAVAGQNVAK

SEQ ID NO: 134886 - protein, 56 aa, Glycine max
  Coding DNA Sequence Number=SeqID_43201
MGSLLAMGCSFRFDVSVCGCCEGGVKGDEGWFCWSKEALVIVVDTRVVETMVVVEE

SEQ ID NO: 134887 - protein, 93 aa, Glycine max
  Coding DNA Sequence Number=SeqID_43202
MLCLGAPLWYAHVAFELYHLGYGDWKTFPGMATTKWFSNNEGHNSEYAMGIGENSSLGGRHALFLLWQTLLLELGGELPARIEKFGWLCWYEF

SEQ ID NO: 134888 - protein, 281 aa, Glycine max
  Coding DNA Sequence Number=SeqID_43203
  Gene Ontology: Cellular component=mitochondrion
  Homolog annotation: Hit_ID=Q652R5; Match level="QueryCoverage=58%, HitCoverage=85%, E-value=4e-18, Identity=37%"; Hit description =Putative uncharacterized protein P0603C10.50
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGPGTDGALTLSGAPFQGTWARSATEDASPDYNSDAEGDRFSWWAFPGSLAVTKGILRACTQRVVDGSRTDRLARDWSRAWLIHHFITAKSAMNPDFNQPRGGCSRE

SEQ ID NO: 134889 - protein, 154 aa, Glycine max
  Coding DNA Sequence Number=SeqID_43204
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIMRGQDIYSSQDEATTSPSSSKSEEAKGEESREEIYRQEEGQPLMVKEECIIRHQIPKIGGVMNALGGATLFCKITRAPNIFMICVHRDSLGVPMNPKRIKVIPEWPAPPSVLRKKAQSFKNLGI

SEQ ID NO: 134890 - protein, 74 aa, Glycine max
  Coding DNA Sequence Number=SeqID_43205
  Homolog annotation: Hit_ID=A5BY52; Match level="QueryCoverage=94%, HitCoverage=6%, E-value=2e-09, Identity=47%"; Hit description =Putative uncharacterized protein
MPLYAKFLKDMLTKKNWYIHSDRIVVEGKALIDLGASINLMPLSMCRRLGEIEIMPTHMTLQLAYRSMLVDEYD

SEQ ID NO: 134891 - protein, 264 aa, Glycine max
  Coding DNA Sequence Number=SeqID_43206
  Gene Ontology: Mol. function=P-P-bond-hydrolysis-driven protein transmembrane transporter activity; Cellular component=type II protein secretion system complex; Biological process=intracellular protein transport across a membrane
  Homolog annotation: Hit_ID=A4W782; Match level="QueryCoverage=100%, HitCoverage=81%, E-value=1e-128, Identity=88%"; Hit description =Protein translocase subunit secF
  Pfam annotation: Domain name=SecD_SecF; Domain location=95-264; Score= 251.5; E_value=1.8e-72; Accession=PF02355.7; Description=Protein export membrane protein
  Pfam annotation: Domain name=Sec_GG; Domain location=21-49; Score =25.5; E_value=0.0002; Accession=PF07549.5; Description=SecDSecF GG Motif
  Pfam module annotation: Pfam domain module=SecD_SecF::Sec_GG; Domain location=95-264::21-49
MRWDYWAFGISGFLLILSIIIMGVKGFNWGLDFTGGTVIEISLEKPVDMDQMRESLQKAGFEEPLLQNFGSSRDIMVRMPPVHDANGSQELGSKVVSVINETTSQNAAVKRIEFVGPSVGADLAQTGAMALLVALISILVYVGFRFEWRLAAGVVIALAHDVVITMGILSLFHIEIDLTIVASLMSVIGYSLNDSIVVSDRIRENFRKIRRGTPYEIFNVSLTQTLHRTLITSGTTLMVILMLFLFGGPVLEGFSLTMLIGVTI

SEQ ID NO: 134892 - protein, 71 aa, Glycine max
  Coding DNA Sequence Number=SeqID_43207
MQSSKRNVYLGAYLNGPNNYLKGIINSSLKGLDDTPQPKPKASARWIVVKTIGSRQIEGASHPVGTILSQS

SEQ ID NO: 134893 - protein, 117 aa, Glycine max
  Coding DNA Sequence Number=SeqID_43208
MAKFDPDIVLEFYANAWPTEEGVRDMRSWEGQECEFSQRRNQADGFDEEAIAQLLCISGQDFAWTAAGRQVQIMRTNMTTLTQMWMTLLLSNVLPSDHNSDLPLSKCQLVCHLPGTL

SEQ ID NO: 134894 - protein, 60 aa, Glycine max
  Coding DNA Sequence Number=SeqID_43209
MPYSRPVQGRGCMVRRLARAQAGEAPPEAPGDGEEAHEDEEMADLLDFLGGSGDTAYVFV

SEQ ID NO: 134895 - protein, 123 aa, Glycine max
  Coding DNA Sequence Number=SeqID_43210
  Subcellular localization annotation: CTP_CleavageSite=80; ConfidenceScore=5.35e-01
MPISPCKSIGWSVSSRHGDRTHKTPSGPGKVQQGPGVSSSGYGPLSVLQGALGSHLQDTQWTRRSPTGSWSCQALITGLCQFYRVPITSSKGIRPPTDRAFIKKYCAPRQAQGETPQQHWDGR

SEQ ID NO: 134896 - protein, 131 aa, Glycine max
  Coding DNA Sequence Number=SeqID_43211
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=O98568; Match level="QueryCoverage=80%, HitCoverage=22%, E-value=4e-51, Identity=97%"; Hit description=ATP synthase subunit beta
  Pfam annotation: Domain name=ATP-synt_ab_C; Domain location=12-113; Score=156.7; E_value=6.4e-44; Accession=PF00306.18; Description=ATP synthase alphabeta chain, C terminal domain
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVADKLEYYQIMRLLPQGGDIGDVENTSS

SEQ ID NO: 134897 - protein, 92 aa, Glycine max
  Coding DNA Sequence Number=SeqID_43212
  Subcellular localization annotation: CTP_CleavageSite=45; ConfidenceScore=5.01e-01
MTAQTNRYICRRRLALWSLGRMLLNSNVIHVRVVMLVRMVRTRLFAATRGESCPGMHSRCMIASLSGCARTVGRPPISGGDLGTDKRKLLAP

SEQ ID NO: 134898 - protein, 45 aa, Glycine max
  Coding DNA Sequence Number=SeqID_43213
  Pfam annotation: Domain name=zf-CCHC; Domain location=20-37; Score =9.4; E_value=0.058; Accession=PF00098.14; Description=Zinc knuckle
MAIKDQCDSLQIQKKVSKGNNCQFCRKFGHFQKDYLKSKSWFKKK

SEQ ID NO: 134899 - protein, 111 aa, Glycine max
  Coding DNA Sequence Number=SeqID_43214
MSAITLRSSNQIQVPPPVAVPAPEPVKLHSTLEKEDEIVPQKRKLPDHEGANKNFHVGGPSSSSSDLQQPPIPLSFPPREIPNKNMEEVEKEILETFRKVEVNIPLLDAIK

SEQ ID NO: 134900 - protein, 244 aa, Glycine max
  Coding DNA Sequence Number=SeqID_43215
  Homolog annotation: Hit_ID=Q2HW90; Match level="QueryCoverage=88%, HitCoverage=57%, E-value=6e-18, Identity=27%"; Hit description =Putative uncharacterized protein
MGQLQQQAFRKAYGKIWDLARVEVSMEPIASLSQYYDQPLRCFTFEDFHLVPTVKEFEEILGCPLGGRKPYLFSRFYPSTTRVAKEVFGGKGKRPWQIKATGLSFIDILALLIFGVVLFPNMEGLVDLAAIDAFLAFHHGKESPVVAILAMYDTGMPSICYKVTARASKKERQIETNSWLAQLLASMEGRLGCINYNPVLAIRQLGYPMRGVPSDESITPFIARGFSDHNARVLQGVRKAWDAA

SEQ ID NO: 134901 - protein, 145 aa, Glycine max
  Coding DNA Sequence Number=SeqID_43216
MPTDIREIEAALCIPGRGFILNAEGHPGKILKKDLTTLAQVWSVLSYSNLAPTSHTLDLTMDRARGARRPRARPVEAPSTLATPHPASTSAAPPPAHMTPAPSTLPPADFQGFEAMLRSIHQGHIILLQSVGSSGLEIIKKGGLN

SEQ ID NO: 134902 - protein, 269 aa, Glycine max
  Coding DNA Sequence Number=SeqID_43217
  Homolog annotation: Hit_ID=Q2HW90; Match level="QueryCoverage=56%, HitCoverage=38%, E-value=2e-10, Identity=27%"; Hit description =Putative uncharacterized protein
MGSSQKPSLKKRFYQVKIKSLEVTSLGELGQLMGQLQRQAFRKAYGKIWDLARVEVSMEPIASLSQYYDQPLRCFTFEDFQLVPTVKELEEILGCQLGGRKPYLFFGFYPSTTRVAKVVKISAQELERLKQNRNGVVGVPRKFVLFPNMEGLVDLAAIDAFLAFHHGKESPVVAILAMYDTFGRGCPSIRYKVTARALKRERVIDSLHQEETMWTDRFALTLNRSQELPRLLAKAKAMADTYSAPEEIHGLLSYCQHMIDLMDNMIRNR

SEQ ID NO: 134903 - protein, 132 aa, Glycine max
  Coding DNA Sequence Number=SeqID_43218
MECLEGVWETLQGNERCRFRGPIRLTATSLVHPEEPARTLQQPVEWILPTPTPYRLVEPVQVIEVSSSKEDLEENLEELPPEPAVDALDLPMDDEDPLIDVDSPEDIMSASEADSTEESGPGGTANSDDSSS

SEQ ID NO: 134904 - protein, 54 aa, Glycine max
  Coding DNA Sequence Number=SeqID_43219
MVTTTKALRTACLVDAILPRKGPVTRSMSKRLQEDWARATEEGPRVLMNLMVDF

SEQ ID NO: 134905 - protein, 70 aa, Glycine max
  Coding DNA Sequence Number=SeqID_43220
MTPTHDALLYYNKRWNMSRQNEFVGYSFTGKNPKNFDIPSGCTMDELKNLIKQVAPVGIPLYVIHETQMI

SEQ ID NO: 134906 - protein, 65 aa, Glycine max
  Coding DNA Sequence Number=SeqID_43221
MVHDIFVKAKLEVTGTSIVLNMFGSRRSSDRKMQGSRMSEHKKKDKLILFRKFITSQDLSDNTSS

SEQ ID NO: 134907 - protein, 64 aa, Glycine max
  Coding DNA Sequence Number=SeqID_43222
  Gene Ontology: Cellular component=reaction center (sensu Proteobacteria); Biological process=photosynthesis
  Homolog annotation: Hit_ID=P62100; Match level="QueryCoverage=50%, HitCoverage=88%, E-value=4e-09, Identity=93%"; Hit description =Photosystem II reaction center protein I
  Pfam annotation: Domain name=PsbI; Domain location=31-64; Score=57.9; E_value=3.4e-14; Accession=PF02532.5; Description=Photosystem II reaction centre I protein (PSII 4.8 kDa protein)
HSYDHDYAKLEITLIKGTKAGTGPPLEVDGIDKLDVYTVVIFFVSLVIFGFLSNDPGRNPGREE

SEQ ID NO: 134908 - protein, 147 aa, Glycine max
  Coding DNA Sequence Number=SeqID_43223
  Homolog annotation: Hit_ID=A0PAV3; Match level="QueryCoverage=44%, HitCoverage=31%, E-value=3e-07, Identity=52%"; Hit description =Restriction endonuclease
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARLINWVTPIYYSQNHDVVKRRPVNCNTTHYRANFGAPYIMPRSADSRT

SEQ ID NO: 134909 - protein, 146 aa, Glycine max
  Coding DNA Sequence Number=SeqID_43224
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=74%, E-value=3e-24, Identity=68%"; Hit description=LacZ protein
  Subcellular localization annotation: CTP_CleavageSite=40; ConfidenceScore=5.29e-01
MKHFTDTLISANILYNSTFSTGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134910 - protein, 117 aa, Glycine max
  Coding DNA Sequence Number=SeqID_43225
MSSNGSSQSDGCMMGEVGNLAKILDESPMKTSMSKKRTYFPHISMHIPFRCHKNERCDSSTWERNMPQEYAKRGKTTHTHPIAKLTPMPKYTKNTKKVPTTKTTPNALKYKAKTLYY

SEQ ID NO: 134911 - protein, 158 aa, Glycine max
  Coding DNA Sequence Number=SeqID_43226
MTKSISLKPLGRHDTVRRHLVEEIPIVVPRYAVKPLATVTLESTDQRVTRNVNFFHKPRALENLALPLLFVTVKSLFSFSSRLKTAGNRSLDNHIVLAQTHRTPYTTGKPTFSSLEPTEPPTLFLEVWLKENPTYTVATRVLKQSWVLKAQSFLCEYC

SEQ ID NO: 134912 - protein, 118 aa, Glycine max
  Coding DNA Sequence Number=SeqID_43227
MRFCTIRGTIAIRPTWAFQILPPEVCCFWRKQPWSPGGSWVASSSPYFAINRGRSEEKKVQPSLALLILLKLLRKIISREENSSRGASRNVSVSNYAKILDRSSTFIVRSLFSSVFNG

SEQ ID NO: 134913 - protein, 185 aa, Glycine max
  Coding DNA Sequence Number=SeqID_43228
MLIPRIPSLLLLREKKFMTRRPSTFTRHCSESGPCLSPSVADHPLGPATDHRLGSYALLTRPPLETPLPVRLACVRHAASVHPEPGIELSMRFLVALLIASLFVDKLIRNSLLFQGITCIQGASYSTGVRSQKYSPPTPRVIPRASYPFSIIIRSRHTNRKTYIGFRDNQARTDNFHHVKVTLYR

SEQ ID NO: 134914 - protein, 146 aa, Glycine max
  Coding DNA Sequence Number=SeqID_43229
  Homolog annotation: Hit_ID=Q6UUU1; Match level="QueryCoverage=41%, HitCoverage=40%, E-value=1e-18, Identity=78%"; Hit description =Putative uncharacterized protein
MSPLYLTYGSSCSVPKPVPLWACAPAWTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPRRYLTGK

SEQ ID NO: 134915 - protein, 62 aa, Glycine max
  Coding DNA Sequence Number=SeqID_43230
GPGLPGINRDTRIYLFCEVISVTAVPPVQLLTGWCVTAKAPPDISAGKCSGHAARNHHTRRA

SEQ ID NO: 134916 - protein, 114 aa, Glycine max
  Coding DNA Sequence Number=SeqID_43231
MELARLIGSWCDQIDISQERRIQHRKREDYWRLNEGVIRYVQEAVGSKQNVCKKDSGESSSHVSNSALNTEGRERTTQKGQNGRGRSKSRGKGQTKFRSDIICWNCDKRGHFTN

SEQ ID NO: 134917 - protein, 128 aa, Glycine max
  Coding DNA Sequence Number=SeqID_43232
MDRKEEHGRDKFRGALWGNNKTNMLAIITKYQEELSLATAHEHRVADEYAQVYAEKEARGRVIDLLHQEATMWMDRFSLTLNGSQELPRLLTKAKAMADTYSAPEEIHGLLDYCQHMIDLMAHIIRNR

SEQ ID NO: 134918 - protein, 171 aa, Glycine max
  Coding DNA Sequence Number=SeqID_43233
  Homolog annotation: Hit_ID=Q6WAY4; Match level="QueryCoverage=88%, HitCoverage=27%, E-value=2e-15, Identity=36%"; Hit description =Putative uncharacterized protein
MGTNQNGKRFYQVKVKSLDVTSLKELGRLMGPLQRQAFRKVYGKILDLTAAEVFTEAVVSLAQYYDLLLRCFTFGDFQMVPTIEEFEEILGCPLGGRKPYLFSGFLPSLSKIAAVVGDSTKELDRMKQTRNDVVGLPWKYLEGKARDMTSLEKWGPFADILALLILGCPLF

SEQ ID NO: 134919 - protein, 63 aa, Glycine max
  Coding DNA Sequence Number=SeqID_43234
AGAGRHTTVAWGWPAADNRRTAATSRAPQLIYKGWSVAYDPWSTSRRPSPKPKVARYLGYACI

SEQ ID NO: 134920 - protein, 62 aa, Glycine max
  Coding DNA Sequence Number=SeqID_43235
RVQHVQEEKLKNTSRFKRKVEFKNQDSRIKLQESRSRFKIQDSRIKRRLNQDKYEKVFSKTE

SEQ ID NO: 134921 - protein, 271 aa, Glycine max
  Coding DNA Sequence Number=SeqID_43236
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
  Subcellular localization annotation: CTP_CleavageSite=55; ConfidenceScore=5.08e-01
MVKVGTSYVPINVSFSPKVGQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMRSVFNGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 134922 - protein, 52 aa, Glycine max
  Coding DNA Sequence Number=SeqID_43237
MGRKGLGNRRIMRHQKRALIKFSRIGILVNRERLTEETTPENLAFPWIQMQN

SEQ ID NO: 134923 - protein, 298 aa, Glycine max
  Coding DNA Sequence Number=SeqID_43238
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDEAVDTVVVDIVVVDKDTALGTALDTASEREKVVHIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134924 - protein, 165 aa, Glycine max
  Coding DNA Sequence Number=SeqID_43239
MPISPTEVSVGLWRHDKGSRPQDTQWTRRSPTGPWGFQLWLWASVNPTGCSSPQQGIVPARHPVDPKKSNRILGFPALITGLCQFYGVSVAPNMVIEPPINRTFIKKYCAPRQAQGEIPQQPGDGRQWAIDALPPPPEPLSSFTKARALPTTHGQPAGDQVQSQR

SEQ ID NO: 134925 - protein, 150 aa, Glycine max
  Coding DNA Sequence Number=SeqID_43240
FRYHRTQIIICEVISVTVLFAQSASAVPPVQLLTGWCVTAKAPPDISAGKCSGHAARRVPFAIQAAQLLGRAIGAGLFAITPAGERGMCCKAIKLGNARVFPEFDIHLLLPPSSYPWPPIVKQRNPLMKKIQGLQAAHGATSCGIKSIFV

SEQ ID NO: 134926 - protein, 135 aa, Glycine max
  Coding DNA Sequence Number=SeqID_43241
  Gene Ontology: Biological process=transposition, DNA-mediated
  Homolog annotation: Hit_ID=Q1J7G7; Match level="QueryCoverage=30%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSACQRDSKVSMTDLVSAEEY

SEQ ID NO: 134927 - protein, 158 aa, Glycine max
  Coding DNA Sequence Number=SeqID_43242
MSISSSTASTRIRYPIVRPPAIIQFRAAFHNDQTFIEIPPFFHEQWAPNYPDEVRFKYNGATYPIRVQQPRGRYFFADGLADVRADLKIYESIIINFFACDDNTIFYLHFTPPLNQQTCGRPILHSHLHAWTTEITQCILGAPQPLEIPSHARKYLKQ

SEQ ID NO: 134928 - protein, 17 aa, Glycine max
  Coding DNA Sequence Number=SeqID_43243
MADQQATKSKAKGRKIP

SEQ ID NO: 134929 - protein, 83 aa, Glycine max
  Coding DNA Sequence Number=SeqID_43244
MEKSDKKTFKDKKGKKAYIAWEYNDMDSSSDLENEIINLGLMAKDYESKEEVTSSNYDLSISFDELQDAFNDLRESIKLAIIF

SEQ ID NO: 134930 - protein, 108 aa, Glycine max
  Coding DNA Sequence Number=SeqID_43245
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=29%, E-value=6e-11, Identity=100%"; Hit description=LacZ protein
MGQLTAQARGNCMLAVGGDGKVDAKLGPCQAGTPFADDAHPPFASWRNSEEARTDRPSQQLRSLNGEWDAPCSGALSAAGVVVTRSVTATLASADVRRCFCRYAPPRQ

SEQ ID NO: 134931 - protein, 129 aa, Glycine max
  Coding DNA Sequence Number=SeqID_43246
MEAMKEPMATMMEAMMSMKKIMEVNAAAIAATSTIAEVNLTPPYGLNQINHPTPDMVGMEGKELGVDFEPCLEYATEGQEVGGIPLQNTLEGPQYHPQPHPLHSTAGKNPHVMAEMGVVGSSRGKAQGR

SEQ ID NO: 134932 - protein, 283 aa, Glycine max
  Coding DNA Sequence Number=SeqID_43247
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISLDKSYITWAELRPELHHVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134933 - protein, 97 aa, Glycine max
  Coding DNA Sequence Number=SeqID_43248
  Homolog annotation: Hit_ID=Q5QJQ3; Match level="QueryCoverage=32%, HitCoverage=25%, E-value=5e-12, Identity=100%"; Hit description =Putative uncharacterized protein
MAACLGELRLSPEVMSLPRRAGFLTLKSFGGPNQAEASLGELRSFAPSWAVCTNPPFSPTAAPYPVTIVLSPTRISKARYVCGATEFLKWWPNYGLH

SEQ ID NO: 134934 - protein, 98 aa, Glycine max
  Coding DNA Sequence Number=SeqID_43249
MGYVGVRELSWRWATGDGGFMRALWMWKNLLCTIARPPPSTTCDGVKLPAFIVDHRVVPGDMSRGSGDLGGRQASSWQSTDKKKTRPQSKEACGGWAT

SEQ ID NO: 134935 - protein, 278 aa, Glycine max
  Coding DNA Sequence Number=SeqID_43250
  Homolog annotation: Hit_ID=Q84VH5; Match level="QueryCoverage=98%, HitCoverage=48%, E-value=1e-41, Identity=64%"; Hit description =Envelope-like protein
  Subcellular localization annotation: CTP_CleavageSite=20; ConfidenceScore=5.12e-01
RLQSRKGKTPITRSGRIKTIAQKKSTPITPTTSRWSKVAIPSKKRKEISSSDSDDDVELDVPDIKRAKKSGKKVPGNVPDAPLDNISFHSIGNVERWKFAISTQTCCRKRTGKRCLALIASSRSFLTKAAGCKSNSTSYYRFSPAYINKSWQFTNLQEFSVDIARFHQHSPTLLKEFTQATTPKGSDFSMEQPVLNIQSIQMIPGPGPVPEKLVPKRQQGVKISENPSFATSPREEDTEMDKKIRSFVNSILKNASVPDADKDVPTSSTPNAEVLSSS

SEQ ID NO: 134936 - protein, 120 aa, Glycine max
  Coding DNA Sequence Number=SeqID_43251
  Homolog annotation: Hit_ID=Q2HTA0; Match level="QueryCoverage=70%, HitCoverage=13%, E-value=9e-12, Identity=49%"; Hit description=IMP dehydrogenase/GMP reductase, related
  Pfam annotation: Domain name=DUF1723; Domain location=43-92; Score =40.5; E_value=6.1e-09; Accession=PF08330.1; Description=Protein of unknown function (DUF1723)
DHPKLKLSSHGRKVQKFGRPAPEIEGLVVATGLSPLIACSIDIGDRGLIFAFVERCHRETSSFHLPVGEVSITLDDVASLLHLPIVGAFYTFKPLHVDEAMLMLVELLEVTREAARAETA

SEQ ID NO: 134937 - protein, 111 aa, Glycine max
  Coding DNA Sequence Number=SeqID_43252
  Subcellular localization annotation: CTP_CleavageSite=60; ConfidenceScore=5.57e-01
MACPLACIPKEPSWTSSSMRLASLVFTHRSNTMSWFLLYSLPSRSSSTKQQYAGLPRHLNSMYGRSPCGVSWNMDAKVASASTIWFSSRGTRDAWVDSPCPSGRTGSCVRV

SEQ ID NO: 134938 - protein, 59 aa, Glycine max
  Coding DNA Sequence Number=SeqID_43253
MVNFFLTHLLLEVASPFIFLLLHSTAIRPQEAKESIDEEDPRPTSSNGATSCGSIIFQS

SEQ ID NO: 134939 - protein, 206 aa, Glycine max
  Coding DNA Sequence Number=SeqID_43254
  Homolog annotation: Hit_ID=Q2HW90; Match level="QueryCoverage=91%, HitCoverage=38%, E-value=3e-20, Identity=35%"; Hit description =Putative uncharacterized protein
MGTNQNGKRFYQVKVKGLDVTSLKELGRLMGPLQRQAFRKVYRKILDLTAAEVFTEAVVSLAQYYDQPLRCFTFGDFQMVPTIEEFEEILGCPLGGRKPYLFSGFLPFLSKIAAVVGDSAKEMDCMKQTRNGVVGLPRKYLEGKARDMASRPFADILALLIFGVVLFPNVDGLVDLAAIDAFLAYHHSKESPVVAILADLFDTFDR

SEQ ID NO: 134940 - protein, 95 aa, Glycine max
  Coding DNA Sequence Number=SeqID_43255
MTWFRWHMACVNTKEARKQCWGRWLRASLLDHGNGQYGYERSKDGLLLSQRAGIAASNNMVERKRVPMASRTFAIDSNVKLSRCNVGLSTGGFHQ

SEQ ID NO: 134941 - protein, 142 aa, Glycine max
  Coding DNA Sequence Number=SeqID_43256
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=2e-24, Identity=70%"; Hit description=LacZ protein
MKFLLLDDMQPLVGRFGISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 134942 - protein, 248 aa, Glycine max
  Coding DNA Sequence Number=SeqID_43257
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLVMLLPAGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134943 - protein, 71 aa, Glycine max
  Coding DNA Sequence Number=SeqID_43258
MGKSKVDILIAISPNTWHASKFIIFLPKISGYVIYEDNKQRPHFSPRKVNLKKSEYMIYEDNKGHLINKPN

SEQ ID NO: 134944 - protein, 246 aa, Glycine max
  Coding DNA Sequence Number=SeqID_43259
ENFEAPEEDEEVQALKLELGKARLAKEKFKLAATHIRRECTELREENAATIRALEQETKRARKEEHGREKFRGALWGSNNELKLRREERDRSRVPKKTASREGIDVAPRSSTMWMDRFAPIHQWTSRHPCPSSVIAKKKTMGPNLGCINYNPALAIRQLGYPMRGAPTEESLSPFLVRDLCAQSLKVIQRVHKAWRSPLRKDKELRGIRNGVIGGYHGWLRVHTRGLDWLSKLKVIDEENFEAPER

SEQ ID NO: 134945 - protein, 220 aa, Glycine max
  Coding DNA Sequence Number=SeqID_43260
  Gene Ontology: Mol. function=hydroxymethyl-, formyl- and related transferase activity; Cellular component=cytoplasm; Biological process='de novo' IMP biosynthetic process
  Homolog annotation: Hit_ID=Q5YPQ2; Match level="QueryCoverage=67%, HitCoverage=68%, E-value=2e-40, Identity=58%"; Hit description =Putative phosphoribosylglycinamide formyltransferase
  Pfam annotation: Domain name=Formyl_trans_N; Domain location=16-197; Score=110.7; E_value=4.4e-30; Accession=PF00551.10; Description =Formyl transferase
MPSARGAEYPVAVTRLPIVVLISGTGSNLAALLAAERAADCPYEVVAVIADRDAPGLEHARSAGIPTQVVRLSEHPDRAAWDAALAESVTAHRPALVVLAGFMKLVGPPLLEACGGRIINTHPALLPSFPGAHGVRDALAHGVKITGCSVIEVDAGVDTGQILDQAYRYRRPRGGARYQLLFPLVRVNFELGVIMVIAVSCVKLLSAHNSTQHTSRKHKV

SEQ ID NO: 134946 - protein, 250 aa, Glycine max
  Coding DNA Sequence Number=SeqID_43261
MRSWVRGQWIPFDTDALSQFRGDPLVLEEGQQCEFSQRRNRADGFDEEAIVQLLCTPGQDFTRTVARRRVRIMHTSMTTLTQTWMTFLLSNVLPNDHNSDLPLSKCQLVYAILTQMSVHVAQVIADAIYLFAGMPPTRHPLDPDKSNRALGFPTLIMGLCQSFEVPVTPSKVIRQPITRAFIEKYCTPRQAQGDAHQATDAQPPPHQADPAGSLGMEHYLQHLVRQQAANHRGQMQIHECLYRFSLSQLG

SEQ ID NO: 134947 - protein, 186 aa, Glycine max
  Coding DNA Sequence Number=SeqID_43262
MLESFQQQDQMSVLELYIEKDVAGGSMFHSANSLTSCGNNLSNNEAQPPINVSNLHGDEDDDDDDYLVSNSYVEESLDKDDSIDGISDTDDEVTGMIQPVRIVHPVEGVQGIQNPFWNDVLHYNNINWSHPDDEDICGLEMPSSFNVGQELYVGINFDSKDVVKNAVKQYVMKVHQSFKVVESKSN

SEQ ID NO: 134948 - protein, 136 aa, Glycine max
  Coding DNA Sequence Number=SeqID_43263
MKKIMEASAVAVVATSTVAKYARPHDVQIQNEHAFPPHGLPPNYTPPNVAYTPNEDVNKCSLRANNLIIYMSLNPWRETHEIPHHNQADFGPCLGYATEGEAVVGVPLQNPLDGPQLRVIEGGEDYAFANLRRVVP

SEQ ID NO: 134949 - protein, 41 aa, Glycine max
  Coding DNA Sequence Number=SeqID_43264
MMEAMMSVKKIMEANTIALPLPALLLRNGKVGSSRGKAQGH

SEQ ID NO: 134950 - protein, 139 aa, Glycine max
  Coding DNA Sequence Number=SeqID_43265
MIRGDTLRLSAPFGHPEAAGPMTSRDQVWSFCTLVSSRGGGPDDTRRYLTAAGPMIRGDTLRLFAPFCHPEAAGPMTSRDQVWSFCTLVSSRGGGPDDTRRYLTVIRTLLSSRGGGPDDKQRPSLVILHPCIIQRRRAR

SEQ ID NO: 134951 - protein, 86 aa, Glycine max
  Coding DNA Sequence Number=SeqID_43266
MTETVCTDNRLGISIRHLTSRVRMTEIVCTDNRLGISIRHLTSRDDRRCGRQRKSPCVNGFVGPRLTKGAEDDVSLCMLPDSESDG

SEQ ID NO: 134952 - protein, 94 aa, Glycine max
  Coding DNA Sequence Number=SeqID_43267
MEGPSAQTIGGSDLSYREVGSCYVHPALLLGHPANSEVAKLPFSNYSSGKTHRQLPEERHPECFRKKLLPEEFQCLPEEASSGKIPDDVLPEVD

SEQ ID NO: 134953 - protein, 1532 aa, Glycine max
  Coding DNA Sequence Number=SeqID_43268
  Gene Ontology: Mol. function=transcription regulator activity; Cellular component=nucleus; Biological process=transcription
  Homolog annotation: Hit_ID=A5AF28; Match level="QueryCoverage=99%, HitCoverage=93%, E-value=0.0, Identity=52%"; Hit description =Putative uncharacterized protein
  Pfam annotation: Domain name=BAH; Domain location=7-118; Score=10.1; E_value=0.0016; Accession=PF01426.9; Description=BAH domain
  Pfam annotation: Domain name=TFIIS; Domain location=260-343; Score =46.7; E_value=8.2e-11; Accession=PF08711.2; Description =Transcription factor S-II (TFIIS)
  Pfam module annotation: Pfam domain module=BAH::TFIIS; Domain location=7-118::260-343
MDIQDGRKISVGECALFKPSEDRPPFIGIIHCLTFGKEKKLKLGVSWLYRSIEVKLNKGVPLEAAPNEIFYTFHKDETDAESLLHPCKVAFLRKGAELPSGTCVRMHATVQPGGRSPKPMSSPTSTSQLKSVSDSVQNNTSSFPSHIKGRKRERADQGSEPVKRERSIKTEDGDSGHFRHDNILKTEIAKITEKGGLVDNEGVEKLVQLMVPDRNEKKIDLASRSLLAAVIAATEKLDCLSQFVQLRGLPVFDEWLQEVHKGKIGDGVGSRDGDKSVEEFLLVLLRALDKLPVNLQALQTCNIGKSVNHLRTHKNTEIQRKARGLVDTWKKRVEAEMNIKDAKSGSGPTVHWPAKSRSSDVGHGGNRHSGASSDIAMKSSVTQLSASKTASVKIVQGENTIRSASTSTFPGPAKSVLSPASVTANLKDGQPCIAAVSGGSDLPMVNARDEKSSSSSQSHNNSQSCSSDHAKTGGHSGKEDARSSTAMSVNKISGGSSRHRKSINGFPGSTPSGGQRETGSSRNSSLHKNLTSEKISQPGLMDKALDGTSLEGVTCKLIVKIPSQGRSPAQSASAGSFDDPTIMNSRASSPVLPEKHDQFDHCSKEKSDLYRANIGSDINTESWQSNDFKDVLTGSDEADGSPAAVTDEERCRIVNDCKKTFEVPKAASSSSGNENKAGNLQDASYSSINALIEGVKYSEADDVGMNLLASVAAGEILKSELLTPTGSPERNTAAVEQSCTGNDMVKSSEENLVRDECHSNNGLDGEHKNQGSVTDDLGANDESDSDFRASGEKAARELNKSVNACSMDLQQVSEIILESKGKLNEKSVSTALRGLSESSVQEARDGDRSKQLQEVGRGVNGGEIVDVKVSSVAEVEAEATEKLSHIAVKVDVQSDNCTAEGSSGGGRTAAVLVPSDLARGKDENVLHSSAYSVDKVPEDLTERESEKADDVDAENLPSQSKKERNECESDTLTMPENRGLCSIVTGIAAEHVEENLETKEVHDQPAREELPKDSPSVRSQEMDKHLDSKGSKLTAMEAEEAEECTSTTADASSVSAAAVSDADAKVEFDLNEGLNADDEKCGEFNSSAPAGRLVSPVPFPASSMSCGIPAPVTGAAAAKGRFVPPEDLLRSKGEIGWKGSAATSAFRPAELRKVMEMPFGALTSSIPDAPAGKQSRAPLDIDLNVADERILDDISSQPCARHTDSVSLTTDGHDPVSSKMASPVRCSGGLGLDLNQVDEASDVGNCLSSNHKIDVPIMKVKSSLGGPPNREVNVHRDFDLNNGPSVDEVTTESSLFSQHARSSVPSQPPVSGLRVSTAEPVNFSWLPSSGNTYSAVTISSIMPDRGDQPFSIVAPNGPQRLLTPAAGGNPFGPDVYKGPVLSSPFEYPVFPFNSSFPLPSASFSAGSTTYVYPTSGNRLCFPVVNSQLMGPAGAVSSHYPRPYVVGLTEGSNSGSAETSRKWARQGLDLNAGPGGSDMEGRDDNSPLPSRQLSVASSQALAEEQARIQLAGSVCKRKEPDGGWDGYNQSSWQ

SEQ ID NO: 134954 - protein, 170 aa, Glycine max
  Coding DNA Sequence Number=SeqID_43269
  Homolog annotation: Hit_ID=A5BEV8; Match level="QueryCoverage=81%, HitCoverage=24%, E-value=9e-14, Identity=27%"; Hit description =Putative uncharacterized protein
MNEEQWMYDNIMSEEVGMNVENEEDVGVKVEHVDCSDAFNTFELLASRDEVLHWVRSVAHNIGFVVVIMRSDTNTSVRGKTLFLLIVCKRSGEYRHKKIDLSLVGNPYAGRLTKDEKIVVVDMTKSMLKPRNILLTLKEHNANSYTTIKQIYNARHAYHSFIRRSNTEMQ

SEQ ID NO: 134955 - protein, 593 aa, Glycine max
  Coding DNA Sequence Number=SeqID_43270
  Gene Ontology: Mol. function=transporter activity; Cellular component= membrane; Biological process=transport
  Homolog annotation: Hit_ID=Q53J18; Match level="QueryCoverage=99%, HitCoverage=99%, E-value=0.0, Identity=63%"; Hit description =Xanthine/uracil permease family protein
  Pfam annotation: Domain name=Xan_ur_permease; Domain location=36-505; Score=116.9; E_value=6.2e-32; Accession=PF00860.11; Description =Permease family
MAGGGAPAKADEPQPHPPKDQLPNISYCITSPPPWPEAILLGFQHFLVMLGTTVLIPTALVPQMGGGNNEKARVIETLLFVAGINTLLQTMFGTRLPAVIGGSYTFVPTTISIILAGRFSDEPDPIEKFKRIMRSIQGALIVASTLQIVLGFSGLWRNVARFLSPLSSVPLVSLVGFGLYELGFPGVAKCVEIGLPQLILLVFVSQYVPHVLHSGKHIFDRFAVLFTIVIVWIYAHLLTVGGAYNDAPHKTQISCRTDRAGLIDSAPWVAKLSISRLRNTVMSVFHGDCHRCVRDGLIWPPSNPLRQNGLNIKLLAIGCHRVLIKNFFFRIRIPYPFQWGAPSFDAGEAFAMMMASFVALVESSGAFIAVYRYASATPLPPSILSRGIGWQGVGILLSGLFGTVNGSSVSVENAGLLALTRVGSRRVVQISAGFMIFFSILGKFGAVFASIPPPIIAALYCLFFAYVGAGGLSFLQFCNLNSFRTKFILGFSIFVGLSVPQYFNEYTAINGYGPVHTGARWFNDIINVPFQSKPFVAGVVAYFLDNTLFKREAAIRKDRGKHWWDKYKSFKGDTRSEEFYSLPFNLNKYFPSV

SEQ ID NO: 134956 - protein, 54 aa, Glycine max
  Coding DNA Sequence Number=SeqID_43271
MTTKIMSREVVTVDDDDGDGGDNDNHDVGTVVTMTTKKVMTIEVVTVDDNGDDD

SEQ ID NO: 134957 - protein, 518 aa, Glycine max
  Coding DNA Sequence Number=SeqID_43272
  Gene Ontology: Mol. function=ubiquitin-protein ligase activity; Cellular component=ubiquitin ligase complex; Biological process =protein ubiquitination
  Homolog annotation: Hit_ID=A7PD68; Match level="QueryCoverage=97%, HitCoverage=97%, E-value=1e-162, Identity=60%"; Hit description =Chromosome chr17 scaffold_12, whole genome shotgun sequence
  Pfam annotation: Domain name=Arm; Domain location=231-271; Score=6.4; E_value=1.7; Accession=PF00514.14; Description=Armadillobeta-catenin -like repeat
  Pfam annotation: Domain name=Arm; Domain location=272-312; Score =19.4; E_value=0.014; Accession=PF00514.14; Description=Armadillobeta- catenin-like repeat
  Pfam annotation: Domain name=Arm; Domain location=313-353; Score =26.8; E_value=7.7e-05; Accession=PF00514.14; Description =Armadillobeta-catenin-like repeat
  Pfam annotation: Domain name=Arm; Domain location=354-392; Score=1.9; E_value=6.3; Accession=PF00514.14; Description=Armadillobeta-catenin -like repeat
  Pfam annotation: Domain name=Arm; Domain location=393-436; Score =24.0; E_value=0.00054; Accession=PF00514.14; Description =Armadillobeta-catenin-like repeat
  Pfam annotation: Domain name=U-box; Domain location=21-93; Score =23.3; E_value=1.6e-06; Accession=PF04564.6; Description=U-box domain
  Pfam module annotation: Pfam domain module=Arm::Arm::Arm::Arm::Arm::U- box; Domain location=231-271::272-312::313-353::354-392::393-436::21 -93
  Subcellular localization annotation: CTP_CleavageSite=38; ConfidenceScore=5.09e-01
MGGNGKHRWKFSFHRSSTHPPKEFTCPISGSLMSDPVVVASGQTFERLAVQLCKDLNFSPKLDDGTRPDFSTLIPNLAIKTTILHWCDNARTQHPRPPDYASLQRLVLEQKENDRVRVSEMELLNAVADLPPVIFSHAATELGPRVNHFNSGSSSEQESVIIPSSPGTPLPLTIRPTCFSSSSSSSCEIEIENSNTPASEEEEGLLKKLKSNEVFEQEEGVIALRKITRNKEDARVSLCTPRVLLALRGLIASRYGVVQVNAVASLVNLSLEKQNKVKIVRSGFVPFLIDVLKGGLGESQEHAAGALFSLALDDDNKMAIGVLGALHPLMHALRAESERTRHDSALALYHLSLVQSNRMKLVKLGVVPTLLSMVVAGNLASRVLLILCNLAVCTEGRTAMLDANAVEILVSLLRGNELDSEATRENCVAALYALSHRSLRFKGLAKEARVAEVLKEIEETGTERAREKARKVLHMLRTVGDGDGDEIDEFYDSAGLTRNRYRAGAARNSDNLVNTTTF

SEQ ID NO: 134958 - protein, 40 aa, Glycine max
  Coding DNA Sequence Number=SeqID_43273
MTKLASFPTKGCQKHEMAASDLITDCHLLKEQLVQVRAIT

SEQ ID NO: 134959 - protein, 90 aa, Glycine max
  Coding DNA Sequence Number=SeqID_43274
MVHKGDLGCRIKGFLGHRDHNCICLQFPTTHEFYQLASVAFCLLVAWDLNNFDSELEEFARIFYKFDTGFSWTRKYQVEEFHHSSSLFPC

SEQ ID NO: 134960 - protein, 244 aa, Glycine max
  Coding DNA Sequence Number=SeqID_43275
  Gene Ontology: Mol. function=nucleotidyltransferase activity; Cellular component=cytoplasm; Biological process=biosynthetic process
  Homolog annotation: Hit_ID=A7PMK7; Match level="QueryCoverage=97%, HitCoverage=67%, E-value=5e-96, Identity=66%"; Hit description =Chromosome chr14 scaffold_21, whole genome shotgun sequence
  Pfam annotation: Domain name=Hexapep; Domain location=165-182; Score =11.2; E_value=3.9; Accession=PF00132.15; Description=Bacterial transferase hexapeptide (three rep
  Pfam annotation: Domain name=Hexapep; Domain location=183-200; Score =10.1; E_value=8.6; Accession=PF00132.15; Description=Bacterial transferase hexapeptide (three rep
  Pfam annotation: Domain name=Hexapep; Domain location=214-231; Score =3.0; E_value=64; Accession=PF00132.15; Description=Bacterial transferase hexapeptide (three rep
  Pfam module annotation: Pfam domain module=Hexapep::Hexapep::Hexapep; Domain location=165-182::183-200::214-231
MVTDAHKRYGGMGTILVVKVSAESASEFGELVADPTTNELLHYTEKPETFVCSSCAYALNCGTIEGVSTQRKDRANLRRVSSFEAMQPDTRSLPVNYVRLDQDILSPLAGKKQLYIYETNDFWEQIKTPGMSIKCSGLYLAQFRYTSPHLLANGDGIKKASITGDVYIHPSAKVHPSAKIGPSVSISANARIGAGTRLKHCIILDDVEIKAGESVTVEDEVVVLNSIVLPHKTLNLGVQDEILL

SEQ ID NO: 134961 - protein, 412 aa, Glycine max
  Coding DNA Sequence Number=SeqID_43276
  Gene Ontology: Mol. function=transcription factor activity; Cellular component=transcription factor complex; Biological process =regulation of transcription, DNA-dependent
  Homolog annotation: Hit_ID=A7PD78; Match level="QueryCoverage=70%, HitCoverage=90%, E-value=3e-59, Identity=43%"; Hit description =Chromosome chr17 scaffold_12, whole genome shotgun sequence
  Pfam annotation: Domain name=E2F_TDP; Domain location=12-77; Score =115.1; E_value=2.1e-31; Accession=PF02319.11; Description =Transcription factor E2Fdimerisation partner (TDP)
MTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNGLNFRSGPSQPISRMHLKFNGWIGLGLDFICAFQVDLAQNSNVKESRKRMFGTDIGNISFKRNKVDLSMDGQNSKMQNQHENISPRAQLEKIIIKKDAKQTSESYQFGPFAPAYVPKVGTSENNSVKKVHDWDSLAQEHRPQYQNQGLAYGCMDDRVACHQGGMQLLKSYLSEIVDICVLLDKGQAIWVVSMVMVEVDRGGVGFEGNVVIMRPMWVERPFGVAKTEIFVKDKELWGHVDKTDYASDKTMHKKAHAKWEYKANLEDKT

SEQ ID NO: 134962 - protein, 229 aa, Glycine max
  Coding DNA Sequence Number=SeqID_43277
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=74%, HitCoverage=26%, E-value=7e-48, Identity=52%"; Hit description =Chromosome chr18 scaffold_1, whole genome shotgun sequence
  Pfam annotation: Domain name=MORN; Domain location=44-66; Score=10.8; E_value=0.49; Accession=PF02493.11; Description=MORN repeat
  Pfam annotation: Domain name=MORN; Domain location=67-89; Score=32.0; E_value=2.1e-06; Accession=PF02493.11; Description=MORN repeat
  Pfam module annotation: Pfam domain module=MORN::MORN; Domain location=44-66::67-89
MDHGLIIDHVRERNRREANPMTAGDECNLQEGEERYTWRNRNKYVEEWKNGAISDNGVLVRKNGNRYEGCWENGVSKGRGVFTWRDGSTSFGNWGKKFVNEKRVSMDECNNNNNKSVSFPIICIWELNGEAGDITCDIVEASMIYDGGRVCESDVQLQKSPCGSIDGDVKKPGHTVSKGHMNYDLMLNLQLGIRYLIYIATLISFSVMSYLCQLNVTTYSDALPIDRGR

SEQ ID NO: 134963 - protein, 558 aa, Glycine max
  Coding DNA Sequence Number=SeqID_43278
  Gene Ontology: Mol. function=triacylglycerol lipase activity; Biological process=lipid metabolic process
  Homolog annotation: Hit_ID=Q2TQV0; Match level="QueryCoverage=98%, HitCoverage=98%, E-value=1e-145, Identity=47%"; Hit description =Enhanced disease susceptibility 1 protein
  Pfam annotation: Domain name=Lipase_3; Domain location=51-187; Score=- 12.6; E_value=0.0053; Accession=PF01764.16; Description=Lipase (class 3)
MAGGSLGDNIGLKEDAIKRVCGLACKANNHKSTDKLYFYDKVQISSETYHVFSFPGSWDPAEWFVNKPFGVSKINSTQFPSLRSIGNDELAWVNEGFAKRFDRLLETNFEDVAILDGKQVVFTGHSSGAAMATQTTFWVLEKYDIVPRILLAPLASIEENFGSVLQFLNPKSKTSTQDPTRAILISEVYKTVMRNAASVTSHAACILMGSTNLLLETVANFVELSPYRPFGTYVFCNGNGQLIVVENSDAVLQLLFHTALLSDLAELEEVADKSISQHLNYVAELQESLGMQNVVYLEQLEQLPLSADGSNSDVATALDGLGLNTRARLCLRAAGELEKQKRKNEDKIMKEIQDKALTSMKELQNYKTTCEMHKGKGYYDAFKVQKESNDFQANVKRLVLAGVWDEVIEMLKRYELPDEFEGDKEWIKRGTEYRRLVEPLDIANYYRHLKNEDTGPYMIRARPKRYRYTQRWLEHAKRMPPAPITESTFWAEVEELYSWINSKKPLDDHVEQRVKQLQKDLKNWTDDEKVLAKDTFLKDPNFIRWKDILPQELKDTSS

SEQ ID NO: 134964 - protein, 117 aa, Glycine max
  Coding DNA Sequence Number=SeqID_43279
MDRRVKPKSHDMMSVCEKSMHVVANILTLPTLSFAHKTLRTSTTGKAMKNLSRCSEAYKKGPLLLQVHERRSQEPPRQPKSVVKHVVESNNRGSSTTSKVIQIERLEDDVNKKAEVF

SEQ ID NO: 134965 - protein, 543 aa, Glycine max
  Coding DNA Sequence Number=SeqID_43280
  Gene Ontology: Mol. function=aminoacyl-tRNA ligase activity
  Homolog annotation: Hit_ID=Q2PF39; Match level="QueryCoverage=98%, HitCoverage=75%, E-value=1e-167, Identity=58%"; Hit description =Aminoacyl-tRNA synthetase
MALSRDTWITVLCRKLRDWWQWVADGDLPIVASHGMEVEVYKSLDPGVRVVILKALCDIRVEQEDIRGYIDRSIKHGIPLSTFRKERIGGDSHGISYWYEDDQIIGHRLYREIRKTEVVQMKKGKPRGSQEKLFTSKNRTEASVGKKVKIDMLPEIEKVHKRKEKLLKKQHRQALLLDNFLGVDGIAPGRSLRDRKPLTFDVAVIADDYDRSINEAIKITKRKPPSPELIPRREAGAKPEALTNGKWSGPSHDPQDLNFGMPSPKSPDSDDMEEENQTDMLDLDRSNRRRQKPKRYSEKDFVEALSDNEADYDSDDDIVGEAVYDEEYLQKRKQRRKASSSSGSEGDEEYHWDEDNVEDEEEDSLSVSEDSDKPRKFKRLAGRTRRETKVRSVGEIQSGLRRSKRAKTKSRINYRRYEISDSETEFIKSDKSNASDDHSDPTENGEYMMESEDSDGNDEEEQETKAVEPVTYPAEENNQSPAVEENEQNQNLPPEKSSSPGQEEVEGTAKRRFLDLNELAPSSGFDDGPNTTTLKDEGGNDDN

SEQ ID NO: 134966 - protein, 265 aa, Glycine max
  Coding DNA Sequence Number=SeqID_43281
  Gene Ontology: Mol. function=5-formyltetrahydrofolate cyclo-ligase activity; Biological process=folic acid and derivative biosynthetic process
  Homolog annotation: Hit_ID=A7QI12; Match level="QueryCoverage=82%, HitCoverage=82%, E-value=5e-76, Identity=62%"; Hit description =Chromosome chr17 scaffold_101, whole genome shotgun sequence
  Pfam annotation: Domain name=5-FTHF_cyc-lig; Domain location=41-230; Score=90.7; E_value=4.8e-24; Accession=PF01812.11; Description=5 -formyltetrahydrofolate cyclo-ligase family
MRAQTVMTQWCTRAAACGQLRMSTNTNTPKHDDIDAIFKQKRFLRTQVRKTLKSIDPSLKSHQDNTVQDIVLGAPWFRSSRRLCAYISCAALREVDTSKILSQILQHNSTTDGKKLYVPRVEDKNSHMRMLHISRIDDLIANSMDILEPTPVDADGNAREDGLAFDRSGRRLGRGGGYYDTFLKNYQDLAKTRNWKQPLLVALSYSEQILDEGVIPMTSSDLPVDALVSPEGVIPISTTALNSEQFQHGSLTLAVDFTADPEHLQ

SEQ ID NO: 134967 - protein, 37 aa, Glycine max
  Coding DNA Sequence Number=SeqID_43282
MGVAGEVKMEEKRATKGRLDGRGVIKDVKITSTSVRK

SEQ ID NO: 134968 - protein, 186 aa, Glycine max
  Coding DNA Sequence Number=SeqID_43283
  Gene Ontology: Mol. function=threonine endopeptidase activity; Cellular component=proteasome core complex; Biological process =ubiquitin-dependent protein catabolic process
  Homolog annotation: Hit_ID=Q9XI05; Match level="QueryCoverage=45%, HitCoverage=30%, E-value=3e-17, Identity=57%"; Hit description =Proteasome subunit beta type-3-A
MKSVTKTAEGKPPQHGPQWIEAKSHVQTGNYECGYYVMHWIWCIVTGGLKDDWIHWFSDRSAGGGDKDYKEVPPPPLFEPAGGHMNQVVTFNRSYCKPVIAGLGDEDKPFIYTMDCLGAKLYVALMVPFMQDYSSLIVNNLELAKDFVVSGTASESLYGACEAMFKPDMDQVQIIGQLCTYDNLNS

SEQ ID NO: 134969 - protein, 109 aa, Glycine max
  Coding DNA Sequence Number=SeqID_43284
  Homolog annotation: Hit_ID=Q00M75; Match level="QueryCoverage=27%, HitCoverage=4%, E-value=2e-08, Identity=96%"; Hit description=PPR -repeat containing protein
  Pfam annotation: Domain name=DSS1_SEM1; Domain location=54-105; Score= 45.9; E_value=1.4e-10; Accession=PF05160.4; Description=DSS1SEM1 family
MVLSFVVTSNRSNVRKMDWVGGLYCNLTVIVFKERASPGAAVKLCLGDLLVMGLNPETASLHMQGDEWDDKEEGKEVTQQWEDDWDDDDVSDDFSLQLRRELESNTEKN

SEQ ID NO: 134970 - protein, 288 aa, Glycine max
  Coding DNA Sequence Number=SeqID_43285
  Homolog annotation: Hit_ID=A7PD29; Match level="QueryCoverage=34%, HitCoverage=61%, E-value=1e-16, Identity=50%"; Hit description =Chromosome chr17 scaffold_12, whole genome shotgun sequence
MLWHSLPRTQLNRLAQNHRHARAAPDNVDLDRRCENPELRPEERRAPRPDEACRYVAVHASLGSRSRSRAGSPISVEALQRAIEEELFFLVDLEVHAAAKADGVDGDVGGLGGVAVDAAALEGEGPGGGGGDWGSVHDERDDDVVEVFERSCCKRENNERMKEPEEMEIVISLIILFMGIAILMVIHVCVVGRAFTGNNSNNEEEFTHRSISAMKRMFGGNKVGNLKNLPCFEYEEKACKEKGCCGLVDCAVCLENFKIGDVCRTWVHSPVVMREQSAVSENVEISTA

SEQ ID NO: 134971 - protein, 395 aa, Glycine max
  Coding DNA Sequence Number=SeqID_43286
  Gene Ontology: Mol. function=ubiquitin-protein ligase activity; Cellular component=ubiquitin ligase complex; Biological process =protein ubiquitination
  Homolog annotation: Hit_ID=A7PD32; Match level="QueryCoverage=99%, HitCoverage=56%, E-value=1e-118, Identity=57%"; Hit description =Chromosome chr17 scaffold_12, whole genome shotgun sequence
  Pfam annotation: Domain name=Arm; Domain location=120-160; Score =21.3; E_value=0.0037; Accession=PF00514.14; Description =Armadillobeta-catenin-like repeat
  Pfam annotation: Domain name=Arm; Domain location=161-202; Score =14.3; E_value=0.17; Accession=PF00514.14; Description=Armadillobeta -catenin-like repeat
  Pfam annotation: Domain name=Arm; Domain location=203-244; Score=0.6; E_value=9.2; Accession=PF00514.14; Description=Armadillobeta-catenin -like repeat
  Pfam annotation: Domain name=Arm; Domain location=245-286; Score =18.3; E_value=0.028; Accession=PF00514.14; Description=Armadillobeta- catenin-like repeat
  Pfam annotation: Domain name=Arm; Domain location=287-328; Score=6.2; E_value=1.8; Accession=PF00514.14; Description=Armadillobeta-catenin -like repeat
  Pfam annotation: Domain name=U-box; Domain location=1-61; Score=40.1; E_value=8e-09; Accession=PF04564.6; Description=U-box domain
  Pfam module annotation: Pfam domain module=Arm::Arm::Arm::Arm::Arm::U- box; Domain location=120-160::161-202::203-244::245-286::287-328::1-61
MTDPVTISSGQTYNRASIQKWCNSGNLICPKTREKLASTELVPNTALKKLIQKFCSENGVIVVNPIDHNQTVTKTSDAGSPAAAHAMQFLSWFLSRRLVFGTEEQKTKAAYEIRLLAKSSVFNRACLVEMGTVPPLLDLLAADDRNLQESAISALMKLSKHTSGQKLIIESRGLAPILKVLKRGLSLEARHVAAAVIFYLSSSKEYRKLIGENPDVIPALVEMVKEETTFGKNNSVVAIFGLLLRRKNHAIVLSAGAVPVLVNTLASSGNANLVTDSLAVLVALAESVEGAYALLRAEALPLVAKILQSATSRSGKEYCASILLALCVNVGAEVTGVLAKEASVMPSLYSLLTDGTPHAAKKARALINVILEFSDKRFSGTVGSSVSRQRLVNLN

SEQ ID NO: 134972 - protein, 31 aa, Glycine max
  Coding DNA Sequence Number=SeqID_43287
MEFVVVGFWHSMAQPCVKKAQWSWQTSEAIN

SEQ ID NO: 134973 - protein, 126 aa, Glycine max
  Coding DNA Sequence Number=SeqID_43288
MKVRTHMWKSINEFSCISKFSGSSDFFICCPILTIGNVFFDAATEEYWFLADKAYKLWLRIDPRPKPAATPSCTAVLTRLTSSIMKIGILVELNQLCALLQLLLQNKLLVHGMPTFQKQSSSWNQR

SEQ ID NO: 134974 - protein, 46 aa, Glycine max
  Coding DNA Sequence Number=SeqID_43289
MAWCDQRRTNSGMTKEVATIGWLRVERFWRANYVLGWLRLGNKEWE

SEQ ID NO: 134975 - protein, 128 aa, Glycine max
  Coding DNA Sequence Number=SeqID_43290
MVENVSWFDRLVVGVSLSEACALIENHALSETLNPLSELGESEKHQRVISSPRRREQNKGEKQSKEAKNLSFQEDLRFRRLHGVTLGENFDTTSRKVSMNDGRQSRVSHCAREGSVVDDGNFEKGLEH

SEQ ID NO: 134976 - protein, 195 aa, Glycine max
  Coding DNA Sequence Number=SeqID_43291
  Gene Ontology: Mol. function=oxidoreductase activity; Cellular component=mitochondrial matrix; Biological process=metabolic process
  Homolog annotation: Hit_ID=Q1AFF6; Match level="QueryCoverage=86%, HitCoverage=45%, E-value=4e-61, Identity=53%"; Hit description =Aldehyde dehydrogenase
  Pfam annotation: Domain name=Aldedh; Domain location=1-185; Score= -136.8; E_value=2.9e-08; Accession=PF00171.13; Description=Aldehyde dehydrogenase family
NTDEHATLEAWNDGKLFEQADKVELPLVMRLLHYYAVGPALACGNTLVVKIAENAPLTGVPNVVSGFGPTAGSALASHMDVDKSNLKPVTLELGGKSPFIVCEDADVDKAVELAHFALFFNQGQCCCAGSRTYVHERIYDEIFEKAKATALRRVVGDTFKKGLDQGPQGEKGIYSLQNYLQVKAVVTPLKNPSQL

SEQ ID NO: 134977 - protein, 427 aa, Glycine max
  Coding DNA Sequence Number=SeqID_43292
  Gene Ontology: Mol. function=heat shock protein binding; Cellular component=cellular_component; Biological process=response to stress
  Homolog annotation: Hit_ID=A7QI31; Match level="QueryCoverage=100%, HitCoverage=99%, E-value=6e-55, Identity=60%"; Hit description =Chromosome chr17 scaffold_101, whole genome shotgun sequence
  Pfam annotation: Domain name=DnaJ; Domain location=2-65; Score=125.3; E_value=1.8e-34; Accession=PF00226.22; Description=DnaJ domain
  Pfam annotation: Domain name=DnaJ_C; Domain location=301-423; Score =46.9; E_value=7.2e-11; Accession=PF01556.9; Description=DnaJ C terminal region
  Pfam module annotation: Pfam domain module=DnaJ::DnaJ_C; Domain location=2-65::301-423
MDYYNILKVNRNASDDDLKKAYKRLARIWHPDKNPVNKTEAEAKFKRISEAYDVLSDPQKRQIYDLYGEEALKSGQFPPPPQSSSSSSSRAFHHHHHHHRQNNNPPPASASSFRFNPRDADDIYAEFFGPDDIGAGASSRRGGGPDAFFRTSNGGGAAFSASAAAGRKAAAVENALPCSLEDLYKGVKKKMKISRNVYDAFGGQFAVVVVHQSIAVDVRRASCGGRVRRSSVSCVRRLLVSCRRARERRLQLLCVSPAPAPPFVALETAAGRTAEEEKLSKCGDVEEILTIEIKPGWKKGTKITFPEKGNREPGVIPADLIFVIDEKPHALYRRDGNDLVINQEITLLEALTGKTLDLTTLDGRSLMIPLTDIVKPGAEVVVPNEGMPISKEPGMKGNLRVKLDVKYPSRLTPEQKSDLRRVLGGIS

SEQ ID NO: 134978 - protein, 924 aa, Glycine max
  Coding DNA Sequence Number=SeqID_43293
  Gene Ontology: Mol. function=aldehyde dehydrogenase (NAD) activity; Cellular component=mitochondrial matrix; Biological process =metabolic process
  Homolog annotation: Hit_ID=Q84V96; Match level="QueryCoverage=53%, HitCoverage=91%, E-value=0.0, Identity=88%"; Hit description =Aldehyde dehydrogenase 1 precursor
  Pfam annotation: Domain name=Aldedh; Domain location=454-916; Score =868.6; E_value=3.2e-258; Accession=PF00171.13; Description=Aldehyde dehydrogenase family
  Pfam annotation: Domain name=cNMP_binding; Domain location=217-317; Score=28.5; E_value=2.4e-05; Accession=PF00027.20; Description =Cyclic nucleotide-binding domain
  Pfam module annotation: Pfam domain module=Aldedh::cNMP_binding; Domain location=454-916::217-317
MNRTHSPSCNPSFLDCGTLADHERQAWFKRTRVLTACDALNDKNEFQFGMFADAFTDHVSSSRFFQKYFYCLWWGLKNLSSYGQNLQTSTYSGETLFSSFICIAGLILFAHLIGNMQNYLQSSTAKVEEWRLKQKDTEEWMNHRQLPPELQQRVRRFVQYKWLATRGVDEEAILRALPLDLRRQIQRHLCLDIVRRVPFFGQMDDQLLDAICERLVSSLNTKDTYIVREGDPVREMLFIIRGQVESSTTDGGRTGFFNSITLRPGDFCGEELLTWALMPSSTLNLPSSTQTVKTLTEVEAFALRAEDLKFVASQFKRLHSKKLQHAFRAWGAHFIQAAWRRHRKRKLAMELLKENLYYTNVVEDDDDEEEGSAGESSMAGHTQNFGATFLASKFAANTKKGAIKKVAIKLPDADRRNSGKWGNFNRFSTAAAVEDLITPQVPITYTKHLINGQFVDAASGKTFPTYDPRTGEVIAQVAEGDAEDINRAVSAARKAFDEGPWPKLTAYERCKIILRFADLVEKHGDELAALETWNNGKPYEQSATAELPTFVRLFRYYAGWADKIHGLTVPADGNYHVETLHEPIGVAGQIIPWNFPLLMFAWKVGPALACGNTVILKTAEQTPLTALYVAKLFHEAGLPPGVLNVVSGYGPTAGAALASHMDVDKLAFTGSTETGKVVLGLAAQSNLKPVTLELGGKSPFIVCEDADVDQAVELAHFALFFNQGQCCCAGSRTFVHEHIYDEFLEKAKARALKRVVGDPFKKGVEQGPQIDVEQFQKVLRYIKSGIESKATLECGGDQIGSKGFFVQPTVFSNVQDDMLIAKDEIFGPVQTILKFKDIDEVIRRSNATHYGLAAGVFTKNVHTANTLMRALRVGTVWINCFDVFDAAIPFGGYKMSGIGREKGIYSLNNYLQVKAVVSPVKKPA

SEQ ID NO: 134979 - protein, 133 aa, Glycine max
  Coding DNA Sequence Number=SeqID_43294
MDKAEAILALIPNFKSFFLCGDDENGDGSDVNNNDSDRDISGDHSDNDGGGGRGDIGSGGNDDVVVVTVLVVTTNGCGGSNVGGVGDDNGGNDGGGVVVEAVLVVVVVTVIMVIGGIIGSGDGDKGDLVGSGG

SEQ ID NO: 134980 - protein, 77 aa, Glycine max
  Coding DNA Sequence Number=SeqID_43295
KDDDDKAIPVDESEHSDGDAKAVALSKYEFGAYFSTLRHLDPSATSQVTFPERAMAGQSLEHLVEASSPRGYGHIII

SEQ ID NO: 134981 - protein, 61 aa, Glycine max
  Coding DNA Sequence Number=SeqID_43296
MGHLSDQGVPMNPKRIKVIPEWPTPLSVEGRSPEYEEPQDLRSNPFQGGGNDVILPRKGIG

SEQ ID NO: 134982 - protein, 183 aa, Glycine max
  Coding DNA Sequence Number=SeqID_43297
  Homolog annotation: Hit_ID=A0PAV3; Match level="QueryCoverage=35%, HitCoverage=31%, E-value=5e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSIDEERHLLHRTAFDQRQNELALLHADEVVGVFATSSLSIPSTSRGGPVPAFVPFSEG

SEQ ID NO: 134983 - protein, 122 aa, Glycine max
  Coding DNA Sequence Number=SeqID_43298
MEGLVDLAAIDAFLAFHHGKESPVVAILAMYDTFDRGCEKSSARIVCCALALYVWLVSHLFSPRRSQELPRLLANFYSSGGHLLGAGGGDPRTSQLLSAYDRLNGPYDWKPLGSLYCRSDLD

SEQ ID NO: 134984 - protein, 105 aa, Glycine max
  Coding DNA Sequence Number=SeqID_43299
MLAIISKYQEELNLATAHEHRVMDEYAQMYAEKEAKGRLIDLLHQEAMMWMDRFALTLNGSQEHPRLLAKAKAMADTYSAPEEIHKLLSYCQHMIDLMAHMIRNR

SEQ ID NO: 134985 - protein, 224 aa, Glycine max
  Coding DNA Sequence Number=SeqID_43300
  Gene Ontology: Mol. function=RNA-directed DNA polymerase activity; Biological process=RNA-dependent DNA replication
  Homolog annotation: Hit_ID=Q0ZCD3; Match level="QueryCoverage=99%, HitCoverage=21%, E-value=3e-13, Identity=27%"; Hit description =Integrase
  Subcellular localization annotation: CTP_CleavageSite=31; ConfidenceScore=5.15e-01
LSSSRYNPGWRNHPNLRWSNPSQQQQQQQPYFQNVVGPSRPCVPPPIQQQQQQQPQKQQIVEAPPQPSLEELVRQMTMQNMQFQQETRASIPSLTNHMGQLATQLNQQQSQNFDRLPSQFVQNPKNVSAITLRSGKQCESKEKQHIPLSFPPRAISNKKMEEAEKEILETFRKVEELCTNKRKLKGSERISMGRNVSALIGNNKFDNAMLDLGASVSVMPLSIF

SEQ ID NO: 134986 - protein, 92 aa, Glycine max
  Coding DNA Sequence Number=SeqID_43301
  Homolog annotation: Hit_ID=A5AWG3; Match level="QueryCoverage=91%, HitCoverage=16%, E-value=2e-08, Identity=39%"; Hit description =Putative uncharacterized protein
MNIEESIHVTFDESNAILSRKNMLDDIADSLEQMNIHEQDSKGNDKGNNEDPPEEVKSNDELPREWKASRDHPLDNIIGDISKGKNLKIILS

SEQ ID NO: 134987 - protein, 90 aa, Glycine max
  Coding DNA Sequence Number=SeqID_43302
MDVWGANTFPVRKYNSRTFHLKFVDHVFFGFSDVFPQINVGGDSARVPFLEDASRESRVALPPKGRLRHRVNGIIGSGGESMVMLSLRLA

SEQ ID NO: 134988 - protein, 42 aa, Glycine max
  Coding DNA Sequence Number=SeqID_43303
MWRVSETKATVPRKFGSIERIAPDGGEDHWIIQDVPHVLICR

SEQ ID NO: 134989 - protein, 301 aa, Glycine max
  Coding DNA Sequence Number=SeqID_43304
DGPSGTSTLVFRGLHVLANRGLHTLTLRGLCVLTFRGLHVLAFRGLHVLALRGLHVLTIRGLHALTSRGLHVLALRGLLALALGTSYPHLERTKRPRLERTTCPHHQRVARPHLQRTTRPRLERATRPRLGVLVTLIFRGLHVLTFVGLHALTFRGPHVLTFRGLHALAIRGLLVPRLRKATRLHALTFRGLHVLANRGLHALTLRGLHALTSRGLYILALRGFHALTFRGLRVLICRTSSFLLTVPGPPPDIGGGPTVQAQPEREAITQLICITGQDFTRAAAKRRVRIMRTNMTTLTQI

SEQ ID NO: 134990 - protein, 61 aa, Glycine max
  Coding DNA Sequence Number=SeqID_43305
MTLLFPGGNKRMTKLGLCVPSDTTVSEWQRGADNRKNDQTWSLLVIGPAASGVTKGVRITI

SEQ ID NO: 134991 - protein, 48 aa, Glycine max
  Coding DNA Sequence Number=SeqID_43306
MKKQQWKRSGRQRRRGERRCHPLRNKPWKKELHHQDEPWIRSLERMLQ

SEQ ID NO: 134992 - protein, 42 aa, Glycine max
  Coding DNA Sequence Number=SeqID_43307
MARKPRQDFSVSKVRFFPTFVTEYGSQSKREMRGYEWDFENS

SEQ ID NO: 134993 - protein, 58 aa, Glycine max
  Coding DNA Sequence Number=SeqID_43308
GEACRPARPGEQGCFLQKQQPSGGIFWRAQAIMKLSSKLESGGHMNSPKQEHSCGSEK

SEQ ID NO: 134994 - protein, 83 aa, Glycine max
  Coding DNA Sequence Number=SeqID_43309
MRRVITLVVSEPVKPFRPCILGVMARRNDRAIADALQALAQAIGNPNRGEAAGAVEYQGLDHFQRNNPPAFNKDTTLMVLRIG

SEQ ID NO: 134995 - protein, 93 aa, Glycine max
  Coding DNA Sequence Number=SeqID_43310
MKQVTTQMICMYKTKVNQNETNVNKLGIPRSCGSACHQTLGSRISFLNDHLEETLGPTKIGENHSKCINLTRCVARKSLAHRILSAIKGRGPL

SEQ ID NO: 134996 - protein, 274 aa, Glycine max
  Coding DNA Sequence Number=SeqID_43311
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSCEPSHLFWGSVVDDAVLNLPRVACPVLQSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 134997 - protein, 74 aa, Glycine max
  Coding DNA Sequence Number=SeqID_43312
MAKEPRRVTLEDYSSSTVPQFFTSIAQPKVQARTITYPHSLIQLIQNNLFHGLPNEDPYAHLATYIEICNTIRL

SEQ ID NO: 134998 - protein, 70 aa, Glycine max
  Coding DNA Sequence Number=SeqID_43313
  Subcellular localization annotation: CTP_CleavageSite=57; ConfidenceScore=5.15e-01
MQTRQLFCTLVGISSSLSFLITVDGLILGMPAKVHPMTFLCFLSTNNNFSSYSTAREAEMITENFSFSSK

SEQ ID NO: 134999 - protein, 190 aa, Glycine max
  Coding DNA Sequence Number=SeqID_43314
  Gene Ontology: Mol. function=motor activity; Cellular component=cell projection
  Homolog annotation: Hit_ID=UPI00016621D1; Match level="QueryCoverage =96%, HitCoverage=41%, E-value=8e-18, Identity=34%"; Hit description =UPI00016621D1 related cluster
LHAFTFRGLHVLAFRGLHVFAFRWLHALTFRGIHTLTFRGLHVLIGLHALTFRGLHVLPFKGLHALTFKGLQIAVFRGRHVLNFKGRHVLTFRGLCTFTFRGLQVVTFRGLHVLVFRGLLVLTFKGLHILTFRGLHAIVFRGLHVLAFRGLHVLAFRELHVLPFRGTHVLAFRGLHVLAFRGLHTVVFKG

SEQ ID NO: 135000 - protein, 218 aa, Glycine max
  Coding DNA Sequence Number=SeqID_43315
  Gene Ontology: Mol. function=4 iron, 4 sulfur cluster binding; Cellular component=integral to membrane; Biological process =tricarboxylic acid cycle
  Homolog annotation: Hit_ID=P36683; Match level="QueryCoverage=100%, HitCoverage=25%, E-value=1e-108, Identity=90%"; Hit description =Aconitate hydratase 2
MQPGITLRDLVHAIPLYAIKQGLLTVEKKGKKNIFSGRILEIEGLPDLKVEQAFELTDASAERSAAGCTIKLNKEPIVEYLNSNIVLLKWMIAEGYGDRRTLERRIQGMEKWLADPQLLEADADAEYAAVIDIDLADIKEPILCAPNDPDDARLLSDVQGEKIDEVFIGSCMTNIGHFRAAGKLLDSHKGQLPTRLWVAPPTRMDAAQLTEEGYYSVF

SEQ ID NO: 135001 - protein, 212 aa, Glycine max
  Coding DNA Sequence Number=SeqID_43316
  Gene Ontology: Mol. function=binding; Cellular component=outer membrane-bounded periplasmic space; Biological process=cell adhesion
  Homolog annotation: Hit_ID=A8GAT7; Match level="QueryCoverage=100%, HitCoverage=72%, E-value=1e-111, Identity=94%"; Hit description =Periplasmic solute binding protein precursor
  Pfam annotation: Domain name=SBP_bac_9; Domain location=1-210; Score =77.6; E_value=4.1e-20; Accession=PF01297.8; Description=Periplasmic solute binding protein family
GVGLEGWIDRLVSASGYKGQVITASQGISTRQMEEDGKAITDPHAWNSMKNGVQYATNVMNALIAADPEDANYFRQRGVEYIQQLQKLDLWAKTQFAAVPPQKRKVLTSHDAFGYFGQEYGVTFLAPVGFSTEAEASASDVAGLIKQIKQEKVNAYFIENQTDPRLVKQIAAATGAKAGGELYPEALSRAGGPAATYEQAFKHNVDALLSSM

SEQ ID NO: 135002 - protein, 78 aa, Glycine max
  Coding DNA Sequence Number=SeqID_43317
  Homolog annotation: Hit_ID=A0ST23; Match level="QueryCoverage=34%, HitCoverage=55%, E-value=2e-08, Identity=100%"; Hit description =Putative reverse transcriptase
MEDCLERPHLGIKLIDTVDLEGGPVGKPVVPAALMNRPTRGERRFAYWALAECILAYYVGTDEGVSEVLHVAEKKGCT

SEQ ID NO: 135003 - protein, 114 aa, Glycine max
  Coding DNA Sequence Number=SeqID_43318
  Gene Ontology: Biological process=transposition, DNA-mediated
  Homolog annotation: Hit_ID=Q1J7G7; Match level="QueryCoverage=35%, HitCoverage=70%, E-value=9e-12, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPEFDSKLERGGHMNSARHNIHGAPKKGENGGLP

SEQ ID NO: 135004 - protein, 255 aa, Glycine max
  Coding DNA Sequence Number=SeqID_43319
  Subcellular localization annotation: CTP_CleavageSite=36; ConfidenceScore=5.07e-01
AGFADALQHAFGVAVRGVDQQNVNACRHQRVNALFVAGAGADRRAHAQTAVLVFTGVRFAFRFLEVFNGDHAQQVEAVVHHQRFFYALFVHLLQYHVARFTFFHGDQAIFRRHDRGDRLGQIGHEAHVAAGDDADQLVVFGDDRVTGKAVARGQLFHFLQRGGWGNGLRVGDYAAFMLLHAADFFSLALDGHVFVDEAQAAFLRQRDGQAGFGNGIHGCGQHRDVQADGFGQLGAELCGVRQNRGVGWNQEDVVK

SEQ ID NO: 135005 - protein, 170 aa, Glycine max
  Coding DNA Sequence Number=SeqID_43320
MGEVEEVQEQMKADMEAVKEQMATMMEAMMSMKKIMEANAVAVAATRAAAKYGRPHDVQIQNEHAFPPHGLPPNYTPPNVAYTPNENVNNSTLLGYATEGQAVGGIPPNTLEGPQFRPQPQPLHFAVGRAPPTMAEKGKVDHLKERLRAIEGGEDYAFANLEELFLIPKH

SEQ ID NO: 135006 - protein, 113 aa, Glycine max
  Coding DNA Sequence Number=SeqID_43321
  Homolog annotation: Hit_ID=A0PAV3; Match level="QueryCoverage=33%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSITSLVFASCQLDSKIA

SEQ ID NO: 135007 - protein, 65 aa, Glycine max
  Coding DNA Sequence Number=SeqID_43322
  Gene Ontology: Biological process=transposition, DNA-mediated
  Homolog annotation: Hit_ID=Q1J7G7; Match level="QueryCoverage=46%, HitCoverage=42%, E-value=8e-10, Identity=96%"; Hit description =Transposase
FPVSTGTPGLIFLRSDLPSQWLLFLSAVPPVQLLTGWCVTAKAPPNISAGKCSGHAARNHHTRRA

SEQ ID NO: 135008 - protein, 72 aa, Glycine max
  Coding DNA Sequence Number=SeqID_43323
GRIILSYLLGWGQNVDSRNQSRYLGTDASGDGVTTDQSLPLLCEKQAENVAARQPRILCIRGFLLLFVCFKK

SEQ ID NO: 135009 - protein, 99 aa, Glycine max
  Coding DNA Sequence Number=SeqID_43324
MDDVAAQQHPAQRSQFRPPSAEVSAGMPPTRQPLDPDKPNRALGFPALIIGLCQSFGVPVTPSKVIRLSITRAFIEKYCTPRQAQGGDLQAPNAPPPPP

SEQ ID NO: 135010 - protein, 133 aa, Glycine max
  Coding DNA Sequence Number=SeqID_43325
GGGAYGKTALPRPSHFPVKYLPGIFQEISRPGFVSHPLAHRIPQPEEESVLERPPRGGSNSPIVSRIHIFMLARRFFSCHNAHWNTLPVTQHSNRQLHTSPFTPAGNSEEARTRSPLPLTVAQVPELEMGRAL

SEQ ID NO: 135011 - protein, 303 aa, Glycine max
  Coding DNA Sequence Number=SeqID_43326
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHDFRWPSEHKGLHWVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135012 - protein, 90 aa, Glycine max
  Coding DNA Sequence Number=SeqID_43327
ELVPLDLEVEATCQRNRAERRQKILQNRTVVSILADESQSSESSSSYSPSLRESATNLPEAIIMANEQPGRVTLEDYSSSSVPLFFISIA

SEQ ID NO: 135013 - protein, 438 aa, Glycine max
  Coding DNA Sequence Number=SeqID_43328
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=97%, HitCoverage=54%, E-value=1e-142, Identity=57%"; Hit description=DNA polymerase
  Pfam annotation: Domain name=DNA_pol_B_2; Domain location=1-318; Score=121.7; E_value=2.2e-33; Accession=PF03175.4; Description=DNA polymerase type B, organellar and viral
MEQDILLLGGIMQSFQDIYYKAYQADIVNKLTIASLALSLFREKYYDYNKHRIHIPNQNEDTFIRRGYYGGHTDAYLPYGTNLYYYDVNSLYPFVIKEFSMPGGTPVWHSDLEYMTLDNMFGFIEAYVECPKSINKPFLPYGDNKDGTLIFPTGTFVGVYYSEELKYARDIGYTIIPICGYLFEEMESPFKDYINSLFESRSNAKKKGNNALSFVYKLLMNSLYGRFGINPQSTKTEMCNKSKRDRIFRRPEFIDDVFIREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPDWKELSVKKKESTTTLRTLSNSKRIPFFNEKGKY

SEQ ID NO: 135014 - protein, 203 aa, Glycine max
  Coding DNA Sequence Number=SeqID_43329
  Subcellular localization annotation: CTP_CleavageSite=22; ConfidenceScore=5.16e-01
MWGANPFPVRKYTSRPFHLKVRRSRLFRFFRHFLQINVGGDSARIPFVQHASRESGVALPPKGRLRQCLPKVLGKFTEAPETIFQKRGGVFRLVASSLSNPTSKMFRKGLGNLVPLDLEIKATLRRNRAERRRKLLQGRIVVSILEEETHFSDSTSSDSPSSRESTTYLPEVVSMADEHQQRVTLEDYSSSSVPQFFTTHCTS

SEQ ID NO: 135015 - protein, 62 aa, Glycine max
  Coding DNA Sequence Number=SeqID_43330
MGQIRFLCSVAIGLDGAVSVLFAADRRRIAVLGSDGRPQANAGVIGNGGEEGRVKFGGEGVQ

SEQ ID NO: 135016 - protein, 62 aa, Glycine max
  Coding DNA Sequence Number=SeqID_43331
MVILGPLSFRSSQSSDKRAETKYGHSAPFVIQEQCVEWWAETNYGFAGGEIDRPNGVSLEQN

SEQ ID NO: 135017 - protein, 35 aa, Glycine max
  Coding DNA Sequence Number=SeqID_43332
MAQRINEGRGVEKGAAWVSPVQVVPRKGGMTVVWE

SEQ ID NO: 135018 - protein, 65 aa, Glycine max
  Coding DNA Sequence Number=SeqID_43333
MVVNECVIDICSDITCHEGEAQTDSSESRPWDTRFECSFKPMLIPCGWGILAKQSNPDWSPYDVT

SEQ ID NO: 135019 - protein, 81 aa, Glycine max
  Coding DNA Sequence Number=SeqID_43334
  Gene Ontology: Mol. function=structural constituent of ribosome; Cellular component=ribonucleoprotein complex; Biological process =ribosomal large subunit assembly and maintenance
  Homolog annotation: Hit_ID=Q6D4H1; Match level="QueryCoverage=100%, HitCoverage=68%, E-value=5e-28, Identity=82%"; Hit description=50S ribosomal protein L20
  Pfam annotation: Domain name=Ribosomal_L20; Domain location=1-72; Score=107.6; E_value=3.8e-29; Accession=PF00453.9; Description =Ribosomal protein L20
AVIKAGQYAYRDRRQKKRQFRQLWIARINAAARQNGISYSKFINGLKKASVEIDRKILADIAVFDKLAFTALVEKAKAALA

SEQ ID NO: 135020 - protein, 247 aa, Glycine max
  Coding DNA Sequence Number=SeqID_43335
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTFIVQYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135021 - protein, 230 aa, Glycine max
  Coding DNA Sequence Number=SeqID_43336
MASNFQQFSARNDAIVIREVHEVATNSAASSETKNLEGKLDALVNLVTQLALNQKSVPVARVCGLCSSADHHTDLCPSMQQPGAIEQPEAYAANIYNRPPQPQQQNQPQQNNYDLSSNRYNHGWRNHPNLRWSSPQQQQQQPAPSFQNAAGPSRPCIPPPIQQQQQPQKQPTVEAPPQPSLEELVRQMTMQNMQFQQETRTSIQSLPNQIGQLATQLNQQQSQNPDKLPS

SEQ ID NO: 135022 - protein, 713 aa, Glycine max
  Coding DNA Sequence Number=SeqID_43337
  Gene Ontology: Mol. function=glutamate synthase (NADPH) activity; Cellular component=chloroplast; Biological process=nitrogen compound metabolic process
  Homolog annotation: Hit_ID=Q1GXP0; Match level="QueryCoverage=48%, HitCoverage=19%, E-value=1e-128, Identity=66%"; Hit description =Glutamate synthase
  Pfam annotation: Domain name=FAD_binding_1; Domain location=571-713; Score=-20.5; E_value=1.3e-06; Accession=PF00667.11; Description=FAD binding domain
  Pfam annotation: Domain name=Flavodoxin_1; Domain location=411-542; Score=145.5; E_value=1.5e-40; Accession=PF00258.16; Description =Flavodoxin
  Pfam annotation: Domain name=GXGXG; Domain location=4-128; Score =34.6; E_value=2.6e-09; Accession=PF01493.10; Description=GXGXG motif
  Pfam module annotation: Pfam domain module=FAD_binding_1::Flavodoxin _1::GXGXG; Domain location=571-713::411-542::4-128
  Subcellular localization annotation: CTP_CleavageSite=50; ConfidenceScore=5.00e-01
QCGGELVVMSPGGGAQDSDGNVLIGNFALFGSTGGRLFVQGQAGDRFAVRNSGATAVVEGVGDFCCEYMTNGAILNLGTFGKGFGNGMSGGFAYQYDPYRSLAAHAAGDSVLFGSIADEDEMAQVHKQAVLTMLHWHLEATQSPRAAWLLENWETECQHFVYVMPRSLLLYQDGGEILKAKTRKDLLEELSTSLAAHQVAKFKSAWRAGKTIADGAVPAYGATDTQEMFVLLNNYTVLSFAQQLALGKLPKGTAVEDAAVEKAVRNLLMTEDFALVSKLQRHARAAIENYSDDELASLIAAKRMSDYKAALTQRNIRSMDSLATYGWIIYQDACNREVLGHLPDFEELFARAALPEIAAAIPYIPEDAPFNGEQKYWLAGFLAGLHSRLLVLEDKQTAPAAGASATTQLHILFGSQTGNAEALAQTAAKAARAKGLVPVVQALGEVDLDVFATMRHVLIVTSTYGEGEMPDNAQLFWQAISASTAPRLEQMHFAVLAIGDTGYDGFCQAGKFIDMRLEQLGAKRVVDRIDCDIDYEEPSSEWIGSAMPQFAASAGSSGTVLESAPEAPVIPGSNKQNPYAAALVTNKRLSGEQSAKDIRHFEFDLSDSGLKYEAGDALGVIPVNDAGLVSLLLSELKADYETPVPGFDRNLGDLLTYQFEISEPSRKLIEWVGQHTTNQELLHVLQHDDKDTLANWLWGKDTLDLLQLELKRS

SEQ ID NO: 135023 - protein, 147 aa, Glycine max
  Coding DNA Sequence Number=SeqID_43338
  Subcellular localization annotation: CTP_CleavageSite=53; ConfidenceScore=5.18e-01
MTMHNMQFQQEIIASIQSLTNQMGQMATQMNQAQSQNSDKLPSQTVQNPKNVSAITLRSSNQIQVPPPVATPAPEPVKLHSTPEKKDETVAQKRKLPNKKFHAGGPSSSNSDLQQPPIPLPFPPREFPNKKMEEAEKEILETFRKVE

SEQ ID NO: 135024 - protein, 179 aa, Glycine max
  Coding DNA Sequence Number=SeqID_43339
  Gene Ontology: Mol. function=nucleoside-triphosphatase activity; Cellular component=integral to membrane; Biological process=response to antibiotic
  Homolog annotation: Hit_ID=A4AMI3; Match level="QueryCoverage=98%, HitCoverage=81%, E-value=1e-64, Identity=65%"; Hit description=ABC transporter ATP-binding protein
  Pfam annotation: Domain name=ABC_tran; Domain location=1-166; Score =139.9; E_value=7e-39; Accession=PF00005.18; Description=ABC transporter
MGSSGSGKSTLLNIIGILDEKDSGIYELDGVPIEHLSEVKAAEYRRYKTALENVALPLYYQNVPRKERNQIAMEYLEKVGLAQWATHLPNELSGGQKQRVAIARALITNPKVVLADEPTGALDSKTTHDIMKLLQDINNEGKTIIVVTHEPDVAAQTKRNVILKDGVIESDEFIKQVVL

SEQ ID NO: 135025 - protein, 164 aa, Glycine max
  Coding DNA Sequence Number=SeqID_43340
MFGALMGNNGGGEREKKSNVGVKRRAFEFSAEGRERITCHLSHFEWNKKGPTFSLGVTSYSATRREKFDLLNSKILPRSACHFSGRNFQDVTSQPTLLRASEAKLTGASPKGGKCAESPPTIICGKRQKNRRKPVMKNIPDSGVVFTFEEGISTSHVCPKGQQP

SEQ ID NO: 135026 - protein, 104 aa, Glycine max
  Coding DNA Sequence Number=SeqID_43341
MFGRRYSLQAYPYGLPPDFTPRAAPEDLSQAPTFEGQLPPYDDYPGQDYEERDTHLGPLLHLKDPSPHELPQPNIVCHIPDSPTPVKESVTFAKDKGTIEALEE

SEQ ID NO: 135027 - protein, 80 aa, Glycine max
  Coding DNA Sequence Number=SeqID_43342
MARTKKTDQMTFEAAKEIANKIVKHPGCVRAAGAGAMIKQYFGPAPRTSRMFSSMAPEDLEQLTQQIKDQLEESIIEKVT

SEQ ID NO: 135028 - protein, 144 aa, Glycine max
  Coding DNA Sequence Number=SeqID_43343
MERSMIDAASGGALGDMTPAGARNLIEKMASNSQQFSSRSDDIVIRRVHEVVTNSSGETKKLEGKLDALVNLVTQLAMNKKSAPIARLCGLCSSADHHTNLCPSVQQYEAIEQPEAYAAKIYNRSPQPQQQNQPQQNNYDLSSS

SEQ ID NO: 135029 - protein, 37 aa, Glycine max
  Coding DNA Sequence Number=SeqID_43344
LCLTASRYWAPFVTQYVKFRDMPEIKRKHCYAIREVP

SEQ ID NO: 135030 - protein, 102 aa, Glycine max
  Coding DNA Sequence Number=SeqID_43345
MTRQIGGYLTLLQEHFPSVHQCVIDDAYEETSPRASRWLTTKAYMKGIAGVPYWACCDALIVTNVSADYMEWFFQISHPFIIPTQAGDQPRHPPAPDHEDYI

SEQ ID NO: 135031 - protein, 122 aa, Glycine max
  Coding DNA Sequence Number=SeqID_43346
MGEAEKVQEKMKAKMEAIKEQMATMIKAMMSMKKIMEANAAHISQTMGKTHEIPHHNLADFEPWLGYATEGQAVGGIPFENTLESPQFRPQPQPLHFCGGKSPSCYGRKGKDGSSKGKAQGH

SEQ ID NO: 135032 - protein, 121 aa, Glycine max
  Coding DNA Sequence Number=SeqID_43347
MDRARLIFGLVSRMDMNIGALIFCQMTSIAQSNTSRLGFPALITALWARKERTRPAELPSISAAPTPASTSAAPSVPAQSLQVVAPPGSIPSIEQFLERVAWPGAQPSLHREDEGPTAQVP

SEQ ID NO: 135033 - protein, 270 aa, Glycine max
  Coding DNA Sequence Number=SeqID_43348
  Homolog annotation: Hit_ID=Q5XM22; Match level="QueryCoverage=25%, HitCoverage=38%, E-value=9e-22, Identity=73%"; Hit description =Resistance-like protein HAAS-2
  Pfam annotation: Domain name=DUF1723; Domain location=142-186; Score =37.8; E_value=3.9e-08; Accession=PF08330.1; Description=Protein of unknown function (DUF1723)
MVRTRGLPRSLGRGIGRGRGGQDEHHPDDVPRRSRPTASVHRQQVRVAEEVVDMTENVPPMTTDVPAAGVEGLVANDVATGSVVDDAVVGFPGGPRDPSMLTSFPDHVAHNIWTREAYIRPHFEGLVAATRLSPLIGCSVVTDDPRLIYALVERWHGETNNFHLPVGELTITLDDVEEVEEVIILLMELLEVLGQEARAETAQARGTYVRLSWVWDIYLSRCEARRWIVVARAYLLHLVGCTLFANKSATHVHVVHLEAFRDLGESGRYA

SEQ ID NO: 135034 - protein, 64 aa, Glycine max
  Coding DNA Sequence Number=SeqID_43349
MECDTHFPCVVSCVYNNPTSVDLEKCVGSVKEKVIYVRGRGCHSDSSECRPWGSPGLSAPLSLC

SEQ ID NO: 135035 - protein, 135 aa, Glycine max
  Coding DNA Sequence Number=SeqID_43350
MAASDIAILRDRAHISTKKSLLELTSQDALLAQNKLLSKQLEAFTKTLRCTIYGGAHESGCCIPNEEKIAHEVYYMGSQPSGKITLGGSSTRPQQQMPSLYDRTTKLEETLAQFMQVSMSNQKSTEFAIKNLEVQ

SEQ ID NO: 135036 - protein, 136 aa, Glycine max
  Coding DNA Sequence Number=SeqID_43351
  Subcellular localization annotation: CTP_CleavageSite=46; ConfidenceScore=5.18e-01
MPPTKHPLDPNKSNRALGFPALITSLCQSFRVPVTPSKVIQPPITRAFIEKYCTPRQAQGDAPQAANIPPPPRQADPAGSFGMERYLQHLVRQQAANHRGKVQINECLYQLSLSQQSQGFAPFACPTPDQFRAEVA

SEQ ID NO: 135037 - protein, 92 aa, Glycine max
  Coding DNA Sequence Number=SeqID_43352
  Subcellular localization annotation: CTP_CleavageSite=58; ConfidenceScore=5.34e-01
MVHDIFVKVKLEVTGTSTALNVFGSRRNSDVTRSIFCPNFFKMVTSILQLDSMNLFVKARAWFNPITQGMKWVYDPNMVGSWYLTHATKNAS

SEQ ID NO: 135038 - protein, 181 aa, Glycine max
  Coding DNA Sequence Number=SeqID_43353
FVARDFGFVHDPWIGDHRVDHRRRGEERGGQACHRRWMLRQGHHPVLPEVYALGELQPIVDHFGEILRPSQREENCSFVLCPLNVLDVDTFLDKFIKWTHFPQLLHLLNSEFNHGANHLLVSLLMAKMHIPLGPRVSTLCSSTMTTFSVFFTMVLKFLPLLATSMAGILESSLGRSACSTE

SEQ ID NO: 135039 - protein, 60 aa, Glycine max
  Coding DNA Sequence Number=SeqID_43354
MPLQGEDESRRSSPPLEAMDKSLKVGEDEYRERERRGTKFCASNEPTNPKSSPRFSTKCA

SEQ ID NO: 135040 - protein, 179 aa, Glycine max
  Coding DNA Sequence Number=SeqID_43355
MERSMIDAASGGALDSSLSAENKKLEGKLEALVNLVTQLAINQKSASAPVIVARVCGLCCKSAITLRSGKKIEVPPPVVAPAPEPVKLHSTSEKEDELAKQKRKLPDHEGANKNFHAGGPSSSSSDLQQPPIPLPFPPRAIPNKKMEEVDKKILATFRKVEVNIPLLDATSKFQDMSSF

SEQ ID NO: 135041 - protein, 46 aa, Glycine max
  Coding DNA Sequence Number=SeqID_43356
MEAAEFCTKSGIEELICEFLGLESFVSHLDGTLTSSVGPMSVSERE

SEQ ID NO: 135042 - protein, 140 aa, Glycine max
  Coding DNA Sequence Number=SeqID_43357
MAEPSKKRKGSSSRSQRHSETQETQIPSSISSSSLFSSEEQRIRYTNIFSSHSIIDPKFIDMDFFSNESFECIQAFENSNLIPFMSLKLPVYYELVKAFYSNLKIQEGTLISEVYGIKMVIDQSLFYDLTQLSSEGVPFE

SEQ ID NO: 135043 - protein, 80 aa, Glycine max
  Coding DNA Sequence Number=SeqID_43358
MIPRAHAHQGGNTAPPPEHHKNAGTLRVKVVETRQDYNRYCQALFPQAPGIVVRSPFPTLAYRIQPPPVLPSGSDKASFT

SEQ ID NO: 135044 - protein, 124 aa, Glycine max
  Coding DNA Sequence Number=SeqID_43359
MRGSGEFVPFLDTASRGNKMPQRTFLRRRHGPSVGLFTEGIKTEPICNAYAKDTMRELESPTVATYPSAGGRRETRGMRVPRKEYARSRHQRLFEENVGKTGKDAFYELLSERFGSCIYAWGRY

SEQ ID NO: 135045 - protein, 63 aa, Glycine max
  Coding DNA Sequence Number=SeqID_43360
  Subcellular localization annotation: CTP_CleavageSite=43; ConfidenceScore=5.07e-01
TYQGNPCGVYPDLSSFTGSGVIQKLYSLYQVIRPVRFTSSGIRASALDTVGLKQTIVAKVMSI

SEQ ID NO: 135046 - protein, 91 aa, Glycine max
  Coding DNA Sequence Number=SeqID_43361
MTCRSRNFTNCLMMGAKHLTRTKERSHVIKQRMTKLGLCLSSGPPPLDDKRVRITVRMTKLGLCLSSGPPPLDDKKGADNRKVSPRIMGAE

SEQ ID NO: 135047 - protein, 163 aa, Glycine max
  Coding DNA Sequence Number=SeqID_43362
  Homolog annotation: Hit_ID=A5AZ88; Match level="QueryCoverage=77%, HitCoverage=12%, E-value=6e-09, Identity=32%"; Hit description =Putative uncharacterized protein
MRRKRNNGSSAHKYTLTKKIISKLTHFLINRLPKEKGMKTMSCVLDMGKGKLELSVEDQKISFDLFEAMKHLDDSEPCFEEEMLEQEIEVTASSMVLQTLVQKEFDYETKCLVSKDGGEILACIEKLDDPDDESIGHVMFEEVENNRPKEKPKVELKTLLAHL

SEQ ID NO: 135048 - protein, 68 aa, Glycine max
  Coding DNA Sequence Number=SeqID_43363
MNSLLIPHDVSSIGASEWRRKRERRRHFKEKMSLEEAHHHRRPWIRAWRKKEMNEGRGREEHEILCSK

SEQ ID NO: 135049 - protein, 73 aa, Glycine max
  Coding DNA Sequence Number=SeqID_43364
  Subcellular localization annotation: CTP_CleavageSite=38; ConfidenceScore=5.43e-01
MSFLWKWPQGSLPQRDTGRIKRLKEPVPLPNMTTTVLRALSTSSASRPSRDGHFSGSDASSSGKTSIPTSRRR

SEQ ID NO: 135050 - protein, 180 aa, Glycine max
  Coding DNA Sequence Number=SeqID_43365
MAPKKLSSKRSRRDAAAEGTSATPEFDSHRLRSAKHQQRFEAIKGWSFHKERRVQLMDDEYTDFQEEIARRHWTSLVTPMAKFDPDIVLEFYANAWPTEEGVRDMRSWVRGQWIPFDVDALSQFLGDPLVLEEGQECEFSQRRTGTMGSTRRPLLSYYASRVRILPGPLQGGGCGSCAPA

SEQ ID NO: 135051 - protein, 74 aa, Glycine max
  Coding DNA Sequence Number=SeqID_43366
METISKIFEELDVCGKVTLKSKLREIAYPDQNSMCPPPSKVNTKGAPKKPMNNNQRSTKHDPSYWEYVDAFHSM

SEQ ID NO: 135052 - protein, 75 aa, Glycine max
  Coding DNA Sequence Number=SeqID_43367
HLIKFDVDSLNNFLETLVVVEQGESLPSYSRFSRLRPDPQELAAQLCIPGRGFVLTLISSGDLCLMACDLSLVLV

SEQ ID NO: 135053 - protein, 228 aa, Glycine max
  Coding DNA Sequence Number=SeqID_43368
  Homolog annotation: Hit_ID=Q6UUU1; Match level="QueryCoverage=26%, HitCoverage=40%, E-value=3e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGNYRLEVQPGKTCKSTTGQQPLARLPRFKGVG

SEQ ID NO: 135054 - protein, 52 aa, Glycine max
  Coding DNA Sequence Number=SeqID_43369
MTNIANVSSQEMAPKKLRAKRSRKDVVGEGSSAASQVDVEFYGHSFRSEEHQ

SEQ ID NO: 135055 - protein, 209 aa, Glycine max
  Coding DNA Sequence Number=SeqID_43370
  Homolog annotation: Hit_ID=Q2HW90; Match level="QueryCoverage=94%, HitCoverage=39%, E-value=2e-26, Identity=35%"; Hit description =Putative uncharacterized protein
MGQLLRQAFRKAYGKIWDLATVEVSIEAISSLAQYYDQPLRCFTFGDFQLSPMVEEFEEILGCPLGGRRPYLFLGFYPSLARISKIVQISAQELDHRKQVENGVVGIPIKYLEAKARILEGKGEWAPFIDILALLIFGGVLFPNVDGLVDLAAIDAFLAYHDHKESPVVAMLADLYDTFDRRYEKSSTRIVCCTPALYVWLVSHLFRQE

SEQ ID NO: 135056 - protein, 91 aa, Glycine max
  Coding DNA Sequence Number=SeqID_43371
MTDVVPDVTTSRFRTCSIFGQDVLDIVSDIVDPAASILHLTFILPCALCSNSSIFGQDVLDIVSDIVDPTASILHLTFYLALCIVQPDLIP

SEQ ID NO: 135057 - protein, 157 aa, Glycine max
  Coding DNA Sequence Number=SeqID_43372
  Pfam annotation: Domain name=G-patch; Domain location=1-54; Score =4.8; E_value=0.049; Accession=PF01585.14; Description=G-patch domain
MVARVMLRNGFEPGMGLGKDCLGNADVVDIKGNPYKVWPGRISQCFTSAGMVSEEEVATIEEEFPQDPPSFVQPCHPDSQVGNWRMISQSEVYTADLIYEGRFFEDPDNEGLTIDFDRDISQTINEEEEEDVLTPELERLVAQEECEMKPHQEETEL

SEQ ID NO: 135058 - protein, 142 aa, Glycine max
  Coding DNA Sequence Number=SeqID_43373
  Homolog annotation: Hit_ID=A2Q1D6; Match level="QueryCoverage=95%, HitCoverage=30%, E-value=8e-13, Identity=28%"; Hit description =Ovarian tumour, otubain, related
MKNMVNCSDAFNTSQVFATHDDVLHWAQYVVYEIGFMAVIMRSDTNDGIRGRTSFVLIDCERSGRYRAKKKDLDEKIIVADMTKSMVKPRNILLTLKEHNVNIYTTIKKIYNARNAYRSSIRDNNIEMQQLMKLLERDQYIH

SEQ ID NO: 135059 - protein, 274 aa, Glycine max
  Coding DNA Sequence Number=SeqID_43374
  Homolog annotation: Hit_ID=Q84VH5; Match level="QueryCoverage=88%, HitCoverage=39%, E-value=1e-100, Identity=72%"; Hit description =Envelope-like protein
MDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSVGKLSVKYAILHRIGAANWVPTNHTSTVATAFRILCCQITHCLPNCIVWHYVESTSQYLNYTDSVKKRESPLSLHYKLFEGTHVPDIVSTSGKAAASGAVSKDALIAELKDTCKVLEATIKATTEKKMELERLIKRLSDSGIDDGEAAEEEEAAEEEEDAAEDTESDDDSEATP

SEQ ID NO: 135060 - protein, 64 aa, Glycine max
  Coding DNA Sequence Number=SeqID_43375
MASELSTDSTDTSTSSNSSSATSKDMIEVPSFYHQQWALEYPEFVNFRYDGTTYQIRLRQHRAK

SEQ ID NO: 135061 - protein, 234 aa, Glycine max
  Coding DNA Sequence Number=SeqID_43376
  Gene Ontology: Mol. function=chloramphenicol O-acetyltransferase activity; Biological process=response to antibiotic
  Homolog annotation: Hit_ID=P62577; Match level="QueryCoverage=88%, HitCoverage=94%, E-value=1e-121, Identity=99%"; Hit description =Chloramphenicol acetyltransferase
  Pfam annotation: Domain name=CAT; Domain location=6-209; Score=500.5; E_value=2e-147; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIHVHHAVCDGFHVGRMLNDYNSTAMSGRAGRNFLRQLLVPRNILSD

SEQ ID NO: 135062 - protein, 273 aa, Glycine max
  Coding DNA Sequence Number=SeqID_43377
  Homolog annotation: Hit_ID=A5BSR3; Match level="QueryCoverage=43%, HitCoverage=35%, E-value=8e-10, Identity=35%"; Hit description =Putative uncharacterized protein
  Pfam annotation: Domain name=Transposase_23; Domain location=192-259; Score=-10.0; E_value=0.015; Accession=PF03017.5; Description =TNP1ENSPM transposase
MAEKTKSRVNQGDGTDNTDVVGDPPSPIARHLKWKKARTNKFGQMASAATQEIANKIDDLQEQSTQGTFVPHGREDILNTAIGRPEHPGWVRVAGHGVTIGNYYGPRGSGSNTSSATMTADKLVEIIGSIKQELRKELDAIKSELSQIQTQQSAPFRPSIPNVLVARVSTKESCAEAAANVVANDQSTLDASIVGLYIVCGDSTQVVAAGKMYGVGGIIHNVAYADDVVRICVETIYDGDASVPFPTSEIQYVRDASSTFIAWPRHLVKPITD

SEQ ID NO: 135063 - protein, 214 aa, Glycine max
  Coding DNA Sequence Number=SeqID_43378
  Homolog annotation: Hit_ID=Q2HW90; Match level="QueryCoverage=87%, HitCoverage=43%, E-value=3e-18, Identity=32%"; Hit description =Putative uncharacterized protein
MGSSQKPSLKKRFYQVKIKSLEVTSLRELGQLMGQLQQQAFRKAYGKIWDLARVEVSMEPIASLSQYYDQPLRCFTFEDFQLVPTVKEFEEILGCPLGGRKPYLFSGFYPSTTRVAKVVKISAQELNQANGLSFIDILALLIFGVVLFPNMEGLVDLAVIDAFLAFHHGKESPVVAILAMYDTFDRGCEKSSARIVCCALALYALAGFTPFSPR

SEQ ID NO: 135064 - protein, 83 aa, Glycine max
  Coding DNA Sequence Number=SeqID_43379
PLGPSGIFLQKAVASGGSNPARLGELGGNHLPYFAINRGGKQEGRAEALPKRFRNVFREESRKGFNRSSTFFIRSSSFFDLQR

SEQ ID NO: 135065 - protein, 52 aa, Glycine max
  Coding DNA Sequence Number=SeqID_43380
MGLRSRIVLGDGQIPGKIQRQRPIKVNGNAVTVCCAMSFPTLKYLGTDASRA

SEQ ID NO: 135066 - protein, 87 aa, Glycine max
  Coding DNA Sequence Number=SeqID_43381
MGASSFFDSVAQRMMQYVSPTNCYFVVIQRHLHTPNNPWSEKLSLLQNIWIESSGMKPPTYLDSSQAQGRPSMVLTTQTQLEGFLPA

SEQ ID NO: 135067 - protein, 46 aa, Glycine max
  Coding DNA Sequence Number=SeqID_43382
MKHWMSSKSLRMKLRTNVKEGTEHYCAWYGVCLATPIFLNLCGSKH

SEQ ID NO: 135068 - protein, 118 aa, Glycine max
  Coding DNA Sequence Number=SeqID_43383
  Pfam annotation: Domain name=zf-CCHC; Domain location=46-63; Score =28.6; E_value=2.2e-05; Accession=PF00098.14; Description=Zinc knuckle
MQEENEDEEDFLLYVKKFHKFVKNRRIERHQNFNNGKRSQEGSLTLKCYKCNQPGHIKAHCPTNESWPEKNEKKSHEERRSKKAYIAWDDNDSSDGSEKEINLLSKDYESNENISQED

SEQ ID NO: 135069 - protein, 198 aa, Glycine max
  Coding DNA Sequence Number=SeqID_43384
  Homolog annotation: Hit_ID=UPI00006A2D9E; Match level="QueryCoverage =60%, HitCoverage=81%, E-value=1e-09, Identity=17%"; Hit description =UPI00006A2D9E related cluster
MRGTVHEPQVNIGADQKFSPIDVFNKKRGQTLGFQWIDQTSNASIAVTPKWVNPWVLVPSPLEDHTSFTFRELHALAIRGLHVLTFRGLHALAIRGPHVLTFVGLHALTFRGPHVLTLRGLHALAIRGLHVLTFRGLHALAIRGPHVLTFVGLHALTFRGPHVLTFRGLHALALRGLHVLTFRGATRPRHQRTTRPHL

SEQ ID NO: 135070 - protein, 66 aa, Glycine max
  Coding DNA Sequence Number=SeqID_43385
  Homolog annotation: Hit_ID=A8GD80; Match level="QueryCoverage=100%, HitCoverage=38%, E-value=4e-21, Identity=72%"; Hit description =Putative uncharacterized protein precursor
MRLNTWSKALLPLVVLACVSATQVRAAESDTGPIPIQLLGNWRVSKIVPTQTTGCWDQQQAQSLIG

SEQ ID NO: 135071 - protein, 115 aa, Glycine max
  Coding DNA Sequence Number=SeqID_43386
FRALLEHKISCSSLPLPSIIFFFLQAHIHGLLWCGFSSLSSFSILLPFIFQEAKESIDEEDPRPTSSNGAYMTKEFRRLVLPSFGKGRRETQKEFRRLVLIEFFLAKGKENEKDE

SEQ ID NO: 135072 - protein, 158 aa, Glycine max
  Coding DNA Sequence Number=SeqID_43387
  Gene Ontology: Mol. function=nucleoside-triphosphatase activity; Cellular component=chloroplast
  Homolog annotation: Hit_ID=Q2PMM5; Match level="QueryCoverage=98%, HitCoverage=7%, E-value=1e-68, Identity=78%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPKSWVLNSNSIDDKEREFLVQFSTLTTEKRIDQILLSLTHSHHLSKNNSGYQMIANNREQPKI

SEQ ID NO: 135073 - protein, 109 aa, Glycine max
  Coding DNA Sequence Number=SeqID_43388
  Pfam annotation: Domain name=zf-CCHC; Domain location=59-76; Score =24.8; E_value=0.00027; Accession=PF00098.14; Description=Zinc knuckle
  Subcellular localization annotation: CTP_CleavageSite=73; ConfidenceScore=5.85e-01
LKRKSAIKRNSSNNFNQNWINRSKKKGGNSSSPHGKSAVSSAGTKHNSTSSSNTGTRNIKCFKCLGRGHIASECATRRTMIMKADEEITSEYEISEEEEVEEEVEEEAM

SEQ ID NO: 135074 - protein, 250 aa, Glycine max
  Coding DNA Sequence Number=SeqID_43389
  Homolog annotation: Hit_ID=A3N684; Match level="QueryCoverage=99%, HitCoverage=100%, E-value=1e-127, Identity=86%"; Hit description =Putative uncharacterized protein
MNRVRHSGIQHPTPYFNEAEGLKRKAKIDRYLDKKMEEWRQTIPYASHMKDKNINMAYYRRTLIEHIWRIRLSRVSQSKAIYKIAQISPSAAQDYAHYQADEMLHDKLYIHDCEAAGVTMEEVLKTEPYLSTRLFEGFFYYTLEHEHPMAPVVSNYLVEYTQAKLQPDIVKNLRSTLGHDMVKGQEAHLTVDTRDDHSMEMWKILNQLILSEDDYNAVFKYIDDIQAILAMFFREIYEDTVQRPAEKASA

SEQ ID NO: 135075 - protein, 112 aa, Glycine max
  Coding DNA Sequence Number=SeqID_43390
MEHTNLGIPRSYGYACPRTLGSCISFLNDHFRGNTGSIKDRRKSLKVYQSCTVRGEKVASAQDFVGNQRERTTLGRGQGLTSSPWVKVYDKLGFWLKACRTAGHDICQGLAS

SEQ ID NO: 135076 - protein, 136 aa, Glycine max
  Coding DNA Sequence Number=SeqID_43391
MVLKEELVACLRSKRSLARHLEATEQSMLAIIGQYKEELNQSLTHEQKLVEDFAQAYAEKEARGRVIDALHQEATMWMDRFALTLNGSQDLPRLLAKAKAIAEIKALFPFIKREVLKLITLSKIGLEVDPSALIIH

SEQ ID NO: 135077 - protein, 89 aa, Glycine max
  Coding DNA Sequence Number=SeqID_43392
MNRKQIFTVVATYPSAGGRRVARGMRVPRKEYARSRHQRLFEENVEKTGKDAIYELLSERFGSCIYARGRVFPFAPTYSSICDEEIRPT

SEQ ID NO: 135078 - protein, 129 aa, Glycine max
  Coding DNA Sequence Number=SeqID_43393
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=86%, HitCoverage=68%, E-value=2e-25, Identity=61%"; Hit description=LacZ -alpha
  Subcellular localization annotation: CTP_CleavageSite=34; ConfidenceScore=5.27e-01
MTMITNSSSVPACFDCVDFAPRTLSRGYAFFVAPGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 135079 - protein, 103 aa, Glycine max
  Coding DNA Sequence Number=SeqID_43394
MVKEEDKEVSVSSKRLAKKESHFSIKTNIKETSSLRQPPHLLLCKKTLVSIATPIGLEVIPQVKELLDEGLVCKSLNHCALLVPKIAPLIELVRNHVPSWEDA

SEQ ID NO: 135080 - protein, 65 aa, Glycine max
  Coding DNA Sequence Number=SeqID_43395
MKKMKIGGFPLELKRMVEQDDREMKPHQEETKIINLGANEDKKEPTLFQSPRRMGRCKYAWTIRI

SEQ ID NO: 135081 - protein, 162 aa, Glycine max
  Coding DNA Sequence Number=SeqID_43396
  Gene Ontology: Mol. function=subtilase activity; Biological process =proteolysis
  Homolog annotation: Hit_ID=Q6L477; Match level="QueryCoverage=100%, HitCoverage=30%, E-value=2e-10, Identity=25%"; Hit description =Putative uncharacterized protein OSJNBa0009L15.8
VDVTYKTWKEVPVAQKDLIWEDIQAEFEFPEASDSRTKKKILQIIGEQWRQFKSVKNTALAKRNGPSFVRPAETPRGRYDVQKKAQAIQKQNTAPYVLSRGGYEYLEQKLMAAQSGSTEGVIDPPSLIRRHVKWKLARTKKTGQMTSEAAKEIAEKIDSLDE

SEQ ID NO: 135082 - protein, 92 aa, Glycine max
  Coding DNA Sequence Number=SeqID_43397
MFDEFKEELERRHWDEELTDFANGNIDVAIVKEFYANFYDLEDKSPKQVRVRGHLIKFDEDTLNTFLKTPVVVEEGETLCAYSRFALLRPDP

SEQ ID NO: 135083 - protein, 99 aa, Glycine max
  Coding DNA Sequence Number=SeqID_43398
MRWVNRVGPHSIDPKNHFLQFTQWNSKARTNKRWEFLWLTLSFSIWYHRNAMLFKNQPFTPEKVMDDALFHTWSWLKCVEKDFNMHFTFWSTNLKDVFS

SEQ ID NO: 135084 - protein, 76 aa, Glycine max
  Coding DNA Sequence Number=SeqID_43399
NQGVPTNTKRIKLISEWPTPLGVEGRSPKFQEPRHLRSNPFQKGGGGMMQSYPPRALGRNSKKIEPEMHEKALGFS

SEQ ID NO: 135085 - protein, 95 aa, Glycine max
  Coding DNA Sequence Number=SeqID_43400
MSCTGSLSAPLYLTKRTALVHLLREKAVHKCAKCTSTNKAINLSLKSNFVKSLDWDSELCMSRISRERKVQVPESFERFCCVKICRDQSLKQEPV

SEQ ID NO: 135086 - protein, 70 aa, Glycine max
  Coding DNA Sequence Number=SeqID_43401
MQSYPLKVLDRRLKEDWARVAKEGSRVLMNLKPSLLLIKPRPQIPLVRLNSTKTTLRHTYTTKFLCPDPS

SEQ ID NO: 135087 - protein, 217 aa, Glycine max
  Coding DNA Sequence Number=SeqID_43402
  Gene Ontology: Mol. function=transcription factor activity; Cellular component=nucleus; Biological process=regulation of transcription, DNA-dependent
  Homolog annotation: Hit_ID=A7PF45; Match level="QueryCoverage=81%, HitCoverage=76%, E-value=7e-34, Identity=48%"; Hit description =Chromosome chr11 scaffold_13, whole genome shotgun sequence
  Pfam annotation: Domain name=AP2; Domain location=11-54; Score=11.0; E_value=0.098; Accession=PF00847.11; Description=AP2 domain
MIISSFSLPTSLYLSSSYYHLIGTNFHGYHTGTFETAEEAARAYDQAAILMSGRNAKTNFPIVQTPEGDPKTTLTPTDHETPSSSMTTSKELEEILHAKLRKCGKLPSPSMTCLRLDPENSHIGVWQKRAGQHSDSNWVMMVPPLGKKGGANEGGTGDGSCSNNPSSFSKCDPAPQVVRQELLRTEMDEEERIALQMIEELLGRNCPITSPSFNNLY

SEQ ID NO: 135088 - protein, 96 aa, Glycine max
  Coding DNA Sequence Number=SeqID_43403
  Homolog annotation: Hit_ID=A5AG41; Match level="QueryCoverage=89%, HitCoverage=7%, E-value=3e-08, Identity=33%"; Hit description =Putative uncharacterized protein
MELILLRVGLREEERTSIVRFLSGLNMEVRDKVELLPYRNLDDLVQLCIRVKQQLKRKPTSKSYGSHSYPKEDQGQGILWATPSKPKDDKRDEEEK

SEQ ID NO: 135089 - protein, 59 aa, Glycine max
  Coding DNA Sequence Number=SeqID_43404
VGLPFTTIDIEADVRHPLFHPIHLSWEAYFNNPRPLEPERLKALRIQWAQYYLRVRDQT

SEQ ID NO: 135090 - protein, 49 aa, Glycine max
  Coding DNA Sequence Number=SeqID_43405
LASANLKFVDAILPRKGPVTRTMSKRLQEDWARAAEEGPRVLMNLRVDF

SEQ ID NO: 135091 - protein, 221 aa, Glycine max
  Coding DNA Sequence Number=SeqID_43406
  Homolog annotation: Hit_ID=Q2HTA0; Match level="QueryCoverage=55%, HitCoverage=21%, E-value=1e-15, Identity=35%"; Hit description=IMP dehydrogenase/GMP reductase, related
  Pfam annotation: Domain name=DUF1723; Domain location=151-200; Score =56.4; E_value=9.5e-14; Accession=PF08330.1; Description=Protein of unknown function (DUF1723)
MVRTRGLGRALGQVTSRGVGRGDRDDSDDAPQRRRPTASAQRQRVAVTATHAEPVIPAPDVQDDRMEAPAAVEDIVADIRVDTGAKAAEDAHEGFPGGPSDPSVLTLYADHVACSVWTGEDAPELKLSSHGRKVHSLGTPIPAIEGLVADTNDRGLLSAFVERWHRETSNFHLQVGELTITLDDVSSLLHLPVIGDLHTFEPLHVDDAVQMLVDLLMVSPE

SEQ ID NO: 135092 - protein, 209 aa, Glycine max
  Coding DNA Sequence Number=SeqID_43407
  Gene Ontology: Mol. function=catalytic activity; Biological process =mitochondrial electron transport, ubiquinol to cytochrome c
  Homolog annotation: Hit_ID=Q2R0G4; Match level="QueryCoverage=71%, HitCoverage=16%, E-value=2e-16, Identity=37%"; Hit description =Putative uncharacterized protein
  Pfam annotation: Domain name=DUF1723; Domain location=70-119; Score =40.1; E_value=7.8e-09; Accession=PF08330.1; Description=Protein of unknown function (DUF1723)
FHLLGSGNALQSGMMEKRWFQNHMVTQNRQKPGNQRDYLPWLDQVEQAYEDFWKTYGIFDLIQFSRSGPEYRPEMLIAAMHFFESSTNTFQFKCGMMTPTLLDVAALTGLRPSGETYDPTNSSDNIKLVYKENTFSKYIAEHKGPVEEEVSDEEHVAFLTLWLSHYVFCTKSLQCYTNPLGEACDDLKKSKDGSSFLSVWAHVASPVVA

SEQ ID NO: 135093 - protein, 226 aa, Glycine max
  Coding DNA Sequence Number=SeqID_43408
MIDAASGGALGDMTPVEARNLIEKMTSNSKQFSARNDAIVLRGVHEVATDSSSSTENKKLEGKLDALVNLVTQLAMNLKSAPVARPVPHFQNAAGPSKPYVPPSIQQQQQQRSQKRQQATEAPPQPSLEELVRQMTIQNMQFQQETKASIQSLTNQMGQMATLLNQAQSQNFDKLPSQTVQNLKNVSAITLRSSNQIQVPRPVAAPAPKPVKFHSTPEKEDEIVAQ

SEQ ID NO: 135094 - protein, 146 aa, Glycine max
  Coding DNA Sequence Number=SeqID_43409
MVKEECKEVSVSSKRLVKKESHFTIKTNIKETSPLRQPPHFLLCKKTLVSIVIPLGLEFIPQVKELLDEDLVCKSLNLCALLVPKIGIIRHQIPKIGGMMNVLNDATLFYKITGAPNIFMICVLIWDTLGLSYFLIGIINMKIQKK

SEQ ID NO: 135095 - protein, 92 aa, Glycine max
  Coding DNA Sequence Number=SeqID_43410
MVLGKPWSLTTSLKKSFEMWEASSTLWHGIKCAILLNLSTTTKIESTPLWVLGSPRTKSILMSTQGADGMGKDKGLVYPKVAHEPTLMALLH

SEQ ID NO: 135096 - protein, 54 aa, Glycine max
  Coding DNA Sequence Number=SeqID_43411
MHRLKYGRKKEKLRKCFSTGARKNEEGSSLYIAKVGSYMEVTWKLLKLPSTVGS

SEQ ID NO: 135097 - protein, 94 aa, Glycine max
  Coding DNA Sequence Number=SeqID_43412
MTTFKIPNKTLTILKEKLPKIITHKWKFGNLLEAPNTLPIKGLFVTKLESNEVLLSPIALKVCRNLPFGGRATRDSRDACSTKGIRAESPPTFI

SEQ ID NO: 135098 - protein, 35 aa, Glycine max
  Coding DNA Sequence Number=SeqID_43413
MRKASSSSCNLLLSYPNFVWGPLLDDMRPFFGPCE

SEQ ID NO: 135099 - protein, 120 aa, Glycine max
  Coding DNA Sequence Number=SeqID_43414
LEVNTQERRSLEQTDQWLAPTFWWKLNKQRCVRERMREARMSILSISFSIVTVDSTSDSPQFSASPYQLDFTLYALGSYNAQWNASGLLHDKHTLRSSRILGEIEVDEPWLGLWLPLNYQ

SEQ ID NO: 135100 - protein, 115 aa, Glycine max
  Coding DNA Sequence Number=SeqID_43415
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=50%, HitCoverage=46%, E-value=9e-25, Identity=94%"; Hit description =Putative uncharacterized protein
MYPLLFSVNPSRCTLYFESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 135101 - protein, 133 aa, Glycine max
  Coding DNA Sequence Number=SeqID_43416
MEQEVIHNLAMEHFKKFYIEEGEYEQLLCPNRFLILCEGDIQFIHLPFTMRELSISKVWDHVVKGCRWLVGGGASIQFWWDRWLPTSVIIEELDVTVNGMVTDEGEWQHGLFVNRVLEWLVVEIMGMLPPCVA

SEQ ID NO: 135102 - protein, 211 aa, Glycine max
  Coding DNA Sequence Number=SeqID_43417
  Homolog annotation: Hit_ID=Q6WAY6; Match level="QueryCoverage=88%, HitCoverage=32%, E-value=3e-20, Identity=33%"; Hit description =Putative uncharacterized protein
MMGTNQNGKRLYQVKIKSLDVTSLKELGRLMEPLQRQAFRKVYGKILDLTAVQVFTEAVVSLAQYYDQPLRCFTFGDFQMVPTVEEFEEILGCPLRVRKLYLFSGFLPSLSKIAAVVGDSAKELDRMKQTQNGVVGLPRKYLEGKARDMASQEKWVPFVDILALLIFGVALFLNVDGLVDLAAIDAFLAYHHSKESPVVAILADLFDTFDR

SEQ ID NO: 135103 - protein, 29 aa, Glycine max
  Coding DNA Sequence Number=SeqID_43418
MAGDGLRPRVHPKEMGHATLPPLSLLFHA

SEQ ID NO: 135104 - protein, 51 aa, Glycine max
  Coding DNA Sequence Number=SeqID_43419
MNPKRIKVIPEWPAPPSVKGRSPEYQEPQDLRSNPFQGAGNDAILLRKGIG

SEQ ID NO: 135105 - protein, 85 aa, Glycine max
  Coding DNA Sequence Number=SeqID_43420
MESPSVTTYPFAGEQREGSRVRLPKGGKCPESPPTFICGKRRKNRRKPVMKNIPDSGVVFTVEEGRQKRDSCSYVPSIEEEIRHT

SEQ ID NO: 135106 - protein, 190 aa, Glycine max
  Coding DNA Sequence Number=SeqID_43421
  Pfam annotation: Domain name=G-patch; Domain location=2-41; Score =22.0; E_value=0.00042; Accession=PF01585.14; Description=G-patch domain
MARVMLGNGYEPGMGLGKDNGGITSLINAKGNCGKYGLGYKPTQADMKRSIVGRKSGGQSSRWRQESEGSPPCHISRSFISAGLGDKGQVVAICEDDVPSTLDLVRPCPPDFQLENWRVEERPGIYATSIIFDDESPEGTNTWDPSINFEQEMNQTEDEGNEEVGTSFRTRKEWSPMRTKKWGLIKKRQS

SEQ ID NO: 135107 - protein, 117 aa, Glycine max
  Coding DNA Sequence Number=SeqID_43422
MTGRLIAGSLAFESRILHYLIVRILLPRSSNLAQALRLNAPLPYPHLVTLFLQHFNIPLDSEPYVPIKRSFLIGAFVIASFGYQKEHDGSWVKKGARHVGEEGHDGEDSSLLSKILD

SEQ ID NO: 135108 - protein, 144 aa, Glycine max
  Coding DNA Sequence Number=SeqID_43423
  Homolog annotation: Hit_ID=Q6WAY4; Match level="QueryCoverage=84%, HitCoverage=25%, E-value=7e-09, Identity=29%"; Hit description =Putative uncharacterized protein
MGSSQMPSLKKRFYQVKVKSLGTTSLKELGQLMGQLQRQAFRKDYGKIWDLAMLIRCFTFEDFQLVPTVKEFEEILGCPLGGRKPYLFSGFYPSTTRVAKVVKISAQELDRVKQNRNGVVGVPRKCLEERAKALANQGEWAFFY

SEQ ID NO: 135109 - protein, 167 aa, Glycine max
  Coding DNA Sequence Number=SeqID_43424
MAQPPPRERTLREMAAPDFTYESLFHVLCQGRLPHKHLKEFHIVAPIHETSQCQEDHIFGVEKKLFLMSVAQAWLYYLAPKGPSELISVKKFFIFQVLKNFPCFQTTTIKKDISEAILYDLQPFDPEIDRTFHRLVRHHFIPFDHPEHSITGESVHSVIGDFEHPDF

SEQ ID NO: 135110 - protein, 28 aa, Glycine max
  Coding DNA Sequence Number=SeqID_43425
KGIHDEEDPRPTSSKGAYITIGPPSPSK

SEQ ID NO: 135111 - protein, 237 aa, Glycine max
  Coding DNA Sequence Number=SeqID_43426
  Subcellular localization annotation: CTP_CleavageSite=64; ConfidenceScore=5.14e-01
MFAHSIKGCRPLGRTCGVLIPSPCVNTTPEPFHLKVRRSRLFRFFRRFPQINVGGDSASIPFVEHASRESRVALPLKGRLRQVATNPFASSETKKLEGKLDALINLVTQLALNQKSVPVARVCGLGSSADHHTDLCPSMQQPGAIEQPEAYAANIYNRPPQPQQQNQPQQSNYDLSSNRYNPGWRNHPNLRWPSPQQQQQQPAPSFQNAAGPSRPYIPPPIQQQQQPQKQPTVEAPP

SEQ ID NO: 135112 - protein, 52 aa, Glycine max
  Coding DNA Sequence Number=SeqID_43427
MCGLRTLSVKGSGVVFTHGEGEKLAFFYLFVVDKGVSLAPTYPHCDEEIRPT

SEQ ID NO: 135113 - protein, 90 aa, Glycine max
  Coding DNA Sequence Number=SeqID_43428
  Homolog annotation: Hit_ID=A5BFN6; Match level="QueryCoverage=67%, HitCoverage=11%, E-value=6e-07, Identity=37%"; Hit description =Putative uncharacterized protein
DSRGSPSKFYKEKTKKFHDSLIAKKAFVVGQKVLLHNSRLGLMSVEIKSESTDKGFKVNGHQLIPFLTNPSLVDVVVEETSLLHSTSLPP

SEQ ID NO: 135114 - protein, 127 aa, Glycine max
  Coding DNA Sequence Number=SeqID_43429
MTGRDQIWSFCTLVSSRGGGPNDTRRYLTVIRTLLSSRGGGPDDKQRPSLAAGPMIRGDTLRYPHPFVIQRRAGPMTAETKFGHSAPLVSSRGGGPDDTRKYPSGYPYKHSFAICKTERLIALQRLT

SEQ ID NO: 135115 - protein, 139 aa, Glycine max
  Coding DNA Sequence Number=SeqID_43430
GILKEDFQAFSRVLIINKDNGGRSLVTMSNHKSTESALKNLEIQVGQLAKQIADKLSNSFAANTEKNPKAEFKDVMTRSKRFMEAEEEESIVHKEKTAEKKGTDGKKNEKSLWERPIQQGPNIFQRTTKLEETLTQFMQ

SEQ ID NO: 135116 - protein, 162 aa, Glycine max
  Coding DNA Sequence Number=SeqID_43431
MDELMNPAVVYPKMIHPKSFSGYQQGGNFNQNQGQGWRSHQGNQFNKDQGGPSNRPPNQGPNLYERTTKLEETLSQFIQVSMSNYKSTESAIKNLEIQVGQLAKQITKSSSGGFGANTEKNPKEECKAVMTRSKREIVVENESRISEEKELGAEGEREKEGD

SEQ ID NO: 135117 - protein, 85 aa, Glycine max
  Coding DNA Sequence Number=SeqID_43432
MACNKSGSRTNPFKEGGNDRGATSPSNDPFHSIGVPMIKSKTKRMKQTLQGLILKIKEKEDQCELRVAPNWVALQQIDEDALWPT

SEQ ID NO: 135118 - protein, 271 aa, Glycine max
  Coding DNA Sequence Number=SeqID_43433
MVRSPLARAHGICRCPVFRGLWCWGAVPKRPSWFRCCGAWGGGSAWPNGERAGPQPGSARMRIFRPARPRLLHGDPCDAALARGPVQAADTGSAPPPVPETSITGRPEHRRPRARGDFAQHRRAAAAMAKRARQHPARPAQAASDPAGRDPGTSRGAVGLGVRASAGPGRGGRERTGRDIQHCRAGGHSGNQPPLGTRPGEQPAGCRRALAAHGDRGDGFVACDRPQSSAPAGAAFGCPRLGMVRWHPSWRRAWHSCSSAARMVQSSGCKR

SEQ ID NO: 135119 - protein, 148 aa, Glycine max; identical to SEQ ID NO: 127601
  Coding DNA Sequence Number=SeqID_43434

SEQ ID NO: 135120 - protein, 55 aa, Glycine max
  Coding DNA Sequence Number=SeqID_43435
MFLSVGGPPSTVEGKGKLDLIEERLRAIEGFGDYSFVDMTDLCLVLDVVIPLKFK

SEQ ID NO: 135121 - protein, 68 aa, Glycine max
  Coding DNA Sequence Number=SeqID_43436
  Subcellular localization annotation: CTP_CleavageSite=38; ConfidenceScore=5.12e-01
KWPQGSLPQRDPGKTRRLKEPVPLPNMTTIILGALSTSSASRPSKDGHSFRRDVSSSGTTSILTSRKR

SEQ ID NO: 135122 - protein, 104 aa, Glycine max
  Coding DNA Sequence Number=SeqID_43437
MDRARKTLVGPEEVQQGLGVSSSGYMPLLVLQGARSPQQGIAPVRHPVDLKKSNRVLGFPILITGLCQFHRVPTAPSKVIRPPTNRTFIKKYYAPRQTQGKTPQ

SEQ ID NO: 135123 - protein, 152 aa, Glycine max
  Coding DNA Sequence Number=SeqID_43438
MQDKRDEEEKLEEQKKKKDSKALSSKAKGKEKEEKDSSKKIVKKENHLAIKGDVKRALLLKQSFYLLLSRETSLNTAITLDVIPQVMELLDEGLVRKSLTLCALLVPKIDIMWHRIPMIGGMMNVLSGATLFRKITHASNIFMIHLHRDSLG

SEQ ID NO: 135124 - protein, 73 aa, Glycine max
  Coding DNA Sequence Number=SeqID_43439
MTLPTVARRAIGAGLCAIPSGAKGRMCATGDYYVGNFPEHELTSPHLTGRSLQRAAAKPFFHRLRPPDKHHEI

SEQ ID NO: 135125 - protein, 298 aa, Glycine max
  Coding DNA Sequence Number=SeqID_43440
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFLCLNDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRYQAFPPGGSLVRSPVPAFRFT

SEQ ID NO: 135126 - protein, 173 aa, Glycine max
  Coding DNA Sequence Number=SeqID_43441
  Subcellular localization annotation: CTP_CleavageSite=52; ConfidenceScore=5.34e-01
CYLAHSAQRPYCQSPPAKVSVGIAPTKTPSGPEKVQQGPGVSSSGYGPLSVLQGARTPPARSRHHRDRACKTPSGPEEVQQGLGVFYGVPVTSSKGIRPPTNRAFIKKYCAPRQAQGETPQQPGDGRQRATDAPPSPLEFTSAHPRKGLSIAYTTWPTNRRPSPKPKDAPSCS

SEQ ID NO: 135127 - protein, 329 aa, Glycine max
  Coding DNA Sequence Number=SeqID_43442
  Homolog annotation: Hit_ID=Q652R5; Match level="QueryCoverage=27%, HitCoverage=36%, E-value=2e-16, Identity=53%"; Hit description =Putative uncharacterized protein P0603C10.50
  Subcellular localization annotation: CTP_CleavageSite=6; ConfidenceScore=5.30e-01
SPTAPRGATGSRARTEALTLSGAPSRGLGPGPPLRTLLQTTIRTPRATDFHGGLFPGRRWVQNSTGLAIREGNFERVNHLLHGDSLRHTQIQTNDLHVSIAAGLHQSFLWLRPAAATLVHHLSEYPAGMLLKLATRSKTQRFTGRRCNSTGGSHQYRIPCALRVYSMQERAVDSQSMSVLLGPCLDRDTESPGGVALNRFEPTPEAPGFVFVARHAGRALPPNPMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPR

SEQ ID NO: 135128 - protein, 214 aa, Glycine max
  Coding DNA Sequence Number=SeqID_43443
FPTSNIQSCGFGMTDPLDESISCFLIRVNPWGYPPSPWVLVTLTVRGLHVLTLTGLHVLTIRGLPALTSRGLHVLALRGLHALTFRGLHVLALRGLHVLTIRGLHALTSRGLHVLALRGLHALALGTSYPHRQRTTRPRLERTTRPHHQRAARPHLQRTTCPRFERAARPHLQRTTRPRLERTTRPHHQRAARPHLQRTTRPRLERATRPSLGY

SEQ ID NO: 135129 - protein, 137 aa, Glycine max
  Coding DNA Sequence Number=SeqID_43444
MVKVGTSYVPINVSFSGPKVEPRDYIAHGVHVSISCPPVQLLRELVRNSQKHTSRTSALASVAGSTLSGVPSERASCAEKKGAPVPAEYVNTTHYRGISSTAVGGRSRTDPPRSEFDAAKWTNGAEVSWKTRKNLTG

SEQ ID NO: 135130 - protein, 322 aa, Glycine max
  Coding DNA Sequence Number=SeqID_43445
  Homolog annotation: Hit_ID=Q6WAY6; Match level="QueryCoverage=38%, HitCoverage=21%, E-value=2e-14, Identity=37%"; Hit description =Putative uncharacterized protein
ANWDQLLASKEGASVNWFPRWKEGRTRVLISCGGFPNVPLMGTRGCISYNLVLATRQLGYPMRGAPLEDELTPVISRGFNKTNMETLQKVRKAWEVVKKKDKELRGNNNGPIGGYHEWLKAHVQGLDWLPSLRTAKREEDEAPEEDEEVQALRTELKQAQTVKERFKSEALKIRKENAELRVINIATTKALEQETKRGHREEHGQNKFRGALWGSNNELKLRREERDQSRTNMLVIISKYQEELSLATTHEHRVADEYAQVYAEKETRGRVIDSLHQEATMWMDRFALTLNGSQELPRLLAKAKAMAETYSAPEEIHGLLSY

SEQ ID NO: 135131 - protein, 104 aa, Glycine max
  Coding DNA Sequence Number=SeqID_43446
  Homolog annotation: Hit_ID=A5AEB7; Match level="QueryCoverage=94%, HitCoverage=7%, E-value=8e-31, Identity=67%"; Hit description =Putative uncharacterized protein
MDIDYASRKDESPAITNESSPSNVALYERWERSNWLSVMFIKIKISAWIRGSVNQHEKVRDLLKVIDDQFITSDKTLASTLIMKFSSLQLTSVKGRRKACNEDG

SEQ ID NO: 135132 - protein, 53 aa, Glycine max
  Coding DNA Sequence Number=SeqID_43447
AKQLLKGIINSSLKGLDDTPQPKPKASARWIVVKYFNDVRQLEADRLKALRIQ

SEQ ID NO: 135133 - protein, 311 aa, Glycine max
  Coding DNA Sequence Number=SeqID_43448
  Homolog annotation: Hit_ID=Q949K7; Match level="QueryCoverage=9%, HitCoverage=35%, E-value=6e-07, Identity=74%"; Hit description =Putative gag polyprotein
DQPWVHGMILKEELAACARSKRSLAQHLEATEQSMLAIIGQYKEELNQSVTHEQKLVEDFAQVYAEKEARGRVIDALHQEATMWMDREFTITKKAQRHPYNTRSRKMDNEEGVQEQMKADLSALKDQMASITEAMLKLQKTIEDNAMATASNAVREAEPVLQPAINLGRDRNTTVFGRSAAPKVLSQAPTFEGQLPPYADYPLQEDDEGDAHLGPLLPFKDPAPHELPQPNIVRHVPSSPAPVKESLPFAEDKGKIDSLEERLRAVEGLDNYPFSDLADLCLVPDIVIPPKFKVLDFDKYKGMTCPKGHLR

SEQ ID NO: 135134 - protein, 176 aa, Glycine max
  Coding DNA Sequence Number=SeqID_43449
  Gene Ontology: Mol. function=motor activity; Cellular component=cell projection
  Homolog annotation: Hit_ID=UPI00016621D1; Match level="QueryCoverage =97%, HitCoverage=40%, E-value=3e-20, Identity=37%"; Hit description =UPI00016621D1 related cluster
ELYALAFVGLHALTFRGLHVLPFRGLHVLTFIGLHTLTFRGLHVLVFRGLHVLPFRGLHALTFRGLRVLPFRGLHVLAIRGLHTLAFVGLHTLTFRGLHALTFRGLHALTFRGLQVLAFRGLHVLAFRGLHVLPFRGLHVLTFVGLHALTFRGLRVLSFRGLHVLTIRGLHVLAFR

SEQ ID NO: 135135 - protein, 86 aa, Glycine max
  Coding DNA Sequence Number=SeqID_43450
MKVIFRFQDVTEVVLEGCVDADNFQKIRSANTAKKAWDILKKSYAGDSKLKKVLRTLTPRFDHIEVAIEQGQNLEEMKIEELQGIL

SEQ ID NO: 135136 - protein, 235 aa, Glycine max
  Coding DNA Sequence Number=SeqID_43451
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLVTAIASVNAIAVPESDHVLQARIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135137 - protein, 130 aa, Glycine max
  Coding DNA Sequence Number=SeqID_43452
MAPTRHPLDPDKSNRALGFPALITGLCQSFGVPVTPSKIIRPPITRAFIEKYCTQRQMSLSLQSQGFTSFPCPTPDQFRAEVAWPGDWPEAQAAEAPAGAPAEAPDEADEAHEDEEMTDLLDFLGGSGAA

SEQ ID NO: 135138 - protein, 318 aa, Glycine max
  Coding DNA Sequence Number=SeqID_43453
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQLRQRLLQQLGYPQSEHDFQQLVLLQRQLGLQFQRAMQPVPSVQLMMTKICDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135139 - protein, 180 aa, Glycine max
  Coding DNA Sequence Number=SeqID_43454
  Gene Ontology: Mol. function=aspartic-type endopeptidase activity; Biological process=proteolysis
  Homolog annotation: Hit_ID=A5B3J2; Match level="QueryCoverage=64%, HitCoverage=27%, E-value=1e-12, Identity=37%"; Hit description =Putative uncharacterized protein
MHRSPTGNLVPLDLEIEATLRRNKVKRRRKLLQDRTVASILEEETHFFYSLSPNSPSSRESATQLPKTASMADEQHHKITLEDYSSSSVPQFFTSIARLEVQAHNINYSYSLIHLIQGNLFQGLPNEDPYAQLAMFIEICNTVKIAGVLDEVIRLSLFSLSLAGEAKRWLHSFKGNSLKT

SEQ ID NO: 135140 - protein, 284 aa, Glycine max
  Coding DNA Sequence Number=SeqID_43455
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSSDPPASASQIVGTTGVHYHTHQAYRYRRPRGGARYQLLFPLVRVNFELGVIMVIAVSFGKPVVAAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135141 - protein, 15 aa, Glycine max
  Coding DNA Sequence Number=SeqID_43456
MTEPVMPHPAFITYR

SEQ ID NO: 135142 - protein, 231 aa, Glycine max
  Coding DNA Sequence Number=SeqID_43457
MKNIPVCTNKLGRVRKECNRLRDINMSTTEALEREMRKAKGEETNRKRYQGALSGNSNKLKLRSAERDQAITENVALRDELKDYWVSKESLKEKLGMMEKNMLVIVDQYEVKMTRERQDLATLHGQALRSKEGSDRTTTSGKQEVDEWVDYKPTNTDEDMTKSKGKDPLEGLGGPMTRARARKAKEALQQVLSILFEYKPKFQGEKSKGPIGNLGISLLGDQMVADLLAVG

SEQ ID NO: 135143 - protein, 82 aa, Glycine max
  Coding DNA Sequence Number=SeqID_43458
MEQFTKMDESFEATIPEPFVIGEEAKETQPTADPSTPLLEMQEDPTTSVLAMGTSPPATLVFHLIDEEDVQTQDTQDQSQEF

SEQ ID NO: 135144 - protein, 116 aa, Glycine max
  Coding DNA Sequence Number=SeqID_43459
MVITVRPERVVRQFGYIQSIPPPPISARLSHDQIDDKWMQFVDHLLHAGQLCLMPGQDDYEGYEAIAQRLERVLNLRIVTAGTKLYDIMQDCLTIARGGPSADGTVRARQRRRTDH

SEQ ID NO: 135145 - protein, 128 aa, Glycine max
  Coding DNA Sequence Number=SeqID_43460
  Homolog annotation: Hit_ID=Q2AA50; Match level="QueryCoverage=94%, HitCoverage=7%, E-value=8e-07, Identity=31%"; Hit description =Retrotransposon gag protein
  Subcellular localization annotation: CTP_CleavageSite=69; ConfidenceScore=5.04e-01
MTMQNMEFQQETRASIQSLTNQMGQLATQLNQHQSHNSDRLPSQSVQNPKNVSAITLRSGKQCQGPQPVASSSSANELAKPHSTPEKDDDKNLKKKQHIPLPFPPRAISNKNMEEAEKEILETFRKVE

SEQ ID NO: 135146 - protein, 140 aa, Glycine max
  Coding DNA Sequence Number=SeqID_43461
  Homolog annotation: Hit_ID=Q3E8P2; Match level="QueryCoverage=92%, HitCoverage=34%, E-value=2e-08, Identity=24%"; Hit description =Uncharacterized protein At5g35250.1
MARIADKIKTIDGSKETLKLVVRITELWFIGTSGRSEQAEMVIVDSDGDQIHVVCKQDQLKAWKMDLKEDIIGVVDEVVFRHISPRSKRVVFKLMNLSNQLLSCTLWDDYYVQFLEYLDHHESEGPIIVLLTNARIKEGQ

SEQ ID NO: 135147 - protein, 320 aa, Glycine max
  Coding DNA Sequence Number=SeqID_43462
  Gene Ontology: Mol. function=RNA-directed DNA polymerase activity; Biological process=regulation of transcription, DNA-dependent
  Homolog annotation: Hit_ID=A5BT29; Match level="QueryCoverage=98%, HitCoverage=38%, E-value=3e-32, Identity=27%"; Hit description =Putative uncharacterized protein
MFSDNFSIDKETLRKDFYSPANEPQRRWFFQNYKGTNRKQVQDKFYEFFERVKVNVLFFDWFHAYNIKKDIDYPWKQDIIGDPSTNVITNWQVRDGEMIQSELPPTTKYQLPNIKDSNNKLVMATPFKTKDINEEVTSDDIKSLMEQANYTNKYLQILGETIKTKVVPKQKSVEEALVEGVGDNHSELPNKIGSLLKVILETPQTSENTSKMVTRSTSKLINVINEDSDQNLDNTTEIRSVSEKNINSINSKHWKTPSKLYYQRPTAPDLLLEERGENNFKSFSANNIYEWNIDAQTEYNIMNTLQHMTMVATAYQTSHE

SEQ ID NO: 135148 - protein, 30 aa, Glycine max
  Coding DNA Sequence Number=SeqID_43463
MPLSAAADSLAVLSIKNTKLHALTNFTASG

SEQ ID NO: 135149 - protein, 16 aa, Glycine max
  Coding DNA Sequence Number=SeqID_43464
DFGSRLVEWLGMIHVR

SEQ ID NO: 135150 - protein, 238 aa, Glycine max
  Coding DNA Sequence Number=SeqID_43465
  Gene Ontology: Mol. function=motor activity; Cellular component=cell projection
  Homolog annotation: Hit_ID=UPI00016621D1; Match level="QueryCoverage =94%, HitCoverage=40%, E-value=3e-14, Identity=30%"; Hit description =UPI00016621D1 related cluster
VDPWVLVPIFFRGLHVHAIRGLHALAFRGSHTLAFIGLHALTFRGLHALAFRGLYVLTFRGMHTLAFRGLYVLTFRGLHILACRGLHVLAIRGLHVLTFKGLHALTLRGLHVLTFIGLHALTFRGLHRTLPHLQRTTRPRQFRGLHVLAFRWLHVLAFRGLHSLAFRGLHVLVFRGLHVLIFRGLHVLIFRGLHVLAFKGLHVPTFRGLHVFAFRGLRALAFSGIHIRTLREFKVLYP

SEQ ID NO: 135151 - protein, 107 aa, Glycine max
  Coding DNA Sequence Number=SeqID_43466
MCLIRLRLLVLNEYRSGVIEIFIESVCHIGWCIVGRPDRSIGFTLATALVAATITALTYIIFFMLIMASIIVAICSFMASMSAFIFSCTSSASPHYSSSSTSSVRAP

SEQ ID NO: 135152 - protein, 78 aa, Glycine max
  Coding DNA Sequence Number=SeqID_43467
HVARNLREFAFKKTSDNERIQIHTEIDLGSVFLEIITKELFSNKEKRFMQEDDSPGNFHAKGDKIYQLRKRKLEIGSS

SEQ ID NO: 135153 - protein, 130 aa, Glycine max
  Coding DNA Sequence Number=SeqID_43468
  Homolog annotation: Hit_ID=A5BCC7; Match level="QueryCoverage=87%, HitCoverage=8%, E-value=6e-11, Identity=37%"; Hit description =Putative uncharacterized protein
MGHTGGTEESGDMTMDDRKGERDVGFDEQVVTLQNMDTQDTMLPSISPTKSLLGRGHRIKQPSTRLQDYVTNTTRRLSSSNCLPFPKADSGAPYPITNYDHFYLAHRAFLASISQEKESVTYTDVVKDSR

SEQ ID NO: 135154 - protein, 190 aa, Glycine max
  Coding DNA Sequence Number=SeqID_43469
GLALPPELEVGASAARVNTKGSCVDPSMTDPDGDSDKCGLYIKENPLRLVALGRVYEGSTMEHNIPLLLGQVKVGDEEVKDVEAPVPVPIDEVILVGQTLNTSLAWPTHLAKRLSDQVMWDDTVFEVFNEDFPLYIKHEDLSEIAHGGQNLNISVIQLWILHLTETSMRAGNADVYGFLEPQSIQRSGQS

SEQ ID NO: 135155 - protein, 187 aa, Glycine max
  Coding DNA Sequence Number=SeqID_43470
  Homolog annotation: Hit_ID=Q6UUU1; Match level="QueryCoverage=32%, HitCoverage=40%, E-value=2e-18, Identity=78%"; Hit description =Putative uncharacterized protein
MVKVGTSYVPIKGHQDLFILRSDLPSQWLLFLSAVPPVQLLTGWCVNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135156 - protein, 118 aa, Glycine max
  Coding DNA Sequence Number=SeqID_43471
MGDTTIQRVEKENPPPAFAEHNQINLSNKHNTATHRSELEEGARDQSKEWQCTMNDKKDNNLAKFVIRNPEKNTRKSEMSPKMGSFLNKQTRKSEHGCGWKQIGKVAFHLCLVLYLLQ

SEQ ID NO: 135157 - protein, 102 aa, Glycine max
  Coding DNA Sequence Number=SeqID_43472
MAMDGDRRRRPAATNGGRRWRTAVAATDGGDGDDDRIRQGSKGHNWPETVTNSPESGLRGLRMIKLRRTEVGDGQLSQLARKCREMPEKGGCLSQRPVDDTS

SEQ ID NO: 135158 - protein, 350 aa, Glycine max
  Coding DNA Sequence Number=SeqID_43473
  Homolog annotation: Hit_ID=A7Q1D7; Match level="QueryCoverage=51%, HitCoverage=26%, E-value=5e-37, Identity=48%"; Hit description =Chromosome chr10 scaffold_43, whole genome shotgun sequence
MVGIDVLVKHCGCIPRNRGTISSNTHTSIWWVLGYSDGRLGGSPWHGVFGIIEKGLFSQMTASKDVYFDDESAEVVISSLRLGDDHESGSLFTNSNWFAFEEGRDRVGNERSTGSLASPSPTADEVFVKASGDDVIAGEDEELADTATSPEAGLKLEHGGTDKPVEWVEWRESSDANDPSDVLPNGVLEIEPGSNNPGVAESSSPSSSVALTKDEQIATDEPSASLNDSSIETSDRNKDKTEPTQGVETPSTRASATSVDDPVTEVGGDRNKDTTDNKKAVDRPVTAVEGDSNKDTTNNKKTVDESVTVVGGDSNKDTTDNKKAVDGSATEVGGNSNKDTTDNKKEVEHE

SEQ ID NO: 135159 - protein, 398 aa, Glycine max
  Coding DNA Sequence Number=SeqID_43474
  Gene Ontology: Mol. function=oxidoreductase activity; Cellular component=extracellular region; Biological process=response to oxidative stress
  Homolog annotation: Hit_ID=Q40366; Match level="QueryCoverage=97%, HitCoverage=96%, E-value=1e-127, Identity=64%"; Hit description =Peroxidase precursor
  Pfam annotation: Domain name=peroxidase; Domain location=41-339; Score=465.4; E_value=7.7e-137; Accession=PF00141.14; Description =Peroxidase
MRFFTVKVALCCVVVMLLTLSDAQLDNSFYKDTCPRVHSIVREVVRNVSKSDPRILASLIRLHFHDCFVQGCDASILLNDTATIVSEQSAPPNNNSIRGLDVVNQIKTAVENACPGIVSCADILALAAEISSVLLSPDEKTFTPVQVPSQRITQFQENPTKHVPCDGDKILTYPDNIILIWAEAHGPDWKVPLGRRDSLNSSFSLALQNLPGFNFTLDQLKSTFDRQGLNTTDLVALSGAHTIGRSQCRFFAHRIYNFSGNGNSDPTLNTTLSQALRAICPNGGPGTNLTNLDLTTPDRFDSNYYSNLQLQNGLLRSDQVLFSTSGAETIAIVNSFGSNQTLFYEHFKVSMIKMSIIEVLTGSQGEIRKHCNFVNGDSSNLATLATKKSSEDGMVSSI

SEQ ID NO: 135160 - protein, 390 aa, Glycine max
  Coding DNA Sequence Number=SeqID_43475
  Gene Ontology: Mol. function=oxidoreductase activity; Cellular component=extracellular region; Biological process=response to oxidative stress
  Homolog annotation: Hit_ID=O24081; Match level="QueryCoverage=99%, HitCoverage=95%, E-value=1e-129, Identity=71%"; Hit description =Peroxidase1A precursor
  Pfam annotation: Domain name=peroxidase; Domain location=82-331; Score=463.5; E_value=2.7e-136; Accession=PF00141.14; Description =Peroxidase
MANIGVLTGSDGEIRTQCNFVNGNSSALTTKESSQDGMVRWAKVMLENAGIKGVLGALPHFSFAQLDPSFYDSTCSNVSSIVREVLSNVSQSDPRILASLIRLHFHDCFVQGCDASILLNDTDTIVSEQSAAPNNNSIRGLDVVNQIKTAVENACPGTVSCADILALAAQISSDLASGPVWEVPLGRRDSLTANQTLANQNLPAPTFTIDQLINSFGNQSLNITDLVALSGAHTIGRAQCRFFVDRLYNFSNTGNPDPTLNTTLLQSLQGICPNGGPGTNLTNLDLTTPDTFDSNYYSNLQLQNGLLQSDQELLSANNTDIVAIVNNFIMNQTLFFENFKASMRKMGNIGVLTGSQGEIRSQCNSVNGNSSGLTTTATKESSQDSVVSSM

SEQ ID NO: 135161 - protein, 186 aa, Glycine max
  Coding DNA Sequence Number=SeqID_43476
  Gene Ontology: Mol. function=oxidoreductase activity; Cellular component=extracellular region; Biological process=response to oxidative stress
  Homolog annotation: Hit_ID=Q18PQ8; Match level="QueryCoverage=90%, HitCoverage=47%, E-value=1e-55, Identity=64%"; Hit description =Peroxidase
  Pfam annotation: Domain name=peroxidase; Domain location=42-186; Score=133.0; E_value=8.6e-37; Accession=PF00141.14; Description =Peroxidase
MNSLRLTLCCVVVVLGALPYFSYAQLDPSFYDSTCSNLSSIVREVLTNASLSDPRMPASLIRLHFHGCFVQGCDASILLNQTDEIDSEQTAFPNDNSIRGLDVVNKIKTRLENACPGIVSCADTLALAAEVSSELACGPVWEVPLRRRDGFSANQTLANENLPAPSLCIDQLISAFANQGLNITLI

SEQ ID NO: 135162 - protein, 512 aa, Glycine max
  Coding DNA Sequence Number=SeqID_43477
  Gene Ontology: Mol. function=oxidoreductase activity; Cellular component=extracellular region; Biological process=response to oxidative stress
  Homolog annotation: Hit_ID=O22443; Match level="QueryCoverage=34%, HitCoverage=50%, E-value=3e-70, Identity=77%"; Hit description=Seed coat peroxidase precursor
  Pfam annotation: Domain name=YTH; Domain location=1-56; Score=17.1; E_ value=4.7e-06; Accession=PF04146.6; Description=YT521-B-like family
  Pfam annotation: Domain name=peroxidase; Domain location=28-481; Score=156.4; E_value=7.5e-44; Accession=PF00141.14; Description =Peroxidase
  Pfam module annotation: Pfam domain module=YTH::peroxidase; Domain location=1-56::28-481
MTSRIGGSVAGGNWKYAHGTAHYGRNFSVKWLKISRDCQELEPSIGEQLASLLYLEPDSELMAISVAAESKREEEKAKGVNPDNGGENPDIVPFEDNEEEEEEESDEEEESFSHGVGPAGQGRGRGRGMMWPPHMPLGRGARPMPGMQGFNPVMMGDGLSYGPVGPVGPDGFGMPDLFGVGPRGFAPYGPRFSGDFGGPPAAMMFRGRPSQPGMFPSGGFGMMMNPGRGPFMGGMGVGGANPPRGGRPVNMPPMFPPPPPLPQNANRAAKRDQRTADRNDRFGSGSEQGKSQDMLSQSGGPDDDAQYQQGYKGNQDDHPAVNNFRNDDSESEDEAPRRDSLTANRTLANQNLPAPFFTLDKLKAAFAVQGLNTLDLVTLSGGHTFGRARCSTFINRLYNFNNTGNPGPTLNTTYLELLRARCPQNATENNLTSLDLTTPDQFDNRYYSNLQQLNGLLQSDQELFSTPGADTIPIVNSFISNQNTFFANFRVSMIKMGNIGVLTGDEGEIRSQ

SEQ ID NO: 135163 - protein, 290 aa, Glycine max
  Coding DNA Sequence Number=SeqID_43478
  Gene Ontology: Mol. function=glycolipid transporter activity; Cellular component=cytoplasm; Biological process=glycolipid transport
  Homolog annotation: Hit_ID=A7Q1D3; Match level="QueryCoverage=77%, HitCoverage=99%, E-value=9e-71, Identity=60%"; Hit description =Chromosome chr10 scaffold_43, whole genome shotgun sequence
  Pfam annotation: Domain name=GLTP; Domain location=90-288; Score =208.9; E_value=1.2e-59; Accession=PF08718.2; Description=Glycolipid transfer protein (GLTP)
CGVSNDDSKNTNDDYINNDDKDNDSDGIDSVGGGDDRDNIGGSYSNNISDIDHGDDSDNSDNNKIEGNGDKTLRKIADAFNDLANVFTDSQSAEAEVKVAPFSHACSLVSPLFGCLGVAFKFAEMDYVAKVHDLAEASKSIQNLQSLIELDVQANTVRKGGSHTRNLLRVKRGLDMVRVLFEQILVTEGNSLRDPASKAYEQVFAPHHGWAIRKAVSAGMYALPTKEQLLKKLNEDGWQTGREMIYVKPIYDECGMASAKDHMQSYVTASAPLIQYIDKLFVSRDLGIDW

SEQ ID NO: 135164 - protein, 603 aa, Glycine max
  Coding DNA Sequence Number=SeqID_43479
  Gene Ontology: Mol. function=protein binding; Biological process =plant-type hypersensitive response
  Homolog annotation: Hit_ID=Q1HIU5; Match level="QueryCoverage=91%, HitCoverage=82%, E-value=0.0, Identity=74%"; Hit description=Ankyrin repeat BTB/POZ domain-containing protein
  Pfam annotation: Domain name=Ank; Domain location=309-342; Score =19.1; E_value=0.017; Accession=PF00023.21; Description=Ankyrin repeat
  Pfam annotation: Domain name=Ank; Domain location=343-375; Score =23.6; E_value=0.00076; Accession=PF00023.21; Description=Ankyrin repeat
  Pfam annotation: Domain name=BTB; Domain location=56-171; Score=23.5; E_value=2.5e-05; Accession=PF00651.22; Description=BTBPOZ domain
  Pfam module annotation: Pfam domain module=Ank::Ank::BTB; Domain location=309-342::343-375::56-171
  Subcellular localization annotation: CTP_CleavageSite=29; ConfidenceScore=5.34e-01
MAYSAEPSSSLSFTSSSHLSNGSVSHNICSSYGSDPGPNLEALSLSKLSSNFEQLLIETDCDYSDADIVVEGISVSVHRCILASRSKFFHELFKREKGSSEKEGKLKYNMSDLLPYGKVGYEAFLIFLGYVYTGKLKPSPMEVSTCVDSVCAHDACRPAINFAVELMYASYIFQIPEFVSLFQYMNFTCANAWELHLIRLKDQGKALVEDVIPILTVAFHCQLSQLVNQCIDRVARSDLDQISIDQELPNELSQKVKLLRRNPQRDVENDASIVDALSLKRITRIHKALDSDDVELVKLLLNESDITLDEANALHYAAAYCDPKVVSEVLGLGLANVNLRNSRGYTVLHIAAMRKEPSIIVSLLTKGACASDLTFDGQSAVSICRRLTRPKDYHAKTEQGKETNKDRICIDVLEREMWRNPLAGDACMSSHTMADDLHMKLLYLENRVAFARLFFPSEAKLAMDIAHAETTSEFAGLSASNSKGSNGNLREVDLNETPIVQSKRLFSRMEALMKTVEMGRRYFPHCSEVLDKFMEDDLPDLFYLEKGTNEEQRIKRTRFMELKDDVHKAFNMDKAEFSRSGISSSSSSSSLRDSVVHYKARKV

SEQ ID NO: 135165 - protein, 268 aa, Glycine max
  Coding DNA Sequence Number=SeqID_43480
  Gene Ontology: Mol. function=protein binding; Cellular component =cytoskeleton; Biological process=microtubule cytoskeleton organization and biogenesis
  Homolog annotation: Hit_ID=A5BW58; Match level="QueryCoverage=80%, HitCoverage=37%, E-value=3e-70, Identity=59%"; Hit description =Putative uncharacterized protein
  Pfam annotation: Domain name=CAP_GLY; Domain location=44-110; Score =94.6; E_value=3.1e-25; Accession=PF01302.16; Description=CAP-Gly domain
  Pfam annotation: Domain name=LRR_1; Domain location=166-189; Score =6.9; E_value=16; Accession=PF00560.24; Description=Leucine Rich Repeat
  Pfam annotation: Domain name=LRR_1; Domain location=192-216; Score =4.1; E_value=53; Accession=PF00560.24; Description=Leucine Rich Repeat
  Pfam annotation: Domain name=LRR_1; Domain location=218-242; Score =5.5; E_value=29; Accession=PF00560.24; Description=Leucine Rich Repeat
  Pfam module annotation: Pfam domain module=CAP_GLY::LRR_1::LRR_1::LRR_ 1; Domain location=44-110::166-189::192-216::218-242
MIKFLYNRPPPYESFFKGILRMSDELAWSGCGARLCHRIVVPLRALHASGDSRRIGTVKYVGPVEGYSDTWVGVDWDNGEGKHDGSINGVQYFHAKSERSGSFVRAHNLNQGISLLEALESRYKSESTKDEDEEDDMYVLSTSNQRVSVQLLGKDKVYDKLSRFEKLTSVSLSYMGISSPGIPSHINNTVPNIKELDLTGNLLLEWKDVGTICEQLPALRTINLSNNLMSPYKSELPLLKNIKVVVLNNTGVDWEQVPSIFCRLVFLA

SEQ ID NO: 135166 - protein, 85 aa, Glycine max
  Coding DNA Sequence Number=SeqID_43481
MGCNSGNNDDNDNGGGEMVYGGNICDNDDGDDKMMTMAMMVEAAKARCDGGGRMTKAIMENGDNNDSNNSGGGCGGMMTGKMVVE

SEQ ID NO: 135167 - protein, 183 aa, Glycine max
  Coding DNA Sequence Number=SeqID_43482
  Gene Ontology: Mol. function=hydrolase activity, acting on glycosyl bonds; Cellular component=extracellular region; Biological process =cell wall organization and biogenesis
  Homolog annotation: Hit_ID=A0MET3; Match level="QueryCoverage=73%, HitCoverage=34%, E-value=2e-35, Identity=52%"; Hit description =Putative uncharacterized protein
  Subcellular localization annotation: CTP_CleavageSite=34; ConfidenceScore=5.36e-01
MPNPTTTTKKPSPLSLLALHTLHFLVLCTWFSTSSAKATSYNVVDFGAKPDGATDATAAFLSAWNKACSSNKPAGIHVPQGRFLIARAVTFHGQCANRAISITIRGTLVAPSQYTFVGNSLYWLTFDQVSGVSIHGGVLDARGSFLWDCKYKATPNCPIGAADLDAVNGLWKIWGIKRLFNEY

SEQ ID NO: 135168 - protein, 511 aa, Glycine max
  Coding DNA Sequence Number=SeqID_43483
  Homolog annotation: Hit_ID=A7NXK0; Match level="QueryCoverage=45%, HitCoverage=96%, E-value=1e-52, Identity=50%"; Hit description =Chromosome chr5 scaffold_2, whole genome shotgun sequence
  Pfam annotation: Domain name=Sec20; Domain location=384-454; Score =79.1; E_value=1.4e-20; Accession=PF03908.4; Description=Sec20
  Subcellular localization annotation: CTP_CleavageSite=43; ConfidenceScore=5.01e-01
MAAKLENCTAELALRSGCRSGPKHVAGRTATTSTPSNAHAALSASVFATGYHFPLPLQYSTSVHDASSAARPAGHPGFGTIAEIEEVSTTRRTPTRLAAGAGGGHVEDAGAGGDGAGEGGGVEEVGGEEGEAAGGGGVEVEEVGGVGAGEDGGVDGVAWVLLLQEGSDQPRTDETVGAAIGNGNGFSIKRIDPYATVDEEDAASQLSSQATIYYFVCIVDGQGSTTFVVAGQGLATFTVTGNSFCGLHLAFADLSSTQSALSSSSIEAVHANSGLGLREAEKVKKEWDETYKKTQEHIEAIAEYGKPGRAKEEKNSLARLNGIAQDGLALLSSFLFTLDLLAPQLPSEPENYFWVAEKSPQFADAIYSMTFMSHLAGTKAGMTSAAESITESLRRTRQLMVQAESEYKGHRSLLMRTRNLLSTMQRQDVIDRVIIGVGFLLFSLAVLYVVYKRIGLLTLQRKVTEAIKAGMVGQAELRPQAVADDLNLHQVRGDCVHNAEAPLEQRIHDEL

SEQ ID NO: 135169 - protein, 553 aa, Glycine max
  Coding DNA Sequence Number=SeqID_43484
  Gene Ontology: Mol. function=nucleic acid binding; Cellular component= cytoplasm; Biological process=stem cell maintenance
  Homolog annotation: Hit_ID=A7Q7N3; Match level="QueryCoverage=69%, HitCoverage=43%, E-value=1e-118, Identity=58%"; Hit description =Chromosome undetermined scaffold_60, whole genome shotgun sequence
  Pfam annotation: Domain name=DUF1785; Domain location=340-393; Score =62.9; E_value=1.1e-15; Accession=PF08699.1; Description=Domain of unknown function (DUF1785)
  Pfam annotation: Domain name=PAZ; Domain location=394-532; Score =114.8; E_value=2.5e-31; Accession=PF02170.13; Description=PAZ domain
  Pfam module annotation: Pfam domain module=DUF1785::PAZ; Domain location=340-393::394-532
METGAGGGGKGQQGGKTGIGIPQKPPEEPNLRPEWRRPTRTEQDVVLQPEWRRPRPSAPLSEPSNRVVEEELLFQPEWRRSKPSASAIANANASVWEPERRRSRPTATAFPWNQNYGVRKGMASSSGGGGGVERRGDPNDLWRRPAPPATDSVVPKLEKLQISKQLPASTCTLEKKDKISPIQRPDNGGTLAILTSRLRVNHFPVKFDPESIIMHYSVGVKPKVSSKFGQPQKLSNSDLSMIREKLFSDDPERLPLEMTAHDGAKNIYSAVQLPEETFTVEISEGENEKAISYSVTLTLVNKLRLCKLMDYLSGHNLSIPRDILQGMDVVVKENPARRAVSVGRHFYPTNPPVIMKDLHHGIIAIGGFQHSLKPTSQGLSLCVDYSVLAFRKQMSVLDFLHERIDNFKLDEFEKFRKFIEEALIGLKVNVTHRKCNRKYIISRLTPMITRYVTFPIDNTGGWNSNDVSLITFFKEKYGKDIVYKDIPCLDLGKDRKKNYVPMEFCVLVEGQRYPKERLDGISANTLKAMSLAHPNERECAIQKMVQSSDGPCR

SEQ ID NO: 135170 - protein, 313 aa, Glycine max
  Coding DNA Sequence Number=SeqID_43485
  Gene Ontology: Mol. function=metal ion binding
  Homolog annotation: Hit_ID=A9PET8; Match level="QueryCoverage=100%, HitCoverage=100%, E-value=5e-81, Identity=53%"; Hit description =Putative uncharacterized protein
  Pfam annotation: Domain name=zf-C3HC4; Domain location=266-300; Score= 4.2; E_value=0.031; Accession=PF00097.16; Description=Zinc finger, C3HC4 type (RING finger)
MAVEASYMNLLPSQLLTNRETIKSNQQLQHQLNSDYMYNTTQMDSSSALPLPAATMPESLLSFYQSNFCDPNKADSGLTYHIPLQRKRSRDFTTELTSLPAHQKNKISSESSFLNQEILYQFQNQQSEIDRVLAHHTEKVRMELEEQRMRQSRMLVSAIQEAMVNKLKEKDEEIQRMEKLNWALQERVKSMCMENQIWRELAQTNEATANYLRSNLEQVLAHVGEERATAAEVADDAQSSCGSNDAADAGDDTAASTVATGRGRLCKNCGVRESVVLLLPCRHLCLCTMCGTTIRNCPICDSGMDASVHVNLS

SEQ ID NO: 135171 - protein, 312 aa, Glycine max
  Coding DNA Sequence Number=SeqID_43486
  Gene Ontology: Cellular component=integral to membrane
  Homolog annotation: Hit_ID=Q2HSS2; Match level="QueryCoverage=99%, HitCoverage=99%, E-value=1e-136, Identity=75%"; Hit description =F5O11.19, related
  Pfam annotation: Domain name=SNARE_assoc; Domain location=119-240; Score=117.6; E_value=3.8e-32; Accession=PF09335.2; Description=SNARE associated Golgi protein
MMTPESLEELEKHAISGHHVRGNSEYVRLAISDEPRAVETEMLQPLADSRMKSFMWWIKVFLWCFIIVILGLVILKWGVPFTFEKVLYPIMEWEATTFGRPVLALVLVASLALFPVFFIPSGPSMWLAGMIFGYGLGFVIIMIGTTIGMVLPYLIGLIFRDRIHQWLKRWPKNAAMIRLAGEGSWFHQFQVVALFRVSPFPYTIFNYAVVVTNMRFWPYLCGSIAGMVPEAFIYIYSGRLIRTLADAQYGKHQLTTVEIVYNIISFIVAVVTTIAFTVYAKRTLNELKIAEANQEAASVSGSGNLEMEKGSH

SEQ ID NO: 135172 - protein, 571 aa, Glycine max
  Coding DNA Sequence Number=SeqID_43487
  Homolog annotation: Hit_ID=Q9M1X6; Match level="QueryCoverage=58%, HitCoverage=53%, E-value=1e-31, Identity=33%"; Hit description =Putative uncharacterized protein F24G16.270
  Pfam annotation: Domain name=DUF566; Domain location=82-569; Score =74.6; E_value=3.2e-19; Accession=PF04484.3; Description=Family of unknown function (DUF566)
  Subcellular localization annotation: CTP_CleavageSite=32; ConfidenceScore=5.41e-01
MVQVQVQIMPEHNSDPAAPPPPPPPPHNRRPRVREVSSRFMSPSVPRRPRTTEPDPDENSETPFPLGCSISQRKQTQTPQQQRSMKLFKENNNNEHVPPHPHPSKSCSGRIGTPCVSRPGTPTPSVYVSSRYRQTQQHHHHHNNNHHHHRFVNGMASAAEKLMQASGLNQAKSSAACSSDNSGVNCSIQSLPELGEREMLLQSNLSAGEKIGSGNGGGGDLKFRHPSPLSRSVTLPSSGGENKPPASVSKQHGSGNQLAKSGGLSLPPVPPQCGKPAVDVRKGKKGSSHQEDVHSLRLLYNRYLQWRFANAKAHSVMKAQQTESQVVSSMIIVLWLNRTRGYYGGLFDHELEGFKLCPLLPCGCCDWMRLDAAIAMAAIKKALYSQAMRISEMRDSVNKKRIELELLRRSKTLSTILEAQIPYLDEWSTMMEEYSVSITEAIQALVNASERLPVGGNVRTTGGGTEFSIEDDGNNDFQYTKIHAKGETNKRMEFHACFFNMDIKIGLVIKLAEETDVSISELARVAGGERALVGECGDLLSKTYKSQLEECSLRGQLIQLHSVRDKNKNEE

SEQ ID NO: 135173 - protein, 606 aa, Glycine max
  Coding DNA Sequence Number=SeqID_43488
  Gene Ontology: Mol. function=binding; Cellular component=nucleus; Biological process=mRNA modification
  Homolog annotation: Hit_ID=A7PK13; Match level="QueryCoverage=79%, HitCoverage=81%, E-value=1e-160, Identity=55%"; Hit description =Chromosome chr15 scaffold_19, whole genome shotgun sequence
  Pfam annotation: Domain name=PPR; Domain location=127-161; Score =27.8; E_value=3.9e-05; Accession=PF01535.11; Description=PPR repeat
  Pfam annotation: Domain name=PPR; Domain location=189-223; Score =32.6; E_value=1.4e-06; Accession=PF01535.11; Description=PPR repeat
  Pfam annotation: Domain name=PPR; Domain location=251-285; Score =32.3; E_value=1.8e-06; Accession=PF01535.11; Description=PPR repeat
  Pfam annotation: Domain name=PPR; Domain location=335-369; Score =35.2; E_value=2.4e-07; Accession=PF01535.11; Description=PPR repeat
  Pfam annotation: Domain name=PPR; Domain location=433-467; Score =42.4; E_value=1.6e-09; Accession=PF01535.11; Description=PPR repeat
  Pfam annotation: Domain name=PPR; Domain location=504-538; Score=2.6; E_value=3.8; Accession=PF01535.11; Description=PPR repeat
  Pfam module annotation: Pfam domain module=PPR::PPR::PPR::PPR::PPR::PP R; Domain location=127-161::189-223::251-285::335-369::433-467::504 -538
MAISAIETSYNDLNSETFFELAVASHSAEDYCQATFKGCHHCPLDFMNNALKATISTDPEKGLVKNANGVLVSNKGTPLIPKNLSLKPRSSDDALHKRNAEITIHGRPGKLEEAKKLFDEMPQRDDVSYNSMIAFYLKNRDILGAEAVFKAMPHRNIVAESAMIDGYVKVGRLDDVRNVFDSMTHSNAFSWTSLISGYFSCGRIEEALHLFDQVPERNVVFWTSVVLGFACNALMDHARRFFYLMPEKNIIAWTAMVKAYLDNGYFSEAYKLFREMPERNVRSWNIMISGCLRVNRMNEAIDMAAWTAMITACVDDGLMDEVCELFNLMPQKNVGSWNTMIDGYARNDDVGEALRLFVLMLRSCFRSNQTTMTSVVTSCDGMVELMHAHAMVIQLGFEHNTWLTNALIKLYSKSGDLCSARLVFELLKSKDVVSWTAMIVAYSNHGHGHHALQVFTRMLVSGIKPDEITFVGLLSACSHVGLVNQGRRLFVSIKGTYNLNPKAEHYSCLVDILGRAGLVDEAMDVVSTIPPSERDEAVLVALLGVCRLHGDVAIANSIGENLLEIEPSSSGGSHPQIEEIYVLLKQNLQPLMREMGCTPENLLLVD

SEQ ID NO: 135174 - protein, 210 aa, Glycine max
  Coding DNA Sequence Number=SeqID_43489
  Gene Ontology: Mol. function=transcription factor activity; Cellular component=nucleus; Biological process=regulation of transcription, DNA-dependent
  Homolog annotation: Hit_ID=A5BV07; Match level="QueryCoverage=65%, HitCoverage=8%, E-value=2e-52, Identity=74%"; Hit description =Putative uncharacterized protein
  Pfam annotation: Domain name=CBFB_NFYA; Domain location=115-171; Score=130.8; E_value=4e-36; Accession=PF02045.6; Description=CCAAT -binding transcription factor (CBF-BNF-YA) subunit B
MYRNNEADEQQQSEPQMQHLSANGISHAGIGTQNVQYATPPQLGTGHAVWFASLVLSLELVPPTYPYPDPYYRSIFAPYDAQTYPPQPYGGNPMVHLQLMGIQQAGVPLPTDTVEEPVFVNAKQYHGILRRRQSRAKAESEKKAARNRKPYLHESRHLHALRRARGCGGRFLNSKKDENQQDEVASTDESQSNINLNSDKNELAPSDRTS

SEQ ID NO: 135175 - protein, 399 aa, Glycine max
  Coding DNA Sequence Number=SeqID_43490
  Gene Ontology: Mol. function=protein dimerization activity; Cellular component=nucleus; Biological process=regulation of transcription, DNA-dependent
  Homolog annotation: Hit_ID=Q5D1M3; Match level="QueryCoverage=100%, HitCoverage=44%, E-value=0.0, Identity=84%"; Hit description=Class III HD-Zip protein 4
  Pfam annotation: Domain name=MEKHLA; Domain location=250-399; Score =303.8; E_value=3.3e-88; Accession=PF08670.2; Description=MEKHLA domain
NVPPALLVRFLREHRSEWADYGVDAYSAACLKASPYAVPCARPGGFPSTQVILPLAHTIEHEEFLEVVRIEGHAFSPEDVAMARDMYLLQLCSGVDESAVGACAQLVFAPIDESFADDALLLPSGFRVIPLDPKSVEFHFFATFMIFLELGHETTDGPAPTRTLDLASTMEVGSGNARPAGEADLNGYNLRSVLTIAFQFTFENHTRDNVAAMARQYVRSVVGSVQRVAMAIAPSRLNTQLAPKSLPGSPEALTLARWIFRSYRMHTGTELFKAESTAGDAILKQLWHHPDAIMCCSVKTNASPVFTFANQAGLDMLETTLVALQDIMLDKVLDESSRKILCCEFSKIMQQGFAYLPAGICASSMNRPVSYEQAVAWKVLNDDDSNHCLAFMFMNWSFV

SEQ ID NO: 135176 - protein, 175 aa, Glycine max
  Coding DNA Sequence Number=SeqID_43491
MYDNIISEEVDMNEKNEDKAGVNEEHVDCSYWEYVDALHSMQNSNSSVKHSASSSDQAILKRTMPMLDQFHPCIHDSIENIVNVKADSNCGYCVIVALLGMGEDSWSLVCNHLLKEVAKWSDEYINLIGGIEKFDGLSMIYLRDRCPLPHLALLWSRNCHPQAKQWPTPYISRMK

SEQ ID NO: 135177 - protein, 266 aa, Glycine max
  Coding DNA Sequence Number=SeqID_43492
  Homolog annotation: Hit_ID=Q2HW90; Match level="QueryCoverage=56%, HitCoverage=38%, E-value=1e-14, Identity=31%"; Hit description =Putative uncharacterized protein
MELNQALSFKKRFYHVIIKSLEVASLQELGQRMNLLQRQTFRKTYEKIWDFAMIEVFVKAIASLAQYYDRSLRCFTFGDFQLVPIVEEFEGILGCPLGGKKPYLFSGLYPSMERVAKWTSFIDVLALLVFGIVLFPNADGLVDLAAIDAFLAYHHSKESSVVTVLADAYGHHMCAEKGKANWEKLLAGMDKELRGSGNSVIGGYHQWLKAQTQRLTLLPKLKISSGKEAEVLEESKEEKFKTAAIRARKEYDKLRDVNVAIAEALK

SEQ ID NO: 135178 - protein, 174 aa, Glycine max
  Coding DNA Sequence Number=SeqID_43493
EVRDADAPVPVPTDEVSLVGQALHTFLAWPTHLVAVSPPKPPSKPDPEVDDPLYLMTLTIPELFLRPYQHEDLSEIAHGGQCLSISVLQLHLTETCMRAGNSDIYGFLEPQSIQRSGQSQFESESYIKSWMQSSQRNVYLGAYLNGPDNYLKGIINSAIKGLDDAPQPKSKAPA

SEQ ID NO: 135179 - protein, 55 aa, Glycine max
  Coding DNA Sequence Number=SeqID_43494
MVLNQMMMKDTYRLKETLLSFRVFWTGLMDFKPMLVRDVTIIRDYLDLPPPPPSV

SEQ ID NO: 135180 - protein, 156 aa, Glycine max
  Coding DNA Sequence Number=SeqID_43495
MAPKKLPAKRARKDAAGEGSSMAPQVDVEFKGHRFRSEEHQRRFEAIKGWSFLKERGVQLRDEEYTEFHEEIAKRQWTQLAAPMAKYDPKPTEEGVRDKRSWVRGQWIPFDKDAINQFLGHPLVLEEGQRCEFSHRKSQASGFDEEAISQRLRVPG

SEQ ID NO: 135181 - protein, 252 aa, Glycine max
  Coding DNA Sequence Number=SeqID_43496
  Gene Ontology: Biological process=transposition, DNA-mediated
  Homolog annotation: Hit_ID=Q6UUU1; Match level="QueryCoverage=28%, HitCoverage=46%, E-value=1e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLLESHSVAQAGMQWHDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 135182 - protein, 40 aa, Glycine max
  Coding DNA Sequence Number=SeqID_43497
MQGKHRGGVGYRQSRTTLNGNLKGRDTKNGFSFAGSPLPC

SEQ ID NO: 135183 - protein, 136 aa, Glycine max
  Coding DNA Sequence Number=SeqID_43498
  Homolog annotation: Hit_ID=Q6L477; Match level="QueryCoverage=51%, HitCoverage=11%, E-value=5e-09, Identity=35%"; Hit description =Putative uncharacterized protein OSJNBa0009L15.8
  Subcellular localization annotation: CTP_CleavageSite=30; ConfidenceScore=5.66e-01
MASPPASPPSPPPAPSDASALPSAVKRTRKASRLQSLSTRPPGTKRPVVHVDHTTGKADGPHKKKLRTYLGIVVRDKVDVTYDHWKEVPTAQKDLIWEDIQAEFEILETSDSRTKRKLLHTVGERWRQFKSDLTRK

SEQ ID NO: 135184 - protein, 59 aa, Glycine max
  Coding DNA Sequence Number=SeqID_43499
MPISPCGSISWSVPSRDRALKTPSGLGEVQQGLGVSSSDYGPLSVLRSACRPKQDEKMT

SEQ ID NO: 135185 - protein, 423 aa, Glycine max
  Coding DNA Sequence Number=SeqID_43500
  Homolog annotation: Hit_ID=Q2HW90; Match level="QueryCoverage=33%, HitCoverage=31%, E-value=4e-19, Identity=35%"; Hit description =Putative uncharacterized protein
LLVFGVVLFPNVDGLVDLAAIDVFLPYHNSKESPVVAMLVDAYDTFDQRCEKRGARIVCCTPALYVWLVSHIFRHESRLTCPLQGHCMCAEKGKANWEQLLAGFLNVPLMGTRGCINYNLILVIRQLGYPMRGAPSEESIAPFITRGFGDPNSRMLQSAEVPEESKEVQPLMELERTQIVKEKFKMAAIKVRKECDELRDVNTATAAALERETKTARKEERGRNKFRGALWGSNNKLKFRRAKRDQPRIEGMILEDKLKAYQRSKRILSKQLSRTEENMWAIIEQYKEKLNLAATHEQRLEDKYAKVSVLQAEREARERVIDSLHREAMMWMDRFTFTLNRSQELPRLLAKAKAMADLYSAPEEVHGLLNCCRYRGLEGSNGLMMEDMLSMKRMMESNSTAVAANSTSAEADLTHPFTITQWT

SEQ ID NO: 135186 - protein, 145 aa, Glycine max
  Coding DNA Sequence Number=SeqID_43501
MVEASGNRLPVCVIDYTEEWVTGNRLPASGNRLPSLCNRLPEMKSLKIPLLIIVMAAQLIHDRVEMECLEGAWETLEGNTRCRFRGTIRFTATSLVHPDEPAQTLQRTVEWILPTPTPYRLVEPVQVIEVTSSKKTLRGSGGATS

SEQ ID NO: 135187 - protein, 218 aa, Glycine max
  Coding DNA Sequence Number=SeqID_43502
KGHALRRPYRTRARARVMGEAEEVQEKMKADMEAMKEKMATMMKAMMSMKKIMEANAVAIAATSVVAKMNLMSPSGINQMNHPTSDMVGKDLGSTGSPHNVQIQNEHAFPSYGLPLNYTPPNEAYTPNKNTHEIPHHNLADFEPWLGYTTEGQAVGGIPYKTLWRALSITHNCTSCIPQRLKTLMTMAGMGKLDHLEERLRAIEGGEDYAFANLEECS

SEQ ID NO: 135188 - protein, 220 aa, Glycine max
  Coding DNA Sequence Number=SeqID_43503
  Homolog annotation: Hit_ID=Q6WAY4; Match level="QueryCoverage=75%, HitCoverage=30%, E-value=5e-21, Identity=35%"; Hit description =Putative uncharacterized protein
MGTNQTGKRFYQVKVKGLDTTSIKELGQLMEPLQMQAFRKTYGKILELTIAKVSIEAIASLTQYYDQPLRCFTFGDFQLVPTIEEFEEILGCPLGGRKPYLFSGCLPSLSRIATMVKDSARGLDHVKQTRNGIAGLPRKYLEDKVRGMANQGDWVPFMDVLALLIFGVVLFPNVDGLVDLAAIDAFLAYYHSKESPVVAVLTLGIQVRSKAIARVLKRGE

SEQ ID NO: 135189 - protein, 287 aa, Glycine max
  Coding DNA Sequence Number=SeqID_43504
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLVVLEAGKSKIKTLGDTVSSEGLLPGSQMAPLAVFLNEGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135190 - protein, 57 aa, Glycine max
  Coding DNA Sequence Number=SeqID_43505
MTLKKKMKEAIRILKTMGIEEIMNFQENGKPQEIIPSTTLLHGLSITFLAPRTPQQE

SEQ ID NO: 135191 - protein, 95 aa, Glycine max
  Coding DNA Sequence Number=SeqID_43506
AGAVTSFGYCKDHDGQWLKKDALPLQDERTPSPSPQRDASALMTEVLSELRGLRTYVGGRFDSLDGRFEGMDTRITQLEEDVGYLRRCFDLPPPS

SEQ ID NO: 135192 - protein, 96 aa, Glycine max
  Coding DNA Sequence Number=SeqID_43507
MGSSQKPSLKKRFYQVKIKSLEVTSLRELGQLMGQLQPQAFRKNCLLCTGSLCVAGFTPFFSKKVGPSIRYKVTARASKRERVIDSLHQEATMWTD

SEQ ID NO: 135193 - protein, 137 aa, Glycine max
  Coding DNA Sequence Number=SeqID_43508
  Homolog annotation: Hit_ID=Q6UUU1; Match level="QueryCoverage=72%, HitCoverage=90%, E-value=5e-23, Identity=50%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPLAAPSCALLFLPFGLPGVIPAVMG

SEQ ID NO: 135194 - protein, 157 aa, Glycine max
  Coding DNA Sequence Number=SeqID_43509
MSFKTCGKAWAEQMRKMSDKAEFLFLSRKCLCIAGYGKGFDGDPVLRGTRIRATWGYVSSVEEMICTIAQSPPSTTYDGVVPGDMSWGSGDLGDVRRAPGSQPIKEQRPQSKEACVVAGQLWILSGIWILASGNRLPREVEMASGNRLPRVVIDYKA

SEQ ID NO: 135195 - protein, 151 aa, Glycine max
  Coding DNA Sequence Number=SeqID_43510
MAEDQPRRVTLKDYSSSTVPQFFTSIALLEVQAHNITYPHSLIQLIQGNLFHGLPNEDPYAHLATYIEIVIQPRFPKYFLESKIAKGKVVISFFHQFLDESLSEVLERFRSLLRKTLTHGFPEPIQLNIFIDGLRSQSKQFLDASAWEKSS

SEQ ID NO: 135196 - protein, 203 aa, Glycine max
  Coding DNA Sequence Number=SeqID_43511
  Gene Ontology: Mol. function=phosphoribosylamine-glycine ligase activity; Cellular component=chloroplast; Biological process=purine nucleotide biosynthetic process
  Homolog annotation: Hit_ID=P26977; Match level="QueryCoverage=100%, HitCoverage=47%, E-value=1e-111, Identity=94%"; Hit description =Phosphoribosylamine--glycine ligase
  Pfam annotation: Domain name=GARS_A; Domain location=1-88; Score =66.3; E_value=4.7e-17; Accession=PF01071.10; Description =Phosphoribosylglycinamide synthetase,
  Pfam annotation: Domain name=GARS_C; Domain location=122-203; Score =126.7; E_value=6.9e-35; Accession=PF02843.7; Description =Phosphoribosylglycinamide synthetase, C domain
  Pfam module annotation: Pfam domain module=GARS_A::GARS_C; Domain location=1-88::122-203
MATSQDHKRVGNGDTGPNTGGMGAYSPAPVVTDEVHQRTMDRIIWPTVKGMAAEGNTYTGFLYAGLMIDKQGNPKVIEFNCRFGDPETQPIMLRMKSDLVELCLAACEGKLDEKTSEWDERASLGVVIAAGGYPGHYNTGDEIHGLPLEEVEDAKVFHAGTKLADDDRVLTNGGRVLCATALGHTVAEAQKRAYALMADIHWN

SEQ ID NO: 135197 - protein, 29 aa, Glycine max
  Coding DNA Sequence Number=SeqID_43512
MDLLGETSFKGGDIEAHSSSMREISAQTC

SEQ ID NO: 135198 - protein, 63 aa, Glycine max
  Coding DNA Sequence Number=SeqID_43513
VPVTSSKGIRPPTDRAFIKKYCVPRQAQGETPQQHWDGRMHLVAHDPGDLNKTSASSEGSKVP

SEQ ID NO: 135199 - protein, 125 aa, Glycine max
  Coding DNA Sequence Number=SeqID_43514
  Homolog annotation: Hit_ID=A5ATL8; Match level="QueryCoverage=68%, HitCoverage=68%, E-value=2e-20, Identity=65%"; Hit description =Putative uncharacterized protein
MRRDRKKTPTAKALCWADTDTERRKLGERMGLDTPVVLARRTLPGLDMPRILLKERGAFGNADTGGAWLSSARATAGDKPEEGEDDVKSSCPLCPGRHTCYNGRDKGSRSREGELTPKTRPQFGL

SEQ ID NO: 135200 - protein, 37 aa, Glycine max
  Coding DNA Sequence Number=SeqID_43515
MKMLLIPHVMNGSGMVKEEREEMPLQGDDESRRSSPP

SEQ ID NO: 135201 - protein, 176 aa, Glycine max
  Coding DNA Sequence Number=SeqID_43516
MTPVNRKAGTGERTREPPGGNAGIFIVLSGFATTDLSVRFRDACQGGGAYGKTALPRPSHFPVKFLPGALKYLKNQEIPPRGDKPLVPSPHRDRAVGAQREFAPIVSRITIHADAPVQPFFSCHERTSLNPHQLPTSNRHIHIPLSPAIANPHHRPSQRWPIHLNAANGDGFPYGH

SEQ ID NO: 135202 - protein, 67 aa, Glycine max
  Coding DNA Sequence Number=SeqID_43517
MTNNEHKTEKEHESGDLPVMWLHSLPRSRANLTSPHPCRPPLHRREPLRVPTLPGPRVNPRAMRPLP

SEQ ID NO: 135203 - protein, 107 aa, Glycine max
  Coding DNA Sequence Number=SeqID_43518
  Homolog annotation: Hit_ID=A5AWV0; Match level="QueryCoverage=71%, HitCoverage=5%, E-value=7e-07, Identity=37%"; Hit description =Putative uncharacterized protein
MVVILPKENLVVWFFSLHNRPDNYFKGIINSALKGLDDTPQPKSKAAARWIVVKCNRQKGSTECGYYVMHWMSTIILGSFRNNWKVTIGAREIKGASHPVGMILSPT

SEQ ID NO: 135204 - protein, 150 aa, Glycine max
  Coding DNA Sequence Number=SeqID_43519
MLAIRQLGYAMRGAPMEESLSPFLVSDFGTQNFKLKVRTRGLDWLAKLKIINEENFEAPEEDEEVRALKTRTRKSETRQRKISSWSLKTSGKSVPGYEKKMQLPQKPLNKKPRGLARKSMFVTNFRGVIVGAADSELSFKVKEERRIMST

SEQ ID NO: 135205 - protein, 285 aa, Glycine max
  Coding DNA Sequence Number=SeqID_43520
  Homolog annotation: Hit_ID=Q6WAY4; Match level="QueryCoverage=81%, HitCoverage=43%, E-value=3e-07, Identity=24%"; Hit description =Putative uncharacterized protein
MGTRGCINYNPALAIRQLGYPMRGAPTEESLSPFLVRDFGVQSLKVVERVHKAWRSPLRKDKELRGIRNGIIGGYHEWLKVHTRGLDWLFKLKVVNEENYEAPEEDEEIQALKLELGKARLAKEKFKSAATNIWKECTELREENAATARALEQETKRARKEEHGRDKFRGALWGSNNELKLRRKERDQSRVHGMILKEELAACSRSKRRLAQHLEAMEQSMLAIIGQYKEELNHSWTHEQKLVEDVAQAYAEKEARGRVIDALHQEATMWMDRFALTLNGSQDLP

SEQ ID NO: 135206 - protein, 58 aa, Glycine max
  Coding DNA Sequence Number=SeqID_43521
CSSYGACRPWIFFINGVLFFLKIMAAEWIRKKDDWRRHFKEKMSLEEAHHHRKPRIRA

SEQ ID NO: 135207 - protein, 148 aa, Glycine max
  Coding DNA Sequence Number=SeqID_43522
MINAAARKEEECAEIEIHQESICQVTSIHHQLTNEEEKPEVSNTPEYPYLATVGYVGGKDKGRLELSVEDQKISFDLFEAMKHSDMGDAYFEEEEVEQEITLLASTMVLQSPLEKEPGYGRDCLACDEELDDSKDNYVDKVVLKNWKN

SEQ ID NO: 135208 - protein, 139 aa, Glycine max
  Coding DNA Sequence Number=SeqID_43523
MDMKLGSLISGQISLMAHHDSSRLGFPSLITALCKAQGVTSDSLTFESLSPAINLVYIIKNCWNLDDPSTTFRGTRKSRARGSEAPSTSAPPTSAHSTSPLPPAPASPVLPDPSSQSFEPSLSMLQSIHQGQLLIMKSL

SEQ ID NO: 135209 - protein, 129 aa, Glycine max
  Coding DNA Sequence Number=SeqID_43524
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=68%, HitCoverage=75%, E-value=1e-24, Identity=66%"; Hit description=LacZ protein
MQICDHYSRIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 135210 - protein, 58 aa, Glycine max
  Coding DNA Sequence Number=SeqID_43525
MINAGMICPLRCHEEMHDAIKEQARGRQGCCPCSYVSSGAMRNLDLRSSLSLNVCVLN

SEQ ID NO: 135211 - protein, 139 aa, Glycine max
  Coding DNA Sequence Number=SeqID_43526
MGKVEEAQEQMKADMEATKEQMATMMSMKKIMEANVVIVAATSVVAKVNPMPPSGLNQMNHPTLDMTHGMPHHYLADFEPCLGYTTKGKAVGGIPMPNTLEGPQFRPQPQPLHFAVGRAPPAMAEKGTVGSYRGKAQGH

SEQ ID NO: 135212 - protein, 78 aa, Glycine max
  Coding DNA Sequence Number=SeqID_43527
SQSSSTLKRTQKATRLRYLATRAPGEDRPVVHVDPAIGKADGPHKKKLRTYLGIVARDNVDVTYETWKEVPVAQKDLI

SEQ ID NO: 135213 - protein, 174 aa, Glycine max
  Coding DNA Sequence Number=SeqID_43528
LQVVPSVVRLMKQSPYNQQGQWRSHPGNQFNKDQGGPSNRPIQQGPNIFQRITKLEETLTQFMQKNPKEECKAVMTRSKRFVENEEEKSVGLKKKVVEEKGTDGKKNDERGENNQEKEKQIMVNKKELNDQEKEKEVEKEKKIKKLKKMKKNENEKKSRSEKAVNEAAEVPYPV

SEQ ID NO: 135214 - protein, 82 aa, Glycine max
  Coding DNA Sequence Number=SeqID_43529
MSNHKSTESALKNLEIQVDQLVKQLAEKSSNSFGANTKKNPKEECKVVVTRSMKLVAAEDEDVVALKEQVALKDTTVKKRMR

SEQ ID NO: 135215 - protein, 61 aa, Glycine max
  Coding DNA Sequence Number=SeqID_43530
MDKFDIFVPHPLTTHIFAYSTFTGIWVQAIGLFAQATCAPEFGHPRPFNQRLLVLHVVGGA

SEQ ID NO: 135216 - protein, 297 aa, Glycine max
  Coding DNA Sequence Number=SeqID_43531
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDPTLAPQPLTGPAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135217 - protein, 101 aa, Glycine max
  Coding DNA Sequence Number=SeqID_43532
MHSAACQCQNSQITSDNPPQILASLHQLDFAPYVSRSYNAQWNALKPFHDKHVAFKLYPQKNEGWCLVSVVRQADFVADLGVTFVDDWVFLDDKVVVNERG

SEQ ID NO: 135218 - protein, 252 aa, Glycine max
  Coding DNA Sequence Number=SeqID_43533
  Homolog annotation: Hit_ID=A5BZH4; Match level="QueryCoverage=36%, HitCoverage=14%, E-value=6e-08, Identity=37%"; Hit description =Putative uncharacterized protein
  Pfam annotation: Domain name=zf-CCHC; Domain location=200-217; Score =19.0; E_value=0.002; Accession=PF00098.14; Description=Zinc knuckle
MSHHSSSVNGEGTSHKDPLSRILDELSSLKLWKEKTRKKRKSGKERIKINQDERKQIREEERRKILKELRKEKHVSYSSHNSCMSLSEELHDYYEGRHRSHLRLHSHRRKNERKPKEANINLPYFHGKDNVEAYLDWKIRVEKKLKRKSTLKSYGSHSYPKKDQGLGILGAAPSKPKDDKGKTIEKQPPKASMQEKTRSIKCFKCLGRGHITSQCSTKKTMIMSDQDIYSSQDEATTSPSSSESEEAKGKNL

SEQ ID NO: 135219 - protein, 281 aa, Glycine max
  Coding DNA Sequence Number=SeqID_43534
  Gene Ontology: Mol. function=motor activity; Cellular component=cell projection
  Homolog annotation: Hit_ID=UPI00016621D1; Match level="QueryCoverage =86%, HitCoverage=40%, E-value=8e-21, Identity=34%"; Hit description =UPI00016621D1 related cluster
MPSPLEDYMCSPSEDYTSSPLEGYTHSPSDDYIGLHVLAYRGLHTLAFIRLHTLAFIGLHAVTFSGLHVITFRGLHVLAFRGIQTPTFIGLYALAFIGLHALTFKGQHVLAFRGLHVLAFRGLHALAFIGMHALAFIGLHALTFRGLHVLAFRGLHVLAYRGPHVLAFRGLHVLAFRGPHVLAFRGPHVLAFRGLHVLAFRGPHVLAFRGLHALAFRGLHVLIFTGLHALTFRGLHVLTFIGLHVLAFVGVHAITFIGLHALTFIGLYTLTFIGLHFLTFR

SEQ ID NO: 135220 - protein, 88 aa, Glycine max
  Coding DNA Sequence Number=SeqID_43535
MENGTKQSLRIGSKLEGGGHMNENAFHGAPKRLRMENCTKQITTHGSKLEGGGHMNENAIHGAPKRLRMESCTKQSLRMAPNSKVENT

SEQ ID NO: 135221 - protein, 93 aa, Glycine max
  Coding DNA Sequence Number=SeqID_43536
MGKVEEAQKQMKAGIEAMKEQMATMMEAMMSMKKIMEAKIWEVGTAPMMCKFKTSTPSRHMACLPTIHHPNVNNSTPIPIESQQPQTDHAHVS

SEQ ID NO: 135222 - protein, 88 aa, Glycine max
  Coding DNA Sequence Number=SeqID_43537
MPISPCERITPTRHSVDSGGARLGPGGLQLWFTGLCQSYRGARPPQQRSLPIMETGICALQDNPMGPRKKSNRGPWGFPSFWINGPSK

SEQ ID NO: 135223 - protein, 89 aa, Glycine max
  Coding DNA Sequence Number=SeqID_43538
MGWLEYRGNVWKQKQESWQAAIDTFLAFHDRKESPVVAILADLYDTFDRRCEKNSTRIVCCTPALYVWLVSHLFRQEVRHACPLEGQRS

SEQ ID NO: 135224 - protein, 75 aa, Glycine max
  Coding DNA Sequence Number=SeqID_43539
  Homolog annotation: Hit_ID=A4EB57; Match level="QueryCoverage=73%, HitCoverage=34%, E-value=5e-13, Identity=65%"; Hit description =Putative uncharacterized protein
VGLSPATSATLVFSCQHLVWNPLGDRIDKPEEGEDDVKSSSPLSPGRHTCYNGRDKGSRSREGELTPKTRPQFGL

SEQ ID NO: 135225 - protein, 176 aa, Glycine max
  Coding DNA Sequence Number=SeqID_43540
MVLKEELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYWKNTITKRATRHPYRTRSKSRTMGDQEETQEQMKADMSALKEQMASMMEAMLGMRQLME

SEQ ID NO: 135226 - protein, 59 aa, Glycine max
  Coding DNA Sequence Number=SeqID_43541
  Homolog annotation: Hit_ID=A0PAV3; Match level="QueryCoverage=64%, HitCoverage=17%, E-value=8e-07, Identity=73%"; Hit description =Restriction endonuclease
MVKVGTSYVPINVSFSPKVGPGIPGINRDTRIYLFCEVIFRHRCSSGFCFYQLCLLFSY

SEQ ID NO: 135227 - protein, 178 aa, Glycine max
  Coding DNA Sequence Number=SeqID_43542
  Subcellular localization annotation: CTP_CleavageSite=39; ConfidenceScore=5.60e-01
MFSLAGTYQLSQLCRGCSSATSAKRLHLSLSGSVYFVMMASRKRKSICSRPIVQYDTRRFSSLDAWTRYTNNVLGKNILPERKVEIYHTKLDEFKAELERRNFHKRLTNLVDGSIDLALVKEFYANLYSSEDHSPKKSRVRGHLVKIDADSLNTFLETLAVLAKGETLPVYSRYCSCL

SEQ ID NO: 135228 - protein, 165 aa, Glycine max
  Coding DNA Sequence Number=SeqID_43543
  Homolog annotation: Hit_ID=A0ST23; Match level="QueryCoverage=16%, HitCoverage=55%, E-value=2e-08, Identity=100%"; Hit description =Putative reverse transcriptase
  Subcellular localization annotation: CTP_CleavageSite=42; ConfidenceScore=5.14e-01
WTSYVPINVSFSPKVGPGLPAVPPVQLLTGWCVTAKAPPDISAGKCSGHAARRVPFAIQAAQLLGRAIGAGLFAITPAGERGMCCKAIKLGGNDAKIDIKLIDTVDLEGGPVGKPVVPAALMNRPTRGERRFAYWALAECILAYYVGTDEGVSEVLHVAGEKGCT

SEQ ID NO: 135229 - protein, 313 aa, Glycine max
  Coding DNA Sequence Number=SeqID_43544
  Gene Ontology: Mol. function=zinc ion binding
  Homolog annotation: Hit_ID=A4W6P3; Match level="QueryCoverage=53%, HitCoverage=90%, E-value=9e-72, Identity=69%"; Hit description=Sugar fermentation stimulation protein homolog
  Pfam annotation: Domain name=SfsA; Domain location=51-225; Score =169.7; E_value=7.8e-48; Accession=PF03749.4; Description=Sugar fermentation stimulation protein
MPVRPLPSRPQFFTGLSRTHTLYAATALDAGRHDEGILMKFSPALQPATLIQRYKRFIADVVTPEGKTLTLHCPNTGAMTGCATPGDTLVKEALTHGTIPELVGYGTHKSEVKYGDESSRIDFMLQAEDRPECYIEVKSVTLAEQENGYFPDAKHLRELMSVAAAGKRAVLLFAVLHSAIERFSPARHIDPKYAQLLNEAQKQGVECSGRVRKYAFPHRLVKRSNMQEGQNRKTSSLSILAIAGVEPYQEKPGEEYMNEAQLSHFKRILEAWRNQLRDEVDRTVTHMQDEAANFPDPVDRAAQEEEFSLELRN

SEQ ID NO: 135230 - protein, 123 aa, Glycine max
  Coding DNA Sequence Number=SeqID_43545
  Gene Ontology: Mol. function=DNA binding; Cellular component=nucleus
  Homolog annotation: Hit_ID=Q9LRX4; Match level="QueryCoverage=37%, HitCoverage=2%, E-value=4e-10, Identity=69%"; Hit description =Arabidopsis thaliana genomic DNA, chromosome 3, TAC clone:K7P8
MICVGTKRGCFEALGLKGKGSARQLFQRFQGPMEEDTLKSHFDKIIKIGQKQRYHRNQLKLEFSDACSGMNAILRLDLLVLQWPNCITLCVRECIGKNSSPTSARDKTKIKYISGGQPSVNDF

SEQ ID NO: 135231 - protein, 208 aa, Glycine max
  Coding DNA Sequence Number=SeqID_43546
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
DLPSQVLQWLLFLSAVPPVQLLTGWCVTAKAPPDISAGKCSGRVPFAIQAAQLLGRAIGAGLFAITPAGERGMCCKAIKLGNARVFPFETLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135232 - protein, 147 aa, Glycine max
  Coding DNA Sequence Number=SeqID_43547
  Subcellular localization annotation: CTP_CleavageSite=14; ConfidenceScore=5.44e-01
MVKVGTSYVPINVSFSPKVGPGFPACFLTPGIAYSQYRASGGSPSLLICVVRVFRGSGFMFLSAVPPVQLLRGMVLSANSATSIPAGHQRKCKAWGPKIRKPVGNCNDGNARAMRRAFAIASGERGCVHTGLLCWVTERVFPVKCFM

SEQ ID NO: 135233 - protein, 77 aa, Glycine max
  Coding DNA Sequence Number=SeqID_43548
MVQACTEMIMPIGGSNKESIFPEYEWSFKARTSWISGPTVSSKLRVTPRATEREQDQKSFKGRDESESDRARMRVAT

SEQ ID NO: 135234 - protein, 96 aa, Glycine max
  Coding DNA Sequence Number=SeqID_43549
  Subcellular localization annotation: CTP_CleavageSite=30; ConfidenceScore=5.18e-01
MYPLLFLVTTTQVDVPSTCTTKDVPSNVLRQSSQAGEGRHKRIQAVSPLFFWKREKRDTKRIQANKVWKPENSKSFWQRMKKKKKFKKMFKEIQRL

SEQ ID NO: 135235 - protein, 69 aa, Glycine max
  Coding DNA Sequence Number=SeqID_43550
MTIICLRVPSDMIVFGWQKAQNDHNLSLRAIGHDRVWMVKRASMTEIVGRPTKARLLFLCILNEELKPT

SEQ ID NO: 135236 - protein, 91 aa, Glycine max
  Coding DNA Sequence Number=SeqID_43551
MTGPLDESISCFLIRADPWVLVPIFFRGLHILTFKGLHVLTIRGLDVLAFRGLHALTFRGLHVLTFRGLHVLTFIGLHAFTIKGQHVLALR

SEQ ID NO: 135237 - protein, 194 aa, Glycine max
  Coding DNA Sequence Number=SeqID_43552
  Homolog annotation: Hit_ID=Q6WAY6; Match level="QueryCoverage=72%, HitCoverage=30%, E-value=1e-11, Identity=31%"; Hit description =Putative uncharacterized protein
GLVDLATIDAFLTYHNSKENPVTTILADAYDMFDLRCEKSSARIVCCMPALYVWLVSHIFRHEGFPNVPLMGMRGCINYNSMLAIRQLGYPMRGAPSEEIILPFIARGFNEANVKILQRIHRAWNTMERKDKELSGSLSGKEAKVPEESEEVKALKAELEKMRVVKEKLKMVVTRVRKECDVLRDVNMTTVEAL

SEQ ID NO: 135238 - protein, 92 aa, Glycine max
  Coding DNA Sequence Number=SeqID_43553
MRQTRPYSGMTPVNRKAGTGERTREPPGGNACLEHRIPAPVGITTSSRACRHTRVGAQQLPWNSESYSHIQLSTVSFFLTTLRLEHPGRYPT

SEQ ID NO: 135239 - protein, 78 aa, Glycine max
  Coding DNA Sequence Number=SeqID_43554
MGSSQKPSLKKRFYQVKIKSLEVTSLGELGQLMGQLQRIMTQPLRCFTFEDFQLVPTMKKFEEILGCPLGGRKPYLFL

SEQ ID NO: 135240 - protein, 124 aa, Glycine max
  Coding DNA Sequence Number=SeqID_43555
MSEIEEVQEQMKAHMEAMKEQMDTMMEAMMSMKRMVEVNTAIVIAASTATEVKEAEPWEVHAALILCGIRTSITSHHMACLPTIHHPMLHTLLMRMSITPLSYSLRANNPNLIMHMSLNPWGDT

SEQ ID NO: 135241 - protein, 130 aa, Glycine max
  Coding DNA Sequence Number=SeqID_43556
MLRVTPPRRAYPLQGTCPIRHSVCATVGKGDRCGLFAITPAGERADVLKAYSWLLSRVFPVNVLLWQEKKAHGSAEYVNTTHYRANSRFGRSRTDSSLGRNSICPERKWLRKGRSQQGFLEDAGRYLTGK

SEQ ID NO: 135242 - protein, 228 aa, Glycine max
  Coding DNA Sequence Number=SeqID_43557
  Homolog annotation: Hit_ID=A0QYU1; Match level="QueryCoverage=100%, HitCoverage=53%, E-value=5e-45, Identity=42%"; Hit description=D -amino acid deaminase
MSVSGGRTGCRSPQVALEIAQAIHDSRSLQLVGVAGYEGALGAGRDAAGVQRVKDYCEMMIATAALLAEHQLFASGEIILSAGGGAWFDVAAACFSAAQLPLPVTPLIRSGAYMAHDSGLYARIAPFAQPGATHHFSAALEIWGRVLSRPEPGLAFVDFGRRDVPFDQDLPNPLWIRQADGSAPRAATHLRITDVNDQHAYLQLPADDPLQPGDWIGCGISHPCTAFD

SEQ ID NO: 135243 - protein, 239 aa, Glycine max
  Coding DNA Sequence Number=SeqID_43558
  Homolog annotation: Hit_ID=Q6WAY6; Match level="QueryCoverage=49%, HitCoverage=20%, E-value=1e-12, Identity=33%"; Hit description =Putative uncharacterized protein
TYFIPLTEGVRKIAHGLSVACPLSVCVDWDQHLARIGGSAINWFPRWKEGKEGVLFSCGDYPNVPLIGTRGCINYNPALAIRQLGYPMRGTPTEESLSPFLVRDFGAQSLKVIQRVHKAWRSPLRKDKELRGIRNGVIGGYHGWLRVHTRGLDWLPKLKVINEENFEALEEDEEVQALKLELGKARLAKEKFKSAATNIRKECTELREENVATARALEQETKRARKEERGRDKFRGALW

SEQ ID NO: 135244 - protein, 119 aa, Glycine max
  Coding DNA Sequence Number=SeqID_43559
MRGVLIPSPCVNTTPEPFTLKNRRPHLFRFFRHFPRINVGGDYVRFPPLEDAPVSPRVALPPKGRPIGVREQIHDASLDICETPRFCTKMPSICEQAEVDGVHAIRHDHAEGLWENIAP

SEQ ID NO: 135245 - protein, 145 aa, Glycine max
  Coding DNA Sequence Number=SeqID_43560
MSEIKEVQEQMKVDMEAMKEQISIMMEAMMSMKKMMEVNMVTIVAASTATEVDLTHPSDLNQVNRPASNMIGQVGEALGCTGWPPFFASLDKAFLPIIWLASQLDTTQCLHMLPMRISITPLPYSLRANNPNLIMHMSLNHRGDT

SEQ ID NO: 135246 - protein, 103 aa, Glycine max
  Coding DNA Sequence Number=SeqID_43561
SVFTFNGYLGGVVLAEVLLADSRFTRPDMGFHPTKLNFVPSDADEAPLDVSILPACLWYCGVLTIGSCVAYLPNGIRVASQTHSIQASLLGTLEDFKVPHVNH

SEQ ID NO: 135247 - protein, 127 aa, Glycine max
  Coding DNA Sequence Number=SeqID_43562
YCTQRQAQGDAPQATDAPPPHQAGPAGSFDTEQYLWHLVRQQAANHRAHVQTHDCLYQLSLSLQSQGFTSFPCPTPDQFRAEVAWLGDWPEARVGEAPAEAPDEANETREDEEMTDLLDFLGGSTAT

SEQ ID NO: 135248 - protein, 64 aa, Glycine max
  Coding DNA Sequence Number=SeqID_43563
  Subcellular localization annotation: CTP_CleavageSite=42; ConfidenceScore=5.15e-01
MQNYQHAKRSNSAKARINWKRIMQQKRHPHAQSSSQPTINCTSEYDSSSSNFLTAYEDCQSPTN

SEQ ID NO: 135249 - protein, 64 aa, Glycine max
  Coding DNA Sequence Number=SeqID_43564
  Subcellular localization annotation: CTP_CleavageSite=30; ConfidenceScore=5.31e-01
MSPPPLGPLNHSQTQLTLSGRLPFPGGFVRALMLIVTLILSAHITEYRLSTCFSRSVNALKRCA

SEQ ID NO: 135250 - protein, 204 aa, Glycine max
  Coding DNA Sequence Number=SeqID_43565
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=67%, HitCoverage=34%, E-value=6e-71, Identity=96%"; Hit description=NADH dehydrogenase subunit B
  Pfam annotation: Domain name=Oxidored_q1; Domain location=23-203; Score=-10.9; E_value=1.8e-06; Accession=PF00361.11; Description=NADH- Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRCLDFSKLHGHAEEKCYSHSDQDITLLVQITIKMLHSWVLILSETTSIIGASVNKRDHPKMIISVAI

SEQ ID NO: 135251 - protein, 202 aa, Glycine max
  Coding DNA Sequence Number=SeqID_43566
MPTSQYDTRRFSSLDAWTRYTDNVLGRNILLERKVELYHIELDDFKAKLERRNFHKCLTNLVDGSIDMALVKEFYANLYSYEDRPPKQSRVRGHLVKIDADSLNRFLETPVVLAKGETLPAYSRYCRLPTNFREIEAALCIPGRGFILNFEGHPGMILRKDLTTLAQVWSVLSYSNLAPTSHTSDLTMDRARLIFGLVSHRI

SEQ ID NO: 135252 - protein, 52 aa, Glycine max
  Coding DNA Sequence Number=SeqID_43567
MSALPIMGSRIHQVLDCSPTNRERELGLDRRETVGGLGPPKARAVGDPREAD

SEQ ID NO: 135253 - protein, 65 aa, Glycine max
  Coding DNA Sequence Number=SeqID_43568
  Homolog annotation: Hit_ID=UPI0000ECA21E; Match level="QueryCoverage =58%, HitCoverage=10%, E-value=1e-11, Identity=81%"; Hit description =UPI0000ECA21E related cluster
MAYERGGDFLEDARKILNTEAVRSKLDCMHEPPVQSDRCALSGNYRLESNPERHAKAPLAAATGN

SEQ ID NO: 135254 - protein, 45 aa, Glycine max
  Coding DNA Sequence Number=SeqID_43569
MLQPYGINIGLKEHSNRVTPKAYTPKIPSGLLPPDSVYLIALKGT

SEQ ID NO: 135255 - protein, 46 aa, Glycine max
  Coding DNA Sequence Number=SeqID_43570
  Homolog annotation: Hit_ID=A8ARU6; Match level="QueryCoverage=84%, HitCoverage=50%, E-value=1e-12, Identity=79%"; Hit description =Putative uncharacterized protein
PGRQFAPSWTVCTNPPFSPTAAPYPVTIVLSPTRKDMRKHHLAAAT

SEQ ID NO: 135256 - protein, 54 aa, Glycine max
  Coding DNA Sequence Number=SeqID_43571
MDKSLKVGEDEWRERERRSTKFCASKELCFSPLIQDEVQGSPLSVLRCHEACKA

SEQ ID NO: 135257 - protein, 64 aa, Glycine max
  Coding DNA Sequence Number=SeqID_43572
MCAYLNHSANQSGVFVLSASKLGLTHEEMALSASLTHHPVIQDPIMFPLQGPSSQVFFPPSHEL

SEQ ID NO: 135258 - protein, 85 aa, Glycine max
  Coding DNA Sequence Number=SeqID_43573
MTEARQKGVRKVNENENKIEDRRKRRTNDECRRTVENLRVITHGNVTEAPRHGFSSRKQFSLANLREHEVPRRLNPFPLHSSPYL

SEQ ID NO: 135259 - protein, 52 aa, Glycine max
  Coding DNA Sequence Number=SeqID_43574
MSVKNLVGRLGVYDKTNHTLASQVTLTRLKGTLKLGDPQGLHSEESVRAFPS

SEQ ID NO: 135260 - protein, 124 aa, Glycine max
  Coding DNA Sequence Number=SeqID_43575
MQDHTHKDTQWARRSPTGPWGFQLWLRASIVLQGARSPRQGHIIIGIVPARHPVDPKKFSRFYGVPVTSSKGIRPPTNRAFIKRYCVSRQAQGETPQQPGDGQQRATDTPPSPLDFTSAHPQKG

SEQ ID NO: 135261 - protein, 111 aa, Glycine max
  Coding DNA Sequence Number=SeqID_43576
MCVVKKVIWIFRFPMTKDETNIERVRDGMMQMRKSATGGCTEPNSQKVPSGVANCRNMPFCGRSEARLTGALSKGGKMRGVATNVYLWKTSEKPKETGQNENSKFRSCIYV

SEQ ID NO: 135262 - protein, 114 aa, Glycine max
  Coding DNA Sequence Number=SeqID_43577
MYCVSRQAQGETPQQPGDGQQWATDIPPSPLEFTSAHPQKGNGRTHLVAHDPRKLNKMSTSSEGSKIPGTRMYIAKYFTKIYGECCENFPGRQKWTRMNAKIDKRTYFGNIGLT

SEQ ID NO: 135263 - protein, 317 aa, Glycine max
  Coding DNA Sequence Number=SeqID_43578
EMAPRKLASKRSRKDKATEGTSSAPEYDSHHFRSAEHQQRFEAIKGWSFLRERCVQLKDDEYTDSQEEIVRRRWASLVTPMAKFDPDIVLEFYANAWPTEEGVRDMRSWECEYGQRRNRSDGFDEEAIAHLLCIPGQDFARTAAGRRVRIMRTNMTTLTQIWMTLLLSNIQPSDHNSDLPLPKCQLVYAILTRMSIHVAQLIADAIYLFAGMAPTRHPLDPDKSNRALGFPALITGLCQSFGVPVAPNKAADAPPPYQAGPAGSFDTEQYLWHLVHQQAANHWAHRSHGLEIRLRPGQERHQQRLPTGQMRPARTRR

SEQ ID NO: 135264 - protein, 67 aa, Glycine max
  Coding DNA Sequence Number=SeqID_43579
MEQRKRTSSARVNGRRSSVSYHGRRSSVEMTNKAKGKDKEVAGKGSAGKRKGAFDDDKTGGGQKRNK

SEQ ID NO: 135265 - protein, 43 aa, Glycine max
  Coding DNA Sequence Number=SeqID_43580
MESYLQHLVRQQAANHWGQGQGFAPFACPTPEQFRAEVTWPGD

SEQ ID NO: 135266 - protein, 48 aa, Glycine max
  Coding DNA Sequence Number=SeqID_43581
MRKRLQEDWARAAEEGPKVLMNLRGSIMQVGYPRNIGFFSPCILGHLD

SEQ ID NO: 135267 - protein, 133 aa, Glycine max
  Coding DNA Sequence Number=SeqID_43582
MNVEERLKSSHNYSRVTKMLRKRLGLDFLHGNNFPQQFRENKKCQEGRTPFLFTPSPIYSKIGEELATQLAQASSARPGEQGCFLQKQPPSRGRNWKAKLSKKLRKLTDCAKTPPFGFRHITEFHGSRKPASF

SEQ ID NO: 135268 - protein, 84 aa, Glycine max
  Coding DNA Sequence Number=SeqID_43583
  Gene Ontology: Mol. function=DNA binding; Cellular component =cytoplasm; Biological process=regulation of transcription, DNA -dependent
  Homolog annotation: Hit_ID=A9P928; Match level="QueryCoverage=66%, HitCoverage=23%, E-value=2e-15, Identity=60%"; Hit description =Putative uncharacterized protein
MLGLVLFGRIKSKLLNPNSSYMIFKFIITCDDDEERSSLKASRGCSRSSTCQGCSTCYCEGCIKCHFEDCNCQECRDFMLYAKP

SEQ ID NO: 135269 - protein, 59 aa, Glycine max
  Coding DNA Sequence Number=SeqID_43584
MKEDLKKTLKFLDATNETNLATSKQIVLQMKNGLRNVIRKEKEINLLTKDYESDENISQ

SEQ ID NO: 135270 - protein, 43 aa, Glycine max
  Coding DNA Sequence Number=SeqID_43585
MGVSLAIIEASLGIFLRKLLKEEVFSKKLLKEVFSRKLLKEAT

SEQ ID NO: 135271 - protein, 173 aa, Glycine max
  Coding DNA Sequence Number=SeqID_43586
TPTQAKFDRSRFTSQEAWERYTDIVVPRKLLLERNVVVYYTKFDEFKEELERRHWDEKLIDFDDSSIDIAIVKEFYANLYDPKDKSPKQELAAKLCIPGRGFELNADGQPLKILRKNMTTLAQTWSVLSFSNLIPTSHTSDVTLDRAKLIYGIMMKMDMNVGYLISHKISLIA

SEQ ID NO: 135272 - protein, 217 aa, Glycine max
  Coding DNA Sequence Number=SeqID_43587
MANQEEWVPFMDVLALLIFGVVLFPNVDGLVDLAVIDAFLVYHHSKESPAVAVLAGLFDTFDQRCKKSSARINFKVIQRVHKAWENPLRKDKELTGIRNGIIGGYHEWLKVRTRGLDWLAKLKIINEENFEAPEEDEEVRALKTKLGKESLAKEKFKLVATEVRKECVGLREENAATTKALEQETKRARKEEHDRDKFRGALWGSNRELKLRREERD

SEQ ID NO: 135273 - protein, 199 aa, Glycine max
  Coding DNA Sequence Number=SeqID_43588
  Homolog annotation: Hit_ID=Q6WAY6; Match level="QueryCoverage=50%, HitCoverage=18%, E-value=5e-13, Identity=36%"; Hit description =Putative uncharacterized protein
TINWFPRWKEGKEGVLFSCGDYPNVPLIGTRGCINYNPTLAIRQLGYPMRGAPMEESLSPFLVKDFGAQSLKIVQRVHKAWESPLRKDKELRGIRNGIIDGYHDWLRVHTRGLDWLSKLKIINEENFEAPEEDEETSGKSVPNYERKMWLPQEPSNEKPRGLAKKSMAEINSEELCRAATMSSSSGERKETSHEYMAWS

SEQ ID NO: 135274 - protein, 150 aa, Glycine max
  Coding DNA Sequence Number=SeqID_43589
KEGVETRIVITERAGWTKSVSYLCFPLISDERYLAPFVAQYVKSRDVPKIKRKQAYAIRENSVMPTWAFQILPPEGCCFWRKQPGSPGRAGEKGFSLLGTSYSLEIAEEIISVKKIQAEALLYVSVSNYAKIFDRSSKFIVRSSFSSVFN

SEQ ID NO: 135275 - protein, 48 aa, Glycine max
  Coding DNA Sequence Number=SeqID_43590
MKKQQWKRSGRQRKRGERRRHPLRNKPWKKELHHQDEPWIRSLERMLQ

SEQ ID NO: 135276 - protein, 190 aa, Glycine max
  Coding DNA Sequence Number=SeqID_43591
  Homolog annotation: Hit_ID=A5BU47; Match level="QueryCoverage=73%, HitCoverage=7%, E-value=7e-07, Identity=27%"; Hit description =Putative uncharacterized protein
MSQYTLKRTRKATRLRSLATRPPGAERLVVNVDPANGKANGPHKKKLRIYLGIVARDKVDVTYETWKEVPVAQKDLIREDIQAEFEILEASDSRKKKKIFETVSEWWRQFKSDLTKKWALAADKDGVDDTICEKYDISKEKWAQFCQTRRDPSWENKRSWLRRQSKDWRKLASPEALRASLTLHLPSDAT

SEQ ID NO: 135277 - protein, 247 aa, Glycine max
  Coding DNA Sequence Number=SeqID_43592
  Homolog annotation: Hit_ID=Q6WAY6; Match level="QueryCoverage=100%, HitCoverage=45%, E-value=3e-27, Identity=32%"; Hit description =Putative uncharacterized protein
LSLIVEEFEEILGCPLGERKPYLFSGFYPSLARISKIVQISVQELDHKKQVENGEVGIPRKYLEAKARILAGKGEWAPFIDILALLIFGGVLFLNVDGLVDLAAIDAFLAYHNHKESPVVTMLVNLYDTFDRRCEKSNTRIVCCTPALYVWLVSHLFRQEQAKKEHLSTGSLDGRKEEPEFLSCGGFPNVPLMGMRGCISYNPVLAIRQLGYPMRGAPLEDELTPVISRDFNKTNIETVQKVRKAWE

SEQ ID NO: 135278 - protein, 120 aa, Glycine max
  Coding DNA Sequence Number=SeqID_43593
MLMCNEQYSCVGPIELLCTINRTLDGILKQLQSIITPTHDAIMYYNGKWNIPRQGGFLGYSFTGTNLIRFDIPSGCSMGKLKDIIKQVAPMGVPPYGIHKSQVVRQLFFRQPGHAKYLEN

SEQ ID NO: 135279 - protein, 42 aa, Glycine max
  Coding DNA Sequence Number=SeqID_43594
MENAKQMVTPMSTACYLDEDEAGQSIDIKKYRDIKPIPNNLT

SEQ ID NO: 135280 - protein, 100 aa, Glycine max
  Coding DNA Sequence Number=SeqID_43595
MNSKKLFPEELLTTGGSSFGMRMLNFWKKFFRKLQCLISEEVVPKDTSGTISSGIGHINFRKKFFRKLLCSIPEEVVPEVSSGTTSGIDDINFRKKFFRN

SEQ ID NO: 135281 - protein, 128 aa, Glycine max
  Coding DNA Sequence Number=SeqID_43596
  Pfam annotation: Domain name=zf-CCHC; Domain location=78-95; Score =20.2; E_value=0.0014; Accession=PF00098.14; Description=Zinc knuckle
MEMGGDLHDHINKFNRLEQALLLLVSLPKSSKALVQTLLVGRSTLNLDERGRNHSRRHDGLRGRSKSQSHPQRDMSNIQCYYCGENDHVQVRCKQMKEDLKKLRDMNKDGVNSQANVVKSVKDEVHAY

SEQ ID NO: 135282 - protein, 60 aa, Glycine max
  Coding DNA Sequence Number=SeqID_43597
MRDGKRSSYVIGIGVNYGVGLGGKFLIALEPAPKWALPAGRVVVGAGAWGASFWMGAGAL

SEQ ID NO: 135283 - protein, 161 aa, Glycine max
  Coding DNA Sequence Number=SeqID_43598
MGLRTKVGEWRIALGNPYAWLQTHGWRMHERQSIHGAPNKRGEWRIALGNPYAWLQTHGWRMHERQSIHGAPNKSGEWRIALGNHYARLQTHGWRMHERQSIHGAPNKSGEWRIALGNYYTWLQTHWWRMLERQSIHGSSEQKWRMENCTRAITTHGLHTR

SEQ ID NO: 135284 - protein, 142 aa, Glycine max
  Coding DNA Sequence Number=SeqID_43599
MDNKEGVQEQMKADMSALKDQMASITKAMLKIQKSIEDNAMAAASKTAREAEPVLQPAMNLGRDRSATGFNRRYSPQAYPYGLPPDFTPRTAPNDLRQAPTFEGQLPLHADYPLQEDDEGDAHLGPLLPLKELDPMSCPNQT

SEQ ID NO: 135285 - protein, 97 aa, Glycine max
  Coding DNA Sequence Number=SeqID_43600
MELSPMLMSCKILLIVVLTWGWGASTTHGPLYTWTNGKMWSKLDRALCNQSWFNSFGNSACEVMKFISISDHTPLVVTTELVVPRGVQQHLQPSGAS

SEQ ID NO: 135286 - protein, 66 aa, Glycine max
  Coding DNA Sequence Number=SeqID_43601
MVVSFFLTHLLLEVASPIIFLLHSAAIKLQEAKDSIDEEDPRPTSSMELHHVVLSFFSHNLLVLNL

SEQ ID NO: 135287 - protein, 43 aa, Glycine max
  Coding DNA Sequence Number=SeqID_43602
AEAPTRKNHNLGTNMSHHSSSVNGEGTSHKDPLSRILDELSSL

SEQ ID NO: 135288 - protein, 87 aa, Glycine max
  Coding DNA Sequence Number=SeqID_43603
MSEVEEVQEQIKADMEAMKEKMATMMKANMSMKEIMEVNVAALLRPTWALQNIPPEGCCFWRKQPGSPGRAELAWASWAATTSPILL

SEQ ID NO: 135289 - protein, 100 aa, Glycine max
  Coding DNA Sequence Number=SeqID_43604
MTRDNASELQPFDPEIDRTFHRLVRHHFVPFDHPEHSITGEFVHSVIGDFEHPDFEHSDFEHSENMAQPPPRERTLREMTLPDFTYESLCIQYPDEDVPY

SEQ ID NO: 135290 - protein, 238 aa, Glycine max
  Coding DNA Sequence Number=SeqID_43605
MGNSPLRKDQELRGIRNGIIGGYQEWLKVHIRGLDWLAKLKVVSEESFEAPEEDEEVQALKSELGKAKLAIGEVQVWPFLYPFGRSVPDQEGSKIEYGRNKFRGALWGSNSELKLRRTEKATMSLKEQMVSMKEELVAMLGMSVSAFHGEERRPPASFAKSESHRVCLPKNNSRTGKVIDTGARWQPSPGIQPSDAYPYGLPAQLLTTRLVTKKAMRAHIASPPKRAPSTARRNPGIL

SEQ ID NO: 135291 - protein, 187 aa, Glycine max
  Coding DNA Sequence Number=SeqID_43606
  Homolog annotation: Hit_ID=Q652R5; Match level="QueryCoverage=27%, HitCoverage=20%, E-value=2e-14, Identity=72%"; Hit description =Putative uncharacterized protein P0603C10.50
  Subcellular localization annotation: CTP_CleavageSite=34; ConfidenceScore=5.14e-01
LGTVTQLPVHPASPVLLTKNGPLGALDSMARLNRAAAPSYLFKSFAPIPKSDERFARQYRCGPPPEFPLASPRSGIVHHLSGPDRYALTRTLHRRSGSVGGATHRGIPPISFLAPYGFTRPLTRTHVRLLGPCFKDGPNGEPTGRRQERAGAEARQGRALPSTIAMMTSPPSISTAPGLGATIAIRV

SEQ ID NO: 135292 - protein, 69 aa, Glycine max
  Coding DNA Sequence Number=SeqID_43607
EAKGASGNRLPACVIDYTEGWVTGNRLPDASCAAQLVMQSYPARALARRLQVDWARDPRKGPRVLMSLR

SEQ ID NO: 135293 - protein, 114 aa, Glycine max
  Coding DNA Sequence Number=SeqID_43608
DTARRSRTTERSESVSEEAEERPIRKPPLPRALADSLMQLARQVSRLESGHYDHDYEFELGTQLAKQIADKSSNNFGANMENNTKEECKDVMTRSKRFMDVENDESVVYKEQMS

SEQ ID NO: 135294 - protein, 193 aa, Glycine max
  Coding DNA Sequence Number=SeqID_43609
MGDQEETQEQMKADISALKEQMASMMEAMLEMRQLMEKNVATAAAVSSDAEADPTLLATARHPPSNAVGRGRNTQGHNGNPHLGYNRAAYPYGLPPNYSPPVMQDDAGHISSPILQGEPPQQPEEVHEDPEDYAQRDVEFYPPVPEGPAPNTLPQPNLTAQPIVLSMEGPPPATEERRKLDLLEERLRAVGIL

SEQ ID NO: 135295 - protein, 92 aa, Glycine max
  Coding DNA Sequence Number=SeqID_43610
  Subcellular localization annotation: CTP_CleavageSite=61; ConfidenceScore=5.19e-01
MLVRMIRTRHFVAARVKSCPGMHSSCAIASLSGYARTVWIWSTLKTRMRSPLKARACNPLQARTYSPLKVIGTSTQGSTFMRKQEIDSSRGP

SEQ ID NO: 135296 - protein, 212 aa, Glycine max
  Coding DNA Sequence Number=SeqID_43611
  Subcellular localization annotation: CTP_CleavageSite=40; ConfidenceScore=5.13e-01
MIGTSKPYTGAMRGIVHEPQVNVGADSKFSPNRFPATRFLTSNVQSCEFGMIDPLDESITCFLIRVDPWVLVLITLRGLHVLALRGLHVLAIRGIQVLALRGLHVLAFRGLHVLDFRGLHVLTLRGLHALAIRGLHALTFRGLHAHRLQRAAHPCLQRATCPHLQRATRPRLQRTPRPRLQRTARPRLQRSARPCFQRATCPYLQRDTRPRL

SEQ ID NO: 135297 - protein, 226 aa, Glycine max
  Coding DNA Sequence Number=SeqID_43612
  Homolog annotation: Hit_ID=A5BZH4; Match level="QueryCoverage=37%, HitCoverage=13%, E-value=3e-07, Identity=38%"; Hit description =Putative uncharacterized protein
MSLHSSSSVNGEGSTPKDPLYKILDELRSLKLWKEKQERKEKGRHRSHLRPHSHRREKERKPQEANINLPYLYGKDNVEAYLDWDIRVEQQLKRKSTFKSYGSHSYPKKDQGLGILGETPSKPKDDKGKTIEKQPPKASMQEKTSFIKCFKCLGRGLVTSQCPTNKSMIMRGQDIYSSQDEATTSPSSSESEEAKGEESNEEIYHQEEGQPLMVKEECKEISVSSK

SEQ ID NO: 135298 - protein, 73 aa, Glycine max
  Coding DNA Sequence Number=SeqID_43613
MTFMGLRKKSGEWRIGEQHYAITSRGSRPEALGNDIHGAPKKSGEWRVGEQRYAITLRDCRLEGGGHMNSARQ

SEQ ID NO: 135299 - protein, 198 aa, Glycine max
  Coding DNA Sequence Number=SeqID_43614
  Homolog annotation: Hit_ID=Q6WAY6; Match level="QueryCoverage=94%, HitCoverage=37%, E-value=2e-14, Identity=28%"; Hit description =Putative uncharacterized protein
ASINWFPRWKEGRTGVLILCGGFPNVPLMGMRGCISYNPVLAIRQLGYPMRGAPLEEEIAPVISRGFNKTNVEMLQKVRKAWEVVRKKDKELRGSNNGPIGGYRKWEEVEAPEEDEEVQALRTELEQAQTVKERFKSAALKIRKENAELRDINIANTKALEQETKRARREEHGRNKFRGALWGNNSELKLRREEKDQS

SEQ ID NO: 135300 - protein, 110 aa, Glycine max
  Coding DNA Sequence Number=SeqID_43615
MSHHSSSVNGKGRHRSHLRPHSHRREKERKPQEVNIKLSYFHGKDNVEANLDWEIRVEQQLKKKSTSKSDGSHSYPKKDQGQGILGVTPSKPKDDKGKTIEKQAKMRLLL

SEQ ID NO: 135301 - protein, 185 aa, Glycine max
  Coding DNA Sequence Number=SeqID_43616
ETALRNLSSKRSRKDVVAEGTSAAPKFDSHRFRSAEHQQRFEAIKGWSFHRERRVQLKDDEYTDFQEEIARRRWTSLVTPMAKFDPDIVLEFYANAWSTEEGVRDLRSWVRGQWIPFDADALSQFLGYPLVLEEGQECEYAAMHTRLGFYPDRCRETGADHVHQQDYLDPDMNDVAAQQHPAQRS

SEQ ID NO: 135302 - protein, 101 aa, Glycine max
  Coding DNA Sequence Number=SeqID_43617
MARRNTWWGLVWFKDKRDAPHYFHDTNAKMMIWKFYAKLDMTKSKGKDPLEGLGGPMTRARARKAKEALQQVLSILFEYKPKFQGEKSKVVSCIMAQMEED

SEQ ID NO: 135303 - protein, 75 aa, Glycine max
  Coding DNA Sequence Number=SeqID_43618
MAQPPPRERTLREMAAPDFTYESLCIQYPDEDVPYVLKTGLIHLLPKFHGLAGFSSFSGGSGKGLVVLDNSVERA

SEQ ID NO: 135304 - protein, 164 aa, Glycine max
  Coding DNA Sequence Number=SeqID_43619
MNEERMKNGGKPSRICSQKHLGSVTEAPRLGFSSRKQFFSPKTAEMHSQGGKGGGGCRPAHPSELGCFLHKQPCFQNALEGPRFENLKLAICTPILISSPPFFVIYEKVMEALRKHIGLDFLLFPLPFHQYQVKYAYPRFSEILRKHYGSPESPGSHFLTKRGR

SEQ ID NO: 135305 - protein, 174 aa, Glycine max
  Coding DNA Sequence Number=SeqID_43620
METYPMAKELLQGMMDKGLIEVCRARKGEGDVRMQSVDKSPSKPKPLVIHCTRDVATQKPRGFQPILVKKPTPFPYKSDKVVLWKYVAQGSDGRKDASIVHVMDDLSSTKVTNISGMSGMIRSGRIIAAPELPARSKDPKGKSKVEKGDDFSKMGIFTEEATEFLRIIQQSEFK

SEQ ID NO: 135306 - protein, 174 aa, Glycine max
  Coding DNA Sequence Number=SeqID_43621
RTTRPRLQGYTSSHSEDYTSSPSEDCTPSPSEDYMCSPLEDYTSLASEDYTPWPLEDYTSSPSEDYMSSPSEDYTSSPLEGNTPSHSKGYTPSPLEDSYVLAFRGLHVLAFRGLHALTFRGLHVLAFRGLDPSLNRAARPHLQRATRPAFRGLHVLTFRGLHVLPFQRTTCPQL

SEQ ID NO: 135307 - protein, 17 aa, Glycine max
  Coding DNA Sequence Number=SeqID_43622
MVAATNTVAKCEPDAPI

SEQ ID NO: 135308 - protein, 89 aa, Glycine max
  Coding DNA Sequence Number=SeqID_43623
  Subcellular localization annotation: CTP_CleavageSite=38; ConfidenceScore=5.23e-01
MNCVFVHVSSTFEFGAMRSDCLVQFSILNSFRSPKNCVFVHVSSHFDGAMRSDCLVKFSILNLFRSPKNCVLIHVSPPSEFGAMRSDCL

SEQ ID NO: 135309 - protein, 260 aa, Glycine max
  Coding DNA Sequence Number=SeqID_43624
  Homolog annotation: Hit_ID=Q6L477; Match level="QueryCoverage=74%, HitCoverage=36%, E-value=8e-09, Identity=22%"; Hit description =Putative uncharacterized protein OSJNBa0009L15.8
  Subcellular localization annotation: CTP_CleavageSite=26; ConfidenceScore=5.43e-01
MATPPSSPSPTGAASHSPSTLKRTRKATHLRSLSTRPVGAERSLIHVDPEIEKVDGPHRKKLRTYLRIVARDKVDVTYENWKQVPAAQKDLIWEDIHAEFDIPEASYLRKKKRKYFRLWGSVDKDSVDDTVCEKYDISKEKWAQFCQSCRDPSWEAIWKQNSAPHMLSCGGYEFLENKLLEEKKKKQLAKAAKSGSTHTVIDPLSPIRRHVKWKMNRTKKAGQMTSETIKEIADKIVSLTGFLCQDVLIAAIGRPEHPGR

SEQ ID NO: 135310 - protein, 100 aa, Glycine max
  Coding DNA Sequence Number=SeqID_43625
MLPFDFRHVTKLHGFPNDGCQVPQSGQTRVASQQTDGPRTKLGYDTGHSMPISVRSKRTLVDFLDHVVHLFGIHASQEGHVMVSFVQDGTTHKETNSQSP

SEQ ID NO: 135311 - protein, 161 aa, Glycine max
  Coding DNA Sequence Number=SeqID_43626
MISQWNNRAEFRVDVYPRQEGLLGYNSDYMVWYRRKTKMFVDPNNANTAALGDVVETLQYMVSPQGRNTWTVDDLVPYLDKLAIISEEQERITEPVSHGPASEREFPAQEFHILQSSVETRGIGRRRELVEAEQYSQQMMERGHGMYYTPTTFSEYPSQMY

SEQ ID NO: 135312 - protein, 110 aa, Glycine max
  Coding DNA Sequence Number=SeqID_43627
  Homolog annotation: Hit_ID=B0HC01; Match level="QueryCoverage=30%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTRFMRALGPSLAFLAQSSWIEDSKKIEPEMEEKALGFS

SEQ ID NO: 135313 - protein, 62 aa, Glycine max
  Coding DNA Sequence Number=SeqID_43628
MCISWGSLGHSIEHCMTLRRKDFQVQAIGQFAQATCAPEFGLPRPFNQRLLVLHVGGVVVKQ

SEQ ID NO: 135314 - protein, 105 aa, Glycine max
  Coding DNA Sequence Number=SeqID_43629
MVKVGTSYVPINVHFRQKLAQGFPGINSSLPRIYLSVLRKVIFRHSQAYSQYRRRGNARAIECGLRYYQLALKGGCVILAYYVGYTDEGVSEAFVKKATVLSMNM

SEQ ID NO: 135315 - protein, 212 aa, Glycine max
  Coding DNA Sequence Number=SeqID_43630
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=9e-23, Identity=98%"; Hit description=LacZ protein
MKHFTDTLISANIGTKAGTGPPLEVDGIDKLDALYVWLVSHSFRHESRPVCPLQGHHMCAKKGKMIWEKLLAGLAIHPLSAPLLRLSASNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 135316 - protein, 79 aa, Glycine max
  Coding DNA Sequence Number=SeqID_43631
MAEINQGKTMTGHDWPHIVCLLLAVLVCFLCLISRIEDLNEKALGLCCILKQWGMPHCPHSLAIYVQTCAHQVLGEMPQ

SEQ ID NO: 135317 - protein, 95 aa, Glycine max
  Coding DNA Sequence Number=SeqID_43632
MYKENWTQTWPMGSKIYPTVHENPRAFFSSSSPILLEPLAHGSSDWSLPREDCISYHYWKTRMQIFIEAIDYNIWEAIEIGPYVASIIDGSTSTG

SEQ ID NO: 135318 - protein, 96 aa, Glycine max
  Coding DNA Sequence Number=SeqID_43633
  Subcellular localization annotation: CTP_CleavageSite=35; ConfidenceScore=5.34e-01
GGGAYGSKAVCRGLSFPVKYRIPGSSRGNLRPVLSLSARRSNDRAVGAQSGNAAYSESYSHIHADAPSLFFTNAFDWEHPGVISANIVIAVYTSAL

SEQ ID NO: 135319 - protein, 98 aa, Glycine max
  Coding DNA Sequence Number=SeqID_43634
MLQCERYFSLLRHIIEIPNGENSRNWVANVILKFHNDPTVNESEIVIFLRQVRWPTGKREGVGRREKNEIEHLYRMTPKASTLKSPSASLPPDSMRLK

SEQ ID NO: 135320 - protein, 116 aa, Glycine max
  Coding DNA Sequence Number=SeqID_43635
MEPIASLSQYYDQPVRCFTFEDFQLVPTVKEFEEILGCPLGGRKPYLFSGFYPSVATYPSAGGRRVTRGMRVPRKESARSRHQRLFEENVGKTGKDAIYELLSERFGSCIYARGRY

SEQ ID NO: 135321 - protein, 234 aa, Glycine max
  Coding DNA Sequence Number=SeqID_43636
MASLVIINEENFEALEEDEEVRALKNELGKARLAKEKFRLVATDVRKECAGLREENVATTKALEQETKRARREEHGRNKFRGALWGSNNELKLQREERDQSRVDSLILKDELKACSRSKRSLSQHLCETETNMLAIISKYQEELSLATAHEHRVADEYAQVYAEKEARGRVIDSLHQEATMWMDRFALTLNGSQELPRLLAKAKAMADTYSAPEEIHGLLDYCQHMIDLMGPYN

SEQ ID NO: 135322 - protein, 141 aa, Glycine max
  Coding DNA Sequence Number=SeqID_43637
ALAADQDSVEETVCEKYDISKEKWAQFFQTRRDPSWEDVRKKAQAIQKQNTAPHKLLAEKTKKKLEEATQSGSVDGVIDPPYPVRHHVKWKMTHTKKTGEKTTEAAKEIAEKIDSFEEQATQGSFVPHGRQDVLVAAIGRP

SEQ ID NO: 135323 - protein, 155 aa, Glycine max
  Coding DNA Sequence Number=SeqID_43638
  Homolog annotation: Hit_ID=Q6WAY6; Match level="QueryCoverage=96%, HitCoverage=31%, E-value=3e-08, Identity=29%"; Hit description =Putative uncharacterized protein
LKELGRLMGPLQRQAFRKVYGKILDLTATEVFTEAVISLAQYYDPAVEVLHVWGLPNAVVGDSARELDRMKQTRNGVVGLPRKYLEGKARDMASQEKWGAFADILALLIFGVVLFPNVDGLVDLAAIDAFLAYHHNKESPVVAILADLFDTFDRR

SEQ ID NO: 135324 - protein, 125 aa, Glycine max
  Coding DNA Sequence Number=SeqID_43639
GTDPGTLWTLDKSNRALGFPALITGLCQSFGVPVAPTKVIRSPITRAFIEKYYTQRQAQGDAPQAAGAPPPHQADQFRAEVACPGDWPEAQTGEAPPEAPDDGEEAHEDEEMTDLLDFLGGSGAT

SEQ ID NO: 135325 - protein, 132 aa, Glycine max
  Coding DNA Sequence Number=SeqID_43640
  Homolog annotation: Hit_ID=A7QNA6; Match level="QueryCoverage=36%, HitCoverage=5%, E-value=2e-10, Identity=64%"; Hit description =Chromosome chr2 scaffold_132, whole genome shotgun sequence
MSDSANKLRLVRFPKCQNLLLELADYSVYQCGGCGAVLRAKHKGYVSGSLSDEGKVGLGGDSEDTGEKGVIDDDVDVGKNKDELGKTIGREQEKPPKSQIGCENGSKFSNWPNEREVRWKGFGESHELIWKI

SEQ ID NO: 135326 - protein, 80 aa, Glycine max
  Coding DNA Sequence Number=SeqID_43641
  Homolog annotation: Hit_ID=O52175; Match level="QueryCoverage=63%, HitCoverage=58%, E-value=2e-21, Identity=98%"; Hit description =Salmonella berta plasmid pBERT, complete plasmid sequence
MAYNGAEFLDQMATPWKIVKGVERLRRQSRFSIGSAPLTSITKSDAQISGGETRQDYKDTRRFPLAAPSCALLFLPFGLP

SEQ ID NO: 135327 - protein, 127 aa, Glycine max
  Coding DNA Sequence Number=SeqID_43642
  Homolog annotation: Hit_ID=A5BMB6; Match level="QueryCoverage=91%, HitCoverage=36%, E-value=3e-09, Identity=25%"; Hit description =Putative uncharacterized protein
MDEYFRVSNCKNANDMWDTLQLTHEGTTDVKREWQPREHEMELMRLNQHEENDKKKKGLALKVSSSIQEGSDKEDSNEVDEDDDFSLFVKRFNKFIRVRGKQRRLNFKSKKRAEDSSSTPKCLNAIN

SEQ ID NO: 135328 - protein, 244 aa, Glycine max
  Coding DNA Sequence Number=SeqID_43643
MTIGLPPGQRARATSIRALFHQAFVQGEDRQFHPNGALFHPGERGVRAEAGILEAPAAFHQLLATHHPRRALDPMRQLGQFAGLLALHQSLEGLQVLAVAGQQFVEQPPEHRRLAAGQRMQGIQVVETGGRRYGDGFGIDGDGQLVGGEAQGQQALLEDIEADGLDQALVHSSLDAALDLLRLGVRGEADDDHRLLAILALLLADRAGKVGAAHQRHVAVGDDHVERLPMPQVESAQAVLRFLH

SEQ ID NO: 135329 - protein, 80 aa, Glycine max
  Coding DNA Sequence Number=SeqID_43644
MPYRGLKKKHQRMTPIEHFLIDSIQIIFRDTIEITIADIGHCKATTEVAFLFGVAVKIYYEGDENHETGQIQAKGPSGEG

SEQ ID NO: 135330 - protein, 229 aa, Glycine max
  Coding DNA Sequence Number=SeqID_43645
FDADALSQFLGYPLVLEEGQECEYGQRRNQADGFDEEAIAQLLCIPGQDFARTAAGRRVRIMRTNITTLTQIWMTLLLSNIQPSDHNSDLPLPKCQLVYAVLTQMSIHVAQLIADAIYLFAVPVAPSKVIRPPITRAFIEKYCTQRPAQGDAPQAADAPPPHQAGPARSFDSEQYLRHLVRQQAANHRAHVLTHDCLYQLSLNLQSQGFTSFPCPTPDQFRAEVAWPGD

SEQ ID NO: 135331 - protein, 115 aa, Glycine max
  Coding DNA Sequence Number=SeqID_43646
MVSQIPNPRVDPSQYCDLKISNINNKRNRSKYEDLHCMGTKNLPRWIHEMTTKAKGVQPSRVEIYFDTRTQKDGSVVIEKATIVIDELKKKIVEVESSQNLQSTQDSTNWTNDIY

SEQ ID NO: 135332 - protein, 85 aa, Glycine max
  Coding DNA Sequence Number=SeqID_43647
MEALSSGMMDLNYQRHQHLVALRIIFAHETPGNRRGIHSRAMKTFQFAHGKRCNKGEHYPISPAHRLSLPYEIPDEHSSGGQECE

SEQ ID NO: 135333 - protein, 207 aa, Glycine max
  Coding DNA Sequence Number=SeqID_43648
SQTVKERFKSAAIKIRKENAELRDVNIATTKALEQKTKRTRREEHGQNKFRGALWGNNSKLKLQREERDQSRVDSLILKDKLKVCLRSKRSLSQCLCKTETNMLAIVSKYQEELNLATAHEHKVADEYARVYAEKEARGRVIDSLHQEATMWMDQCALTLNGSQELPRLLAKAKAMADTYSAPEEIHRLLGYCQHMIDLMTHIIRNC

SEQ ID NO: 135334 - protein, 59 aa, Glycine max
  Coding DNA Sequence Number=SeqID_43649
MTFMCLRKSGEWRIGGQRYAITLRGSRLEGEWRIGEQRYAITSWGSRLVGGGYMNSARQ

SEQ ID NO: 135335 - protein, 123 aa, Glycine max
  Coding DNA Sequence Number=SeqID_43650
VTGCTICGEAHELGHCIPIEEHTQEVHYMGNQQRQGYNQGGFSGFQQGPYNQQGQRKSHPGNQFNKDQGGLSNRPPQQGPNIFQRTTKLEETLVQFMQVTMSNHKSIDSSLKNLDIQVGQLAK

SEQ ID NO: 135336 - protein, 69 aa, Glycine max
  Coding DNA Sequence Number=SeqID_43651
MTKARQKRESRGGACHPAHPGELGYFLQKQPPSGGTSWKAQNLTNCATMLSFDFGHVTELHKLCNDAFF

SEQ ID NO: 135337 - protein, 32 aa, Glycine max
  Coding DNA Sequence Number=SeqID_43652
MENSKHLATPMNTSCYLDKDESGQPVDAKQYR

SEQ ID NO: 135338 - protein, 268 aa, Glycine max
  Coding DNA Sequence Number=SeqID_43653
  Homolog annotation: Hit_ID=Q6WAY6; Match level="QueryCoverage=66%, HitCoverage=28%, E-value=8e-20, Identity=35%"; Hit description =Putative uncharacterized protein
MGTNQTGKRFYQVKVKSLDTTSIKELGRLMKPLQMQAFRKTYGKILELTIAGGVHRSHCITHPILRPAFEKLHKDSARGLDRIKQTRNGIAGLPRRYLEDKARGMSNQGDWVPFMDVLALLIFGVVLFPNVDGLVDLAAIDAFLAYHHSKESPVVAVLVDLIDTFDRRCEKSSAQIICCLPALCVWLVSHLFQQDTRHPCPLLSHRSCTEKRRIDWDQLLAGIGGRTINWFPRWKEGKEGVLFSCGGYLNIPPIGTRSCINYNPALAI

SEQ ID NO: 135339 - protein, 76 aa, Glycine max
  Coding DNA Sequence Number=SeqID_43654
  Pfam annotation: Domain name=G-patch; Domain location=1-42; Score =18.4; E_value=0.0011; Accession=PF01585.14; Description=G-patch domain
MVARVMLRNGFEPGMGLGRDCLGNADMVDIKGNPYKYGLGYEPGMPGRRWPIGYGPAVLASVSPALEWCPRRRWLQ

SEQ ID NO: 135340 - protein, 197 aa, Glycine max
  Coding DNA Sequence Number=SeqID_43655
METCLEVEELLQRMIDQGRLEVGIEGKEEQHICMQSMEGSGVAKPKPLVIYFTKSAASQKPGHPLMAKPVPFPYQNSHAVPWRYTPPGKKEEEVTDVSSLSAKVTNITGLSGVTRSGRVFAPPDLPVQPADVKGKGKVVEEQDGEAPHASNKDIPAKGPPEKKDGRKEVSLEEASEFLRIIQQSGIQGYRTAQQNPG

SEQ ID NO: 135341 - protein, 133 aa, Glycine max
  Coding DNA Sequence Number=SeqID_43656
MVRTRGLGRALGQVTGKGVGRGDHDDSDDAPQRRRPTASARRQRVAVTADHVDEPVIPSPDVQDDPMEAPVAVEDIPADTGAEAAEDAHEGFPGGPSDPSVLTLTKSSDHVFGRHRRSGTFVRVYGAVAPGDI

SEQ ID NO: 135342 - protein, 79 aa, Glycine max
  Coding DNA Sequence Number=SeqID_43657
MAFAQDFVELSLRNKLCTLMYHEKEMALRKLSAKRSRSDATAEGTSAAPEFDSHRFRSAEHQQRFEAIKGWSFHRGGIL

SEQ ID NO: 135343 - protein, 141 aa, Glycine max
  Coding DNA Sequence Number=SeqID_43658
ARKEEYGRNKFRGALWVSNSELKLRREERDQSRAHSMVLKEELVACSRSKRSLSQRLCETETNMLAIIAKYQEELGLATAHEHRIADEYAQVYAEKEATMWMDRFALTLNGSQELPRLLAKAKAMADTYSTPEEIHGLLGY

SEQ ID NO: 135344 - protein, 139 aa, Glycine max
  Coding DNA Sequence Number=SeqID_43659
MIRGDTLRLSAPFCHPEAAGPMTSRDQVWSFCTLVSSRGGGPDDTRRYLTVIRTLLSSRGGGPDDKQRPSLAAGPMIRGVAMEKMKADMEAIKEKMGEKRRLYAMWSRHVGLHVGLHVGLHPQWSRQLSQPTLRREGDA

SEQ ID NO: 135345 - protein, 111 aa, Glycine max
  Coding DNA Sequence Number=SeqID_43660
MEAIKEKMATMMEAMMSVKKIMEANAVATAATSVVAKETHEIPHHDLANFEPCLGYAAEGQAVGGIPLQNTLEGPQYLPQPQPSRSTAVKNPHDYGRNGKVGSSRGEAQGH

SEQ ID NO: 135346 - protein, 396 aa, Glycine max
  Coding DNA Sequence Number=SeqID_43661
  Gene Ontology: Mol. function=calcium ion binding; Cellular component =cell projection
  Homolog annotation: Hit_ID=UPI00016621D1; Match level="QueryCoverage =54%, HitCoverage=41%, E-value=1e-16, Identity=30%"; Hit description =UPI00016621D1 related cluster
MHGLTFRGPHALSFRGLHVLAFRGLHDLAFRGLHALAFRGLYALTYRGLHVLPFRGLHALAFRGLHVLTFKGVHALAFRGLCAITSRGLHVLAFRGLHVLTFRGLHFLAIRRLHRAARPRHQRTTRLRLQRATPPRHQRDTHPRLQRATHPRLHRATRPRLRGLHALAFRGLYALAFRGLNVLTFRRLYAVAFKGLHILASRGLHALAFRGLHVVAFRGLHVLAFRGLHALALRQMHALAFRGLHALAFRGLHVLAFRGLHALAFRGLHALAFRGLYALAFRGLHVLPFRGLHALAFRGLHVLTFKGLHALAFRRLCALTSRGLHGLAFRGLHILTFRGLHFLAIRRLHVLAFIGLHVLTFRGLHVLTFRGLHVLAFIRVTHPGFIGLRALPPEDY

SEQ ID NO: 135347 - protein, 29 aa, Glycine max
  Coding DNA Sequence Number=SeqID_43662
PLRNSIMSYPNFVRGPLLDDMRPFFGPCE

SEQ ID NO: 135348 - protein, 73 aa, Glycine max
  Coding DNA Sequence Number=SeqID_43663
  Subcellular localization annotation: CTP_CleavageSite=43; ConfidenceScore=5.16e-01
MPTIELDFPNGKKFPGNGTKNLFHPCTTCYYGCEILSTSVPSRASNNKTVFMCSMLRTTFPNIDVSHEWTNSN

SEQ ID NO: 135349 - protein, 302 aa, Glycine max
  Coding DNA Sequence Number=SeqID_43664
  Gene Ontology: Mol. function=catalytic activity; Cellular component =cytoplasm; Biological process=metabolic process
  Homolog annotation: Hit_ID=Q7D313; Match level="QueryCoverage=100%, HitCoverage=100%, E-value=1e-141, Identity=86%"; Hit description =Dihydrodipicolinate synthase
  Pfam annotation: Domain name=DHDPS; Domain location=4-295; Score=8.3; E_value=1.1e-10; Accession=PF00701.13; Description=Dihydrodipicolinate synthetase family
MVAGLKGILPVLPTPFLADGGIDQAGMERLVIFALEKGVDGVVFPGFASEVETLDAAERASLLKIVVDAVAGRVPVVAGASAADWRDVVEHGRAASDLGIRHLMVQPPKSVGTDAPALIEFLGKVVEALPGVEIILQNAPAPRGSDLSPEAIVEIVRSLPQVTYVKEETLPAGPAISHIIAHAPSTLKGIIGGGGARYILDEYARGATAAMPALEIVEEHVAIDRALRAGRQDEARKIYVRTLPLLVLQAVYRMRLTKYVLARRGVIEGLGVRAPTPELDKAAIADIDANLVELGLVAPEAA

SEQ ID NO: 135350 - protein, 149 aa, Glycine max
  Coding DNA Sequence Number=SeqID_43665
  Gene Ontology: Mol. function=aspartic-type endopeptidase activity; Biological process=proteolysis
  Homolog annotation: Hit_ID=A7QRX9; Match level="QueryCoverage=100%, HitCoverage=18%, E-value=6e-34, Identity=43%"; Hit description =Chromosome undetermined scaffold_154, whole genome shotgun sequence
MVATTYQTSHECSKETIIDILVAGFSGQLKGCAVKTDLNGKVITNDDDKEIPDTVNTLIFTIAQHFIGDQSLWKDRSAELLSNLKCRTLADFRWYRDTFLTGVFTREDSQQPFWKEKFLAGLPRSLGDKVRDKIRSQSANGDIPYESLS

SEQ ID NO: 135351 - protein, 258 aa, Glycine max
  Coding DNA Sequence Number=SeqID_43666
  Gene Ontology: Mol. function=cation transmembrane transporter activity; Cellular component=integral to membrane; Biological process=cation transport
  Homolog annotation: Hit_ID=A4WG82; Match level="QueryCoverage=99%, HitCoverage=85%, E-value=1e-134, Identity=92%"; Hit description =Cation diffusion facilitator family transporter precursor
  Pfam annotation: Domain name=Cation_efflux; Domain location=1-253; Score=298.9; E_value=9.7e-87; Accession=PF01545.12; Description =Cation efflux family
ILAALVDSLMDIAASLTNLLVVRYSLQPADEEHTFGHGKAESLAALAQSMFISGSALFLFLTGIQHLVSPTPMNDPGVGVVVTIVALICTLVLVTFQRWVVRKTQSQAVRADMLHYQSDVMMNGAILIALGLAWYGWHRADALFALGIGIYILYSALRMGYEAVQSLLDRALPDSERNEIFSIVTAWPGVSGAHDLRTRQSGPTRFIQIHIEMEDNLPLVQAHVIAEQVEQAILQRFPGSDVIIHQDPCSVVPGHVGL

SEQ ID NO: 135352 - protein, 107 aa, Glycine max
  Coding DNA Sequence Number=SeqID_43667
  Gene Ontology: Mol. function=two-component response regulator activity; Cellular component=intracellular; Biological process=two -component signal transduction system (phosphorelay)
  Homolog annotation: Hit_ID=P0AE89; Match level="QueryCoverage=100%, HitCoverage=46%, E-value=3e-43, Identity=84%"; Hit description =Transcriptional regulatory protein cpxR
  Pfam annotation: Domain name=Response_reg; Domain location=2-107; Score=114.1; E_value=4.2e-31; Accession=PF00072.15; Description =Response regulator receiver domain
MNKILLVDDDRELTSLLKELLDMEGFNVLVAHDGEQALSLLDDSIDLLLLDVMMPKKNGIDTLKELRQTHQTPVIMLTARGSELDRVLGLELGADDYLPKPFNDREL

SEQ ID NO: 135353 - protein, 125 aa, Glycine max
  Coding DNA Sequence Number=SeqID_43668
MGEVEEIQEKMKADMEAIKEKMATMMEAMMSVKKIMEANAVAIVATSVVAKVNPTSPSGINQMNHPTSDMTHEIPHHNLADFEPWLEYATEGQAVGGIPLENTSEGPPVSPPTTTLMFHSGLKPS

SEQ ID NO: 135354 - protein, 17 aa, Glycine max
  Coding DNA Sequence Number=SeqID_43669
MADQQATESKAKGSKIP

SEQ ID NO: 135355 - protein, 244 aa, Glycine max
  Coding DNA Sequence Number=SeqID_43670
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGTIQPTEGQNRTKKQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135356 - protein, 155 aa, Glycine max
  Coding DNA Sequence Number=SeqID_43671
MVGYTPSSFTDLVFASKKIEVDPKRGKFDHPTRTTEKTGANEEGEKEGETHAVTAIPIRPSFPPTQQCHYSANNKPPPYPPPSYPQRPSLNQPQSLSTALPMTKTTFSTNQKKTHQQKGILQQKACRVHPKFRCHMLNLIPYLLDNSNGSHNPSQ

SEQ ID NO: 135357 - protein, 155 aa, Glycine max
  Coding DNA Sequence Number=SeqID_43672
  Homolog annotation: Hit_ID=UPI00006A2D9E; Match level="QueryCoverage =86%, HitCoverage=85%, E-value=2e-12, Identity=16%"; Hit description =UPI00006A2D9E related cluster
MRGPFDESISCFLIGVHPWVLEPIAFRGLHALTFRGLHVLAFRGLHALAFRGIHTLAFRGLHVLAFRGLHVLAIRGLHALAFRGLHVLAFRGLHALTFRGLHALAFIGLQALAFRGLHVLTFRGLHVLAFRGLHALTFRGLHVLTIRGLHVLAKM

SEQ ID NO: 135358 - protein, 279 aa, Glycine max
  Coding DNA Sequence Number=SeqID_43673
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDLVEMRADSLGQNISPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135359 - protein, 27 aa, Glycine max
  Coding DNA Sequence Number=SeqID_43674
MGKDVKEGEVKGILGTENYSLIAFDSA

SEQ ID NO: 135360 - protein, 641 aa, Glycine max
  Coding DNA Sequence Number=SeqID_43675
  Gene Ontology: Mol. function=indole-3-acetic acid amido synthetase; Cellular component=cytoplasm; Biological process=response to auxin stimulus
  Homolog annotation: Hit_ID=A7P139; Match level="QueryCoverage=95%, HitCoverage=97%, E-value=0.0, Identity=72%"; Hit description =Chromosome chr19 scaffold_4, whole genome shotgun sequence
  Pfam annotation: Domain name=GH3; Domain location=33-609; Score =1174.9; E_value=0; Accession=PF03321.4; Description=GH3 auxin -responsive promoter
MPEAHSHYLCNKPNGKHDGATNTSSIIEHNNKKALKYIEDVTSNADEIQKRVLAEILSSSAHAEYLQRHGLDGRTDRETFKKIMPVVTYEDLKPDIDRIANGDTSPILCSKPISEFLTSSGTSGGERKLMPTIEEELERRSLLYSLLMPVMEQFVPGLDKGKGMYFLFIKSEAKTPGGLLARPVLTSYYRSSHFKNKTHCFDPYTNYTSPIETILCLDSYQSMYSQMLCGLSQNEHVLRVGAVFASGFIRALKFLEKHWVCLCRDIRNGTIGPEITDSSVREAIMRVLKPNPKLADFIEGECKKGLWKGIITRLWPNTKYVDVIVTGTMAQYIPMLDYYSNGLPLVCTMYASSECYFGLNLNPLCDPSEVSYTLVPTMAYFEFLPLNKTKEHANSISYTEQELLVDLVDVELGQEYELVVTTYAASNNYATMHNQTGLYRYRVGDILRVAGFKNNAPQFNFVCRKNVVLSIDSDKTDEVELQNAVKNGANHLTLFGASLTEYTSFADTSTIPGHYVLYWEISMNKNNNIDQNQNPIPSSVFEECCFAVEGSLNSVYRQGRVSESIGPLEIKIVENGTFDKLMDFALSQGASINQYKTPRCVKYAPIVELLDSKTVSNYFSPKCPLWVPGHKKWCMYPLDNK

SEQ ID NO: 135361 - protein, 1204 aa, Glycine max
  Coding DNA Sequence Number=SeqID_43676
  Gene Ontology: Mol. function=histone-lysine N-methyltransferase activity; Cellular component=nucleus; Biological process=chromatin modification
  Homolog annotation: Hit_ID=A7PXL8; Match level="QueryCoverage=99%, HitCoverage=49%, E-value=0.0, Identity=67%"; Hit description =Chromosome chr12 scaffold_36, whole genome shotgun sequence
  Pfam annotation: Domain name=SET; Domain location=644-797; Score =90.1; E_value=6.8e-24; Accession=PF00856.19; Description=SET domain
GDGHASKRARMLVDYSEEDSDFEDGSLPNWKDESTFEALCGDATFSGEGSDITDPNVGSLGLLDGCMLSRVFHCLRSDLKSLAFASMTCKHWRATVRFYKKVSRHVNLSSLGHSCTDSIMWNILNAYEKDKIESIVLIGCTNITAGMLEKILLLFPGLSTVDIRGCSQFGELTLKFTNVKWIKSHSSHITKIASESHKIRSVKQFAEQTSSVSKVSILGIRDDFGELKDYFDSVDKRDTAKQLFRQNLYKRSKLYDARNSSSILSRDARTRRWPIKKSESGYKRMEQFLASRLREIMKANSCDFFMPKVAEIEAKMKNGYYSGHGLSYVKEDISRMCRDAIKAKTRGDGGDMNHVITLFIQLATRLEENSKYVNSRDALMKLWGNDPPSSLCSTSSKYKKSKENRLLSERKHRNNETHGGLDNGEYASDREIRRRLSKLNKKYFNSESETSDDFDRSSEDGKSDSDTTTTDTESDQDVHSESRIGDSRGDGYFTPDDGLHFITDEREWGARMTKASLVPPVTRKYDVIDQYIIVADEEDVRRKMRVSLPDDYAEKLSAQKNGIEESDMELPEVKDYKPRKQLENEVVEQEVYGIDPYTHNLLLDSMPKELDWSLQEKHLFIEDKLLRMLNKQVKHFTGTGNTPMSYPLQPAIEEIERYAEEHCDARTGLGVVCNKEEGFGEDDFVVEFLGEVYPVWKWFEKQDGIRSLQKNSDDPAPEFYNIYLERPKGDADGYDLVVVDAMHKANYASRICHSCRPNCEAKVTAVDGHYQIGIYSVREIQHGEEITFDYNSVTESKEEYEASVCLCGSQVCRGSYLNLTGEGAFEKPIALAGGVATCWGGVNFFGFLTRLQLLMADYSADGTKRKRPVLKEWHGILDRHYLMLEACELNSVSEEDYNDLGRAGLGSCLLGGLPDWLVSYAARLVRFINFERTKLPEEILKHNLEEKRKYFSDICLEVERSDAEVQAEGVYNQRLQNLAVTLDKVRYVMRCIFGDPLKAPPPLEKLSPEAVVSFLWKGEDSFVEELLQCLAPYVEESTLNDLKSKIHAHDPSSSGDIQKAVQKSLLWLRDEVRNLPCTYKCRHDAAADLIHIYAYTKYFFRIQDYQTITSPPVYISPLDLGPKYADKLGAGFQEYRKIYGENYCLGQLIFWHNQSNAEPDCTLARISRGCLSLPDISSFYAKAQKPSRHRVYGPRTVRSMLARM

SEQ ID NO: 135362 - protein, 120 aa, Glycine max
  Coding DNA Sequence Number=SeqID_43677
MDKLTVKIMSHSCKMVDITDEGVSYMESDDEWITEEGDDIFDEDNVQVEQPLGESDSGSNIDLNGGSLSDPTLDDIDIDNLVLNDNIEDHFLIKEELEDDGDDGDGGDIGDDLIRGLIDI

SEQ ID NO: 135363 - protein, 224 aa, Glycine max
  Coding DNA Sequence Number=SeqID_43678
  Homolog annotation: Hit_ID=A7P239; Match level="QueryCoverage=58%, HitCoverage=27%, E-value=1e-17, Identity=44%"; Hit description =Chromosome chr19 scaffold_4, whole genome shotgun sequence
MGGSGSEPGGGAAESEQELPLQHLRALRGSRKAVYDIQIQFASIGETLGLMERHGRFDSHAYEPSTIHVAEPSDIEALRSGVPLQNFGKEDFALATQEYGINGVLAIFNIGNRTGQARADFYASLNGLVQQFFQSLPMSVPLPFKHEESSVGVKGGDKGWQRGEVAVTQEDLGLLSERLKNHGFAESVSGNGGGSAEEEGDGRFNIGSIGLLGRLVIVYLLIDR

SEQ ID NO: 135364 - protein, 123 aa, Glycine max
  Coding DNA Sequence Number=SeqID_43679
GYGFRHFQGFNLAMLAKQGWKLSTDPDAILSKDATQALCDIASMLFRWWLEEVLVESWRGLKNYSLATTVLGILKIPRCSELKVPNKVRVFLWSLLEVVYQLANGFKEMASNVLLVVVLVKGT

SEQ ID NO: 135365 - protein, 133 aa, Glycine max
  Coding DNA Sequence Number=SeqID_43680
MKKWSWVRSRTLHKMSSDTISKWINSHEREMSKEKEGGEAVTAQRGGGGRNEKEEEGGGEGEWQRRNRKKEEGRRKGGEEKEKEGRKRWVREKDILKGSTSDTVQKLDDKSTNDEEVGRSKNNPSCAGDPCIF

SEQ ID NO: 135366 - protein, 328 aa, Glycine max
  Coding DNA Sequence Number=SeqID_43681
  Gene Ontology: Mol. function=transferase activity, transferring glycosyl groups; Cellular component=membrane
  Homolog annotation: Hit_ID=O23378; Match level="QueryCoverage=64%, HitCoverage=39%, E-value=5e-69, Identity=61%"; Hit description =Putative uncharacterized protein dl3665c
  Pfam annotation: Domain name=DUF604; Domain location=217-327; Score= -49.6; E_value=2e-10; Accession=PF04646.3; Description=Protein of unknown function, DUF604
  Pfam annotation: Domain name=Fringe; Domain location=81-318; Score= -98.8; E_value=0.072; Accession=PF02434.7; Description=Fringe-like
  Pfam module annotation: Pfam domain module=DUF604::Fringe; Domain location=217-327::81-318
  Subcellular localization annotation: CTP_CleavageSite=15; ConfidenceScore=5.24e-01
MFQRRKKEHGHSTLPLSTTSDLDNTATAMPPLPTIRTKTPSFKSFLLTLSILLNLFLLWAPPNSSSPSLPSSTSALISRLSPTTRRHLLFSVASSSTSWPRRLPYINLWYSPATTRALAFLDKTPPNATSADDSSPPLVISGDTSSFPYTFRGGLRSAIRVARAVKEAVDRNETDVRWFVFGDDDTVFFVDNVVRALARYDHSKWFYVGSNSESYEQNVKYSFEMAFGGGGFAISYSLARVLARVLDSCLRRYGHLYGSDSRIYSCIAELGVALTHEPGFHQEMGSENQLGLFPHLVPHNMPNQVLKCAEEFIDVPLTILFLTSFVDI

SEQ ID NO: 135367 - protein, 276 aa, Glycine max
  Coding DNA Sequence Number=SeqID_43682
MQMKSSSGEGPQHLHYVDHVDDEVHDHPEEAATDDAVTDAEGFSGEPHDTSVLMDYVYHVAAKQRLELKLSSHGRKVEKFGRPAPEIKGLVAATRLSPLIACSLDTSDQGLISAFMERVFHSFQALHVDEVILLLVELLESGSYAWRATALVHMYENLNDASKKTARQLCWIYEHFLLLLLVLLLKIITKGNHVLVVGNISDGVHLLSYTDWRGLYDNLGMCKPFSPHLVAPSLCIEDIDDRWIQFSKYIAPTKRSGTQGLRPHKFYRPSDVGHKN

SEQ ID NO: 135368 - protein, 445 aa, Glycine max
  Coding DNA Sequence Number=SeqID_43683
  Homolog annotation: Hit_ID=A7PXJ1; Match level="QueryCoverage=92%, HitCoverage=94%, E-value=2e-52, Identity=45%"; Hit description =Chromosome chr12 scaffold_36, whole genome shotgun sequence
  Pfam annotation: Domain name=zf-CCCH; Domain location=7-31; Score =21.0; E_value=0.0023; Accession=PF00642.15; Description=Zinc finger C-x8-C-x5-C-x3-H type (and similar)
MVERKQFKTKLCVLYQRGRCNRHNCSFAHGSADLRRFSASYSVYISCELRYADCYLVGVLSNGALEYVWEHGFGGKEKASLRLKVLSAMAAMVEWHGGFFDNCHRQFVKGGPLWQCHRLQWRVYMAEFWRRHRRKQDTNGQSDISGNLKVSDRVQGQVKEGKLLSSGSRNNLEEQLKKVDSDISTLQNRKFQLEVYLDESVQEVDSLNSRIRELEAQLCKEDEECKRSQVRLQRFGDQLVSDISRIGANEEDLSIDIISNGENTGLHPIAKHNVEHNDASSHKKRLHIEHDALEELKQGSSYGKYSDVDRSKDGHLVETARTRKRSRWNLSDQLKEESLGTPDNGTEVTRSLDLEGKHKKGLKQPRIEAPSTSMAAHVVDEDVDIERYDGNDINETANTENDNGAAYKVKGAPLMLPPALLPRSNYLQATTRMLMWMVDEEATGA

SEQ ID NO: 135369 - protein, 95 aa, Glycine max
  Coding DNA Sequence Number=SeqID_43684
MWALMFFFWAFPLSAPPLFVHVLFVLLDAPLILLPYHPAALGKSPCSQGGSHGKAGTNPPKMSRLGKGPATAPKPPMTDEGMRTNIDNLKWRREK

SEQ ID NO: 135370 - protein, 108 aa, Glycine max
  Coding DNA Sequence Number=SeqID_43685
MCADKSYTLNKSVVCRREKAWKLGARVKMLACRTVCRLKKRRCKKLLMNSPSEADWLSEPHPLSEAASSLSGCKTLEEDKSEINVLCAQPAHPVRTLSLLTLSTPKLA

SEQ ID NO: 135371 - protein, 75 aa, Glycine max
  Coding DNA Sequence Number=SeqID_43686
MPTSSRRLGDSSPESYSPYPAAVILLPRTMFVIITVPKTMDQLKRLSIPSEILRFFNHACHPHLAHPTRSVHLPP

SEQ ID NO: 135372 - protein, 246 aa, Glycine max
  Coding DNA Sequence Number=SeqID_43687
MATTSALVVLPPSSSAPIVLPFTILVAVSPSLLSHPCVSLDHLYISSDADSLWSATYKPEQKTPIDFVSAFDKNLIKSAGVQNAMDSAKRHQESPHKVASLEAEVAKWRATACTVWKVEHPKVANATITFVEAVRSNRQLSSKDLKVKKKDLGRKVESIATERVELAKVVAELEARLKESESRLKESELRVTKEGKTNKKLEEELVVYKKEGVKDGVLLNEEEIAAEEEAIDEEQGAAEQGNDACV

SEQ ID NO: 135373 - protein, 130 aa, Glycine max
  Coding DNA Sequence Number=SeqID_43688
MNKLGVVVLLLAQILVLHVKAHESDQAQAPLTVLNPFEHKTQTGVQLNDDQNSDHKVAVSGAIEESSSSEEEKNGEAKAAEAPQIRRIGKHHSSDKSVAGGGVIIGGLVTAIFAAVFCYIRVTRRRDTRY

SEQ ID NO: 135374 - protein, 314 aa, Glycine max
  Coding DNA Sequence Number=SeqID_43689
  Homolog annotation: Hit_ID=Q2HTA0; Match level="QueryCoverage=38%, HitCoverage=18%, E-value=1e-12, Identity=37%"; Hit description=IMP dehydrogenase/GMP reductase, related
  Pfam annotation: Domain name=DUF1723; Domain location=200-249; Score =50.5; E_value=5.9e-12; Accession=PF08330.1; Description=Protein of unknown function (DUF1723)
  Subcellular localization annotation: CTP_CleavageSite=24; ConfidenceScore=5.26e-01
MMLPEQQSRPLGPLLPAPPPPLPPSSPPRTHAPPLASCISLFFCLFIVFGGVRIKLFIIEQGNSEILCNPKYIFKLSCPIRDSLIRSNINQSGIDFQIDLHYFRSFFLCERRAVVEEGQEIYKAPEHFAVDDVKMLCLVVDLRTNQSLLNMLIMWLDRGELKLVAHERKLRDLPPFPHKEIMRLVEDLGLLPLTECSYETPDKGLFSAFVERWHHETNTFHFPIGEMTIIFDDVSSLLHILIIGDFYSYSHTSKEVVIALLMELLGVNKEDAFLETKQCIGGHLGDAGFINTKQLNGYATLMQAWIYEHFPTIG

SEQ ID NO: 135375 - protein, 91 aa, Glycine max
  Coding DNA Sequence Number=SeqID_43690
MALYAYGREPKIPGPNWCGPTVGTTTFFSAQEEAGYGHGGGGCRGVVVRAVVAVGARKESGLRVVAGVAFLCQEVFNGPLCKFESRSATRK

SEQ ID NO: 135376 - protein, 67 aa, Glycine max
  Coding DNA Sequence Number=SeqID_43691
MIKDDFKSLNPKIFLKKKKKTQKIGRGHRGQKEVVSGHVIAVDQPAKGPYLPYAARHLATALHCICI

SEQ ID NO: 135377 - protein, 80 aa, Glycine max
  Coding DNA Sequence Number=SeqID_43692
MHGASKPPVLLVIGLATNSGDMHMQASTRHSKWRHATARGTASLTGDKYFILDSACSCYYYMVSSPPSYYVVFLFGLVRM

SEQ ID NO: 135378 - protein, 127 aa, Glycine max
  Coding DNA Sequence Number=SeqID_43693
MSVLELYTEKDVAGGSMFHSANSLTLCGNYLSNDETQPPTNMSNLHLHEDDDDYYYFVSNLYVEESLDEDDSVDGISDTDNEVTEMIPPVRIVHPAEGVQGIQNPFWNDALHYNNINWSHPDEEDIC

SEQ ID NO: 135379 - protein, 951 aa, Glycine max
  Coding DNA Sequence Number=SeqID_43694
  Gene Ontology: Mol. function=extracellular-glutamate-gated ion channel activity; Cellular component=integral to membrane; Biological process=G-protein coupled receptor protein signaling pathway
  Homolog annotation: Hit_ID=A5AH90; Match level="QueryCoverage=93%, HitCoverage=93%, E-value=0.0, Identity=63%"; Hit description =Putative uncharacterized protein
  Pfam annotation: Domain name=ANF_receptor; Domain location=59-438; Score=312.8; E_value=6.6e-91; Accession=PF01094.19; Description =Receptor family ligand binding region
  Pfam annotation: Domain name=Lig_chan; Domain location=620-883; Score= 324.6; E_value=1.7e-94; Accession=PF00060.17; Description=Ligand -gated ion channel
  Pfam annotation: Domain name=SBP_bac_3; Domain location=502-844; Score=-16.8; E_value=7.3e-07; Accession=PF00497.11; Description =Bacterial extracellular solute-binding proteins, family 3
  Pfam module annotation: Pfam domain module=ANF_receptor::Lig _chan::SBP_bac_3; Domain location=59-438::620-883::502-844
  Subcellular localization annotation: CTP_CleavageSite=65; ConfidenceScore=5.02e-01
MVMGRTLFILVLCLWIPLEVVGRKEPFYSPTTVNSTVSSRPKVVKFGALFNMDSVIGRSALPAIMAAVKDVNSSTSILPGIDLQVILHDTNCSAFLGTMEGTFGAVFQSKLEFHLGHLHIEALQLMENDVVAVVGPVSSGIAHVISHVVNELHVPLLSFGATDPTLSALQYPYFVRTTQNDYFQMYAIADFVDYYRWKKVIAIYVDDDNGRNGVSVLGDAMSKKRAKISYKAAFPPEAKESDISDLLNEVNLMESRVYVLHVNPDHGLAIFSIAKRLRMMDSGYVWIATDWLPSVLDSLDSPDTDTMDLLQGVVAFRHHIPDTDLKKSFLSRLKSQRDNETVSFNSYALYAYDSVWLAARALDAYLNEGGNVSFSSDPKLRDTNGSMLQLASLRTFDGGPQFLKTILGMNFTGLSGQVEFDMDKNLVHPAYDILNIGGSGSRRIGYWSNHSGLSVIAPEVLYEKKSSKTSLKSNQELYSVIWPGEATTTPRGWVFPNNGQPLRIAVPNRVSYTDFVSKSKNPPGVQGYCIDVFEAALKLLNYPVPRQYILFGNGERNPSYNELVEQVAQNNFDAVVGDVTIVTNRTRIVDFTQPFMPSGLVVVVPVEKKSSPWSFLEPFTAQMWLVTGAFFLFVGTVVWILEHRHNPEFRGSPRKQLITVFWFSFSTMFFSHRENTVSGLGRLVLIIWLFVVLIINSSYTASLTSILTVQQLSSQIEGIDSLISSTQPIGIQDGSFARKYLIDDLNIAESRIVTLKNMEDYIDALQRGPKAGGVVAVVDELPYIEVLMSRTDCKFTTVGQEFTKSGWGFAFQRDSPLAVDLSTAILQLSESGDLQRIHDKWLNKKECATVDANSNKLALTSFWGLFLICGIACVIALIIFFARIFCQYNKFSPEPEKTDKEMQPVRSRRPSRTRSLKKLMGFKITMLNVAYGVNAHELLSDIYSSFNVSSC

SEQ ID NO: 135380 - protein, 53 aa, Glycine max
  Coding DNA Sequence Number=SeqID_43695
MVGLMRHGGLVQCGGGVGWMQWWCLGVAMELDGCVEVGCGGLGGLCEMRPGFS

SEQ ID NO: 135381 - protein, 105 aa, Glycine max
  Coding DNA Sequence Number=SeqID_43696
MMNEEFSQYRTSLANIFRCSQNQSQGIELDVHKEKASVAVMKGSHWSSMKAPIVLGTKSKKRNRLALRARTFRKKGYNIKLRDLKPDWYSYGLSYIGKQIKSFSS

SEQ ID NO: 135382 - protein, 85 aa, Glycine max
  Coding DNA Sequence Number=SeqID_43697
  Gene Ontology: Cellular component=anchored to membrane
  Homolog annotation: Hit_ID=A3BFR1; Match level="QueryCoverage=71%, HitCoverage=52%, E-value=3e-12, Identity=54%"; Hit description =Putative uncharacterized protein
MDFPLDQSVGLQVFDGTSGIGFICDLNDNIVAPWPTTSYSLPSSCNRTTKLPSLPTATSSQNGLFINTLVLPLLFTSILLPKRLL

SEQ ID NO: 135383 - protein, 893 aa, Glycine max
  Coding DNA Sequence Number=SeqID_43698
  Gene Ontology: Mol. function=4 iron, 4 sulfur cluster binding; Cellular component=mitochondrion; Biological process=tricarboxylic acid cycle
  Homolog annotation: Hit_ID=A7P0Q1; Match level="QueryCoverage=99%, HitCoverage=88%, E-value=0.0, Identity=89%"; Hit description =Chromosome chr19 scaffold_4, whole genome shotgun sequence
  Pfam annotation: Domain name=Aconitase; Domain location=53-563; Score= 660.6; E_value=1.3e-195; Accession=PF00330.11; Description=Aconitase family (aconitate hydratase
  Pfam annotation: Domain name=Aconitase_C; Domain location=691-821; Score=226.3; E_value=7.2e-65; Accession=PF00694.10; Description =Aconitase C-terminal domain
  Pfam module annotation: Pfam domain module=Aconitase::Aconitase_C; Domain location=53-563::691-821
MMRGNLTSLPKPGGGEFGKFYSLPSLNDPRIDRLPYSIRILLESAIRNCDNFQVKKEDVEKILDWENNSTKQVEIPFKPARVLLQDFTGVPAVVDLACMRDAMNKLGSDSNKINPLVPVDLVIDHSVQVDVTRSDNAVQANMELEFQRNKERFAFLKWGSTAFRNMLVVPPGSGIVHQVNLEYLGRVVFNNEGLLYPDSVVGTDSHTTMIDGLGVAGWGVGGIEAEAAMLGQPLSMVLPGVVGFKLSGKLRNGVTATDLVLTVTQILRKHGVVGKFVEFYGDGMGELSLADRATIANMSPEYGATMGFFPVDHVTLQYLKLTGRSDEIVAMIESYLRENKLFVDYNEPQQDRVYSSYLELNLSDVEPCISGPKRPHDRVPLKEMKADWHACLDNKVGFKGFAIPKEAQGKVAKFDFHGQPAELKHGSVVIAAITSCTNTSNPSVMLGAGLVAKKAHELGLQVNPWVKTSLAPGSGVVTKYLLQSGLQKYLNEQGFHIVGFGCTTCIGNSGELEESVASAISENDIVAAAVLSGNRNFEGRVHALTRANYLASPPLVVAYALAGTVDIDFEKEPIGTGKDGKNVYLRDIWPSTEEIAKVVQSSVLPEMFRSTYEAITKGNPMWNQLQVPADTLYSWDPDSTYIHEPPYFKSMTMDPPGPHGVKDAYCLLNFGDSITTDHISPAGSIHKDSPAAKYLVEHGVERKDFNSYGSRRGNDEVMARGTFANIRLVNKLLNGEVGPKTIHIPTGEKLYVFDAATRYKASGQDTIVLAGAEYGSGSSRDWAAKGPMLLGVKAVIAKSFERIHRSNLVGMGIIPLCFKPGEDADTLGLTGHERYTIELPSIINEIRPGQDVTVTTDNGKSFTCTARFDTEVELAYFNHGGILPYVIRNLIKQ

SEQ ID NO: 135384 - protein, 88 aa, Glycine max
  Coding DNA Sequence Number=SeqID_43699
MSCLECSLWRSEFSPAWWFCKVTAKKRPTGKDIVTYWSSWLGISGVRPMPKFQADSLKYTIPNNNNNNNNNNNNNNKIHITNYHIVNV

SEQ ID NO: 135385 - protein, 35 aa, Glycine max
  Coding DNA Sequence Number=SeqID_43700
MDTRLRVIGDPMNGVQRVSFQRSYFQRCIFVCCLR

SEQ ID NO: 135386 - protein, 49 aa, Glycine max
  Coding DNA Sequence Number=SeqID_43701
MGVFSDGDLREANNGDLTDSRVANNVAVNHHGNAFNDDVEGEEYDHEDP

SEQ ID NO: 135387 - protein, 198 aa, Glycine max
  Coding DNA Sequence Number=SeqID_43702
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A5BQ60; Match level="QueryCoverage=53%, HitCoverage=11%, E-value=4e-22, Identity=54%"; Hit description =Putative uncharacterized protein
MSGHRLHRALSKLKLIEEENDQRSQDARGIHRRHIHRRSRRHLRLLRRAKAQAVKVLAVLFTLRTETKVRVQARLSGQLLLSVQSSQQRRYIPHSFLGLVTEKPKENMKVHAEFRGFLTENALNSHPYEAEITALLKNPLPKIELGTEIADLEMKDSYVWVHTELNELIDVLSEERFFAVDTEQHSLRSFLGFTTLVQ

SEQ ID NO: 135388 - protein, 65 aa, Glycine max
  Coding DNA Sequence Number=SeqID_43703
MKSDATCLEEAEVLNTRGVDVLVPRVHYRDVRRQKIPNLGGEEKLVASNTRDFVTKINIYTSYLT

SEQ ID NO: 135389 - protein, 78 aa, Glycine max
  Coding DNA Sequence Number=SeqID_43704
  Homolog annotation: Hit_ID=A5AKI6; Match level="QueryCoverage=89%, HitCoverage=43%, E-value=7e-12, Identity=52%"; Hit description =Putative uncharacterized protein
MTQYKVKHLRLWIFECREPSHQGFMLGLGAAVLLGLAHAIANLLGGCNCICSQQEFEKASNCLPNFNLVVHTFLCFVR

SEQ ID NO: 135390 - protein, 89 aa, Glycine max
  Coding DNA Sequence Number=SeqID_43705
  Subcellular localization annotation: CTP_CleavageSite=81; ConfidenceScore=5.21e-01
MWTTTGEKLASQLAQASKLSKKLRKLKDCAKTPFFDFRHITEFHGSRKPASFRFLRRLGTSFIVQQRTPSIPKRLTKGCMSSSNNPGRN

SEQ ID NO: 135391 - protein, 187 aa, Glycine max
  Coding DNA Sequence Number=SeqID_43706
MVSGNRLPRECNRLPGLKTRLRNGTGGLWRPLRNRPLVIDYQIAMVAQLIHDRVEMECLEGAWETLEGNTRCRFRGTIRFTATSLVHPDEPAHTLQRTVEWILPTPTPYRLVELVQVIEVTSSEEDPEEDPEELPPEPAVDALDFLEGDEDPLPEVDSPEDVMSASEADSTEDSGPGEMAISGGSSS

SEQ ID NO: 135392 - protein, 63 aa, Glycine max
  Coding DNA Sequence Number=SeqID_43707
MRLPGKDLLMKSPITLGQVLDVSDFRFLNDFRHGNTGGSTKIEKSTQSVSISHRASLGNGFCD

SEQ ID NO: 135393 - protein, 207 aa, Glycine max
  Coding DNA Sequence Number=SeqID_43708
  Gene Ontology: Biological process=transposition, DNA-mediated
  Homolog annotation: Hit_ID=Q1J7G7; Match level="QueryCoverage=20%, HitCoverage=72%, E-value=5e-12, Identity=72%"; Hit description =Transposase
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVTTLNSILFLNYLFNLIPSVNRHDDSYAVYAHVLIKLIDTVDLEGGPVGKPVVPAALMNRPTRGERRFAYWALAECILAYYVGTDEGVSEVLHVAGEKRLH

SEQ ID NO: 135394 - protein, 271 aa, Glycine max
  Coding DNA Sequence Number=SeqID_43709
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLKKPNITSQNYKLVLFAEECMRPNGTERVRSMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135395 - protein, 92 aa, Glycine max
  Coding DNA Sequence Number=SeqID_43710
MTGPLHESISCFLIRVDPWVLVPVASRGLPVLAFRGLHVFAFRGLHVLTIRGLHALTFRGLDFLAFRGLHVLSFGGQHVLTLAFVGLHALTF

SEQ ID NO: 135396 - protein, 123 aa, Glycine max
  Coding DNA Sequence Number=SeqID_43711
MTEGCGEGFCLANLPGLGKPLVEILPPGQLRGFCPLLAWLGSAVLGYGPVLSFGLVGPLLPPVISFVARILPTLACAPLAKSAQGGGGGFVGDLEGRDESKRQGLNLSGSWQQGHSATYNTPS

SEQ ID NO: 135397 - protein, 194 aa, Glycine max
  Coding DNA Sequence Number=SeqID_43712
GSAPPAMAENGKLDQIEERLKVIEGSGDYAFANLEELFLVPNVVTPPKFKVPDFDKYKETTCPKNHLKDVLSEDGDLATQVAPPITKRKMITVIVYTLPVFYYEKMMGYTLSSFADLVFIDEWIEMGLKRGKFNHPAWTNEKTGANEEDEKKGETHAATVVPTWKIPHQLNNIITQPISTLLITHHPVIHKGHP

SEQ ID NO: 135398 - protein, 169 aa, Glycine max
  Coding DNA Sequence Number=SeqID_43713
  Gene Ontology: Biological process=transposition, DNA-mediated
  Homolog annotation: Hit_ID=Q1J7G7; Match level="QueryCoverage=24%, HitCoverage=71%, E-value=3e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSILGGNDCKFGCISRHMLGTSTIDVPLLMEACLCGFYGGWIFELQ

SEQ ID NO: 135399 - protein, 82 aa, Glycine max
  Coding DNA Sequence Number=SeqID_43714
MCWSSYWATHATKDVLYLTTFLCSMLSPGLLSPDVSCMFSLILIKHRPQIPLVGLNLTRTALRHTYQQLGYCTPIPRENTIN

SEQ ID NO: 135400 - protein, 50 aa, Glycine max
  Coding DNA Sequence Number=SeqID_43715
MGVIDYHAYKGNWEMVEVSGNRLLGCAIDYTEGWVTDNRLPDRDGGAANP

SEQ ID NO: 135401 - protein, 135 aa, Glycine max
  Coding DNA Sequence Number=SeqID_43716
MGKAEEVQEYIEANMEAMKEQMVAMMEAMRSMKKIMEANAVAIAATSVVAKVNPMSPSDINQMNHPTSDMVGKDLGSTGGPHDVQIQNEHAFPPYGLPLNYTPPNVAYTPNKNANNSTPIPIESQQPQTDHAHVS

SEQ ID NO: 135402 - protein, 122 aa, Glycine max
  Coding DNA Sequence Number=SeqID_43717
MRSDQSEDICHSMNRHSRLEFPSANFLFFCPVFFWLFKSSWVSFKCPASWIRSQPLIDSFQVLLSSDSVKDIRPPSLCLSSIHSSGSIQNWSWTSVHVVLLLSPCSSEFISLDLTRAFVRPI

SEQ ID NO: 135403 - protein, 115 aa, Glycine max
  Coding DNA Sequence Number=SeqID_43718
  Subcellular localization annotation: CTP_CleavageSite=54; ConfidenceScore=5.29e-01
MTTLAQTWSVLSFSNLIPTSHTSNVTLDRAKLIYGIIMKMDMNVGGSRKARGKRSEAPSTASSEAPAPSSSTLPPSSSTEIPVIPPTPTHKPLPASFSTGPTDFIFTPKMLHSML

SEQ ID NO: 135404 - protein, 52 aa, Glycine max
  Coding DNA Sequence Number=SeqID_43719
MGTNQNGKRFYQVKIKSLDVTSLEELGRLMGPLQRQAFRQVYGKILDLIAAE

SEQ ID NO: 135405 - protein, 184 aa, Glycine max
  Coding DNA Sequence Number=SeqID_43720
  Gene Ontology: Mol. function=chitin binding; Cellular component =extracellular region; Biological process=chitin metabolic process
  Homolog annotation: Hit_ID=UPI00006A17C9; Match level="QueryCoverage =83%, HitCoverage=98%, E-value=8e-13, Identity=31%"; Hit description =UPI00006A17C9 related cluster
MLLSSNVIYICARVVMLVRMIRTRLFPAARVKSCPGMHSSCVIASLSGCIRTVGPPPISGGADVSTLKMRTRSPLKVRACSPLKARMCSPLEVRACSPLLARTCSPLKVRACSPLLVRTCSPLKVRACSPLLARTCSPLKVRACSSLMARACSPQKVRACTPLTVRVRACSPLMVRTCSPLNGE

SEQ ID NO: 135406 - protein, 164 aa, Glycine max
  Coding DNA Sequence Number=SeqID_43721
MDPWVLVPVTFRGLYVLACRGLHALAFRGLRVLIFIPRPPPDIGGRPTVRAHPEKKAITHQLCIPGQDFTCAAAKRRVWIMRTNMTTFTWIWMTLLFSNILPGDHNANLPLQMYRLESHPQRHPVDSEKSNRALGVSSSGIAPAKHPVDPKKSNRVLELSSSDY

SEQ ID NO: 135407 - protein, 112 aa, Glycine max; identical to SEQ ID NO: 104687
  Coding DNA Sequence Number=SeqID_43722

SEQ ID NO: 135408 - protein, 161 aa, Glycine max
  Coding DNA Sequence Number=SeqID_43723
  Homolog annotation: Hit_ID=Q6WAY4; Match level="QueryCoverage=95%, HitCoverage=28%, E-value=3e-15, Identity=33%"; Hit description =Putative uncharacterized protein
MGQLQRQAFRKAYGKIWDLAMAEVSTEAIASLVQYYDQLLRCFTFGDSQLSPTVEEFEEILGCPLGERKPYLFSGFYPSLARIFKIVQILTQELDHRKQVENGVVGVPRKCLEAKARVLAGKGEWALFIDILALLIFGGVLFPNMDGLVDQAAIDAFSRLS

SEQ ID NO: 135409 - protein, 72 aa, Glycine max
  Coding DNA Sequence Number=SeqID_43724
MVSFARVSEIRVSEATSQEEDLLHRSTKKIKEGAKVYMKGSSMSFADKILQPVGRAGMSMETAMNLHKDVMN

SEQ ID NO: 135410 - protein, 104 aa, Glycine max
  Coding DNA Sequence Number=SeqID_43725
MTATGFGSILGRIDSLLKGNPSLALEGMDLFRFWRGSITMPIGGADIEEELTDLRSNPLQGEGDDAILPRKGPVTRAMSKRLQEDWARTAKEGPKVLMNLRVDF

SEQ ID NO: 135411 - protein, 118 aa, Glycine max
  Coding DNA Sequence Number=SeqID_43726
MTRGNPGDLQPFDPEIDRTFHRLVRHSVHPDHFEYSEHSVHSEHFVSGDSEHSDFEHSAINFHTENMAQSPPRERTLREMVAPDFTYESLCIQYPDEDVPYVLKTGLIHLLPKFHGLA

SEQ ID NO: 135412 - protein, 150 aa, Glycine max
  Coding DNA Sequence Number=SeqID_43727
QKTKMFIDPNNANTTKLITILSEEQERITKPVAHGPASERRFPPQQFHMLQSSVETRGFDRRREVVEAEDFSQQMEQRGHGMYYTPPTFSQYPSQMYQYPFEGHDTDMSASEHSFGGVAETHPHFSWPTMTPSQQHDAPMATPNAPLALQ

SEQ ID NO: 135413 - protein, 117 aa, Glycine max
  Coding DNA Sequence Number=SeqID_43728
MPISPCRWNALQKTPSGPEEVQQGPGVSSSGYGPLSVLPGAHSPRQGHASCIGIGPQDTQWTRRSPTGSGSCQALITGLCQFYGVPVTSSKGIRPPTNRAFIKKYCVSRQAQGETPQ

SEQ ID NO: 135414 - protein, 33 aa, Glycine max
  Coding DNA Sequence Number=SeqID_43729
MEVCKRLGVYGKKKAMMRRAFLSSQTLFRKFQW

SEQ ID NO: 135415 - protein, 92 aa, Glycine max
  Coding DNA Sequence Number=SeqID_43730
  Pfam annotation: Domain name=G-patch; Domain location=1-42; Score =27.1; E_value=6.5e-05; Accession=PF01585.14; Description=G-patch domain
MVARVMLKHGYEPGMGLGKDSLGNADVVDIRGNPYKYGLGYESGMPGRRNALSRLRADKAWPGHVSQCFTSAGIMFEEEVAAIGEESPQDPP

SEQ ID NO: 135416 - protein, 271 aa, Glycine max
  Coding DNA Sequence Number=SeqID_43731
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMAVVVHEDVEIQKAIEELLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135417 - protein, 81 aa, Glycine max
  Coding DNA Sequence Number=SeqID_43732
MEKNEETKMEEKLLCSDYHLMEACLWGFYGGWIFELQWGPLMVIFHHGDAAKDKGKEVRGGAIHYGISHGGRSFTTKMSLG

SEQ ID NO: 135418 - protein, 227 aa, Glycine max
  Coding DNA Sequence Number=SeqID_43733
VLSYSNLAPTSHTSDLIVDRARLIFGLVSQMDMNVGALISGQIASMAYLVFERLSPIINLAYIRKNCWNPDDLEVTIRGAKRARTRPVEALSTSIAPPPARTLAAPSTSTPADFQRFETMLQSIHQGKIILLQSLQMVAPPDSIPSVEQFNEMKTDQTQEAATTYEKSLEATSEPSKPVADIASLQQEADPSTPKDQTTPVLSPNTSPTATPVLHVTDEEDVQTQDT

SEQ ID NO: 135419 - protein, 62 aa, Glycine max
  Coding DNA Sequence Number=SeqID_43734
MKDKRDEEEKLEKQKKKKDSKALSSKAKGKEKEEKDSSKNIVKKENHFATKVIKEFPRMLRE

SEQ ID NO: 135420 - protein, 99 aa, Glycine max
  Coding DNA Sequence Number=SeqID_43735
MEAMKEKMATMMEAMMSMKRIMEANAVAVAATSAVAKVNPTPPSGLNQMNHPTSDMHTLPMRMSITPLPYSLRADDLIMHMSLNPWGRHMNTPPQSSRL

SEQ ID NO: 135421 - protein, 64 aa, Glycine max
  Coding DNA Sequence Number=SeqID_43736
WLSARKNLKEDELSGSLSAPLQVIKRTASAHPLSERSALSQKSLTCAKRSICVLSARARTRPPI

SEQ ID NO: 135422 - protein, 175 aa, Glycine max
  Coding DNA Sequence Number=SeqID_43737
MAPRKLSAKRSRRDAAAEGTSAALEFDNHRFRSAEHQQRFEAIKGWSFHRERRVQLKDDEYTDFQEEIARRRWTSLVTPMAKFDPDIVLEFYANAWPTEEGVRDMRSGVRGQWIPFDADALSQFLGDPLVLEEGQECEFRFFPDRCREAGADHAHQHDHLDPDVDDVAAQQCPAQ

SEQ ID NO: 135423 - protein, 128 aa, Glycine max
  Coding DNA Sequence Number=SeqID_43738
  Homolog annotation: Hit_ID=Q5NRP4; Match level="QueryCoverage=66%, HitCoverage=6%, E-value=4e-08, Identity=30%"; Hit description =Putative gag-pol polyprotein, identical
  Pfam annotation: Domain name=zf-CCHC; Domain location=94-111; Score =22.2; E_value=0.00065; Accession=PF00098.14; Description=Zinc knuckle
MKGRHRSHLRPHSHRREKERKPQEANINLPYFHGKDNVEANLDWEIRVEQQLKRQKDQGQGILWVTPSKPKDDKGKTIEKQPLKASMQEKTSSMKCFKCHGRGHITSQCPTKKTMIMRGQDIYSSQDE

SEQ ID NO: 135424 - protein, 155 aa, Glycine max
  Coding DNA Sequence Number=SeqID_43739
MAKRFADDNNLSLHVIGLAASALQKVQNDHNLSLRATGLDRLWMTKGESDHNFSLVPCSIVSGWDKGLRMTIICLRMSSGSPPLDDKRMAKRFADDNNLSLHVIGLAASALQKVQNDHNLSLRATGLDRLWMTKGEEDHNLSLRDSGLDCLWMAK

SEQ ID NO: 135425 - protein, 64 aa, Glycine max
  Coding DNA Sequence Number=SeqID_43740
GPSALLIAGSTLTTDLSTLGGLVANDHSCVTLRVCFNVDGDADASTGGGGGGGGGEAGGVVMVL

SEQ ID NO: 135426 - protein, 101 aa, Glycine max
  Coding DNA Sequence Number=SeqID_43741
MQLPQEPLNKRPRRLARKSMAGTNFAELYGVAIMNSSCEGKKGTSREHIAWSKRSLSQRLCETETNMLAIIAKYQEELGLATAHEHRIADEYAQVYAEKRG

SEQ ID NO: 135427 - protein, 57 aa, Glycine max
  Coding DNA Sequence Number=SeqID_43742
MSSIASLVAVTEVNIYANNYDHFTLPIFHHGLGSGILHYMTPLDCQSPTNQPESTPK

SEQ ID NO: 135428 - protein, 140 aa, Glycine max
  Coding DNA Sequence Number=SeqID_43743
MTRTKKTGQMTSEATKDFANKIDSLEEQASQGFFVAHRRQGVLTAAIRQPKHPGGVRATGVDVTIKQYFGSAPRTSHMSSSMVPEDLENLMQKIRDQLEESITEKVTRQLMLSFNQMQSQFQSYMQSQGLALSLRPEVVL

SEQ ID NO: 135429 - protein, 115 aa, Glycine max
  Coding DNA Sequence Number=SeqID_43744
  Subcellular localization annotation: CTP_CleavageSite=44; ConfidenceScore=5.21e-01
MTVKTSDTCSSGDGHSCLCVRRKYRIRRHSPFRLRNCWEGRSVRASSLLRQLAKGGCAARRLSWVTPGFSQSRRCKTTASAKLACLQVDSRGSPFIQEKSTPNFEVKGHRATKIL

SEQ ID NO: 135430 - protein, 301 aa, Glycine max
  Coding DNA Sequence Number=SeqID_43745
  Gene Ontology: Mol. function=oxidoreductase activity; Cellular component=cytosol; Biological process=metabolic process
  Homolog annotation: Hit_ID=A4WAP7; Match level="QueryCoverage=100%, HitCoverage=87%, E-value=1e-114, Identity=64%"; Hit description =Alcohol dehydrogenase, zinc-binding domain protein
  Pfam annotation: Domain name=ADH_zinc_N; Domain location=108-260; Score=79.9; E_value=8.3e-21; Accession=PF00107.17; Description=Zinc -binding dehydrogenase
MLLRTHYLSLDPYMRGRMDDSKSYAPPAQLDQPMVGGTVCQVAESQHPDFSAGDWVLAASGWQSYALSDGTGVTKIGHLPHPSWALGILGMPGFTAYMGLMDIGQPKAGETLVVAAATGPVGATVGQLGKLNGCRVVGVAGGEEKCRYAIDTLGFSACIDHHRDDFAEQLAAACPDGIDIYFENVGGKVFDAVFPLLNTAARVPVCGLVSGYSSRELPPGPDRTPLIMGGILKRRIRMQGFIIFQDYGDRYPEFLQAMTPLVEQQKVLYREHMVEGLEHAPQAFIDMLKGKNFGKTVVKVA

SEQ ID NO: 135431 - protein, 293 aa, Glycine max
  Coding DNA Sequence Number=SeqID_43746
  Gene Ontology: Mol. function=pseudouridylate synthase activity; Cellular component=chromatin; Biological process=pseudouridine synthesis
  Homolog annotation: Hit_ID=Q66DI7; Match level="QueryCoverage=100%, HitCoverage=100%, E-value=1e-124, Identity=77%"; Hit description =Pseudouridine synthase
  Pfam annotation: Domain name=PseudoU_synth_2; Domain location=68-195; Score=84.1; E_value=4.5e-22; Accession=PF00849.13; Description=RNA pseudouridylate synthase
  Pfam annotation: Domain name=S4; Domain location=7-52; Score=50.9; E _value=4.5e-12; Accession=PF01479.16; Description=S4 domain
  Pfam module annotation: Pfam domain module=PseudoU_synth_2::S4; Domain location=68-195::7-52
MLPNSSTRLNKYISESGICSRRDADRYIEQGNVFINGKRASVGAQVFAGDEVKVNGRLIEPRNEDDLVLIALNKPVGIVTTMEEGERDNIGDFVNHSKRVFPIGRLDKDSQGLIFLTNHGDLVNKILRAGNNHEKEYVVTVDKPITDEFIAGMAAGVPMLGTVTKKCKVKRESTFVFRIILVQGLNRQIRRMAKHFGYEVTKLERTRIMNVSLKGIPLGEWRDLTDDELIDLFKLIEDSSSEDQKTQQAQAKKKAATPAAKKPAVSAPKQSDKAGQGANRKRFTQPGRKKKGR

SEQ ID NO: 135432 - protein, 1208 aa, Glycine max
  Coding DNA Sequence Number=SeqID_43747
  Gene Ontology: Mol. function=transporter activity; Cellular component= integral to membrane; Biological process=transport
  Homolog annotation: Hit_ID=A0NN44; Match level="QueryCoverage=30%, HitCoverage=87%, E-value=1e-113, Identity=53%"; Hit description =Probable extracellular solute-binding protein
  Pfam annotation: Domain name=BPD_transp_1; Domain location=439-668; Score=25.6; E_value=0.00019; Accession=PF00528.13; Description =Binding-protein-dependent transport s
  Pfam annotation: Domain name=Metallophos; Domain location=879-1097; Score=50.1; E_value=7.9e-12; Accession=PF00149.19; Description =Calcineurin-like phosphoesterase
  Pfam annotation: Domain name=SBP_bac_1; Domain location=12-335; Score= 124.1; E_value=4.2e-34; Accession=PF01547.16; Description=Bacterial extracellular solute-binding protein
  Pfam module annotation: Pfam domain module=BPD_transp_1::Metallophos:: SBP_bac_1; Domain location=439-668::879-1097::12-335
MSAIRFSPLACVVMLCASASVFAAEPVKLQMYYPIAVGGKVSHTVEALVADFEKQHPEISIQPVYTGDYATTVTKALTAFRGGNAPQLAVMGDIEAWSLMDAGAIVAASDLATGEEDKQWIDSFYPAFLRRIEGKVWGVPFQRSTVVMYWNKQAFEKAGLDPNTPPATWQQVVAFSKKLTLKQASGVSQWGIEIPSTPNGYWNFQGLAATNGGRLDNGKGNAVYFNTPGNVETLQWLTDLGQKEEVSPKGAIAWGTTPQDFISGKTAMMVTTTGNLTNVHDNATFPFGVAMLPEKTQRGSPTGGGNLYVFKSASPAQQQAAMRFIRWVTAPEQAARWSIATGYVATSPAAWDTAAMKAYVQQVPQALVAREQLKYAQPELSTYNSVQIQDALNHAIEAARRHAAPARVVTAAQRLFAAAARAQLPAAVYPLSGAGHAVAEPSLWNNLLYALITIPLAVTLALLMALAVNRRLRGNALVRAAFFIPSLLPMIAIANLWLFFYTPQLGILNSLLAWFSLPAVNWLGEPDTTLYCLMAVSVWREAGFFMIFYLAALQQIDPRLSEAAAIEGASRGYFFRRVQWPLLLPTTLFVLINASMNAFRIVDQVIAMTNGGPNNSSSLLLFYIYRTAFSFWDMPAASAMTVVLLPIINESCILSGRFCAQPADLAGRAAVEPADAGGANFINAWHAGTVCPLLPQYHAAGADDCGGPAGAGHAGRICTGALMISPDVLILNNYRTISALGLRDTLTGIALPSQPVLHSAPHLHSAGKANLCGIRAGLDQLPLERFSLAAGDHRLGSGASVNRRAAAVFRAGAGRAVGADWGSNADDHLAVAAAVFAVPAAPEMGYAHALTAAQRQRLGDVAELYQLPDLRAAPLDGTLRFGLLADPQYADVEADVPANLYYRHALHKLPQAITALNQQPLDFVVTLGDLVDRHWASYATLLPLYDRLLHPHAVVLGNHDAQTIAQHLDDALPLPKSYYAFQLPGWRFIVYDGNDISLYCNQHNGDDRQRAAALLADLQARQQPQAQPWNGAVGATQLAWLETQLIEARACGQQVVVFGHYPLAPGYSHSLLNGAQLAELFCRYDVRACFAGHDHRGGYHRRADTVFITLQGMLDGPSRVPFAVVELTGETLRLSGWGGEISREEVYGAAPMASRPAREIYLAIDQRSDRLRRDFNIDDFNQAIIRSAQLAAESAAIRIPAQSDTAVS

SEQ ID NO: 135433 - protein, 158 aa, Glycine max
  Coding DNA Sequence Number=SeqID_43748
MWAFLTSRQIDWAHLVWYRMHRALRANAPLPYPQLVTLFLRHFQIPLDDEPFVQVKRSFAIGAGAVTSFGYSKDRNGQWLKKDALPPQDERTPSPPPQRDDSALMTEVLLELRGLRTYVGERFDSLDTHFAGMDIHLTQLEEDVGYIRQSFDLPPPHS

SEQ ID NO: 135434 - protein, 66 aa, Glycine max
  Coding DNA Sequence Number=SeqID_43749
MASSNRLPRRDGSLVIDYQIVMAAQLIRDRVEMECLEGAWETLEGKHEVLISGHDSIHGYFIGASR

SEQ ID NO: 135435 - protein, 126 aa, Glycine max
  Coding DNA Sequence Number=SeqID_43750
METMKEQMTTMSEAMMSMRKAMEVNMATIIAASTATEVDPTHLSGLNQVNHPVSDMVGQGGGALGSMRGPHFVQVQSKHSFPPYGLPLNDTPPNVAHASDGNVDNFAPIPIESQHPNPVMHRSLNP

SEQ ID NO: 135436 - protein, 40 aa, Glycine max
  Coding DNA Sequence Number=SeqID_43751
MTKARQQGVRKGKEGQACHPARPGELGCFLQKAPPSRGTS

SEQ ID NO: 135437 - protein, 181 aa, Glycine max
  Coding DNA Sequence Number=SeqID_43752
MAHKSDQLKKPHNAHPCQSWHTPADTSAEGGQSYVIAGQDVAKQQRHHIWVKVVMLAMHSWPSSNTTGHPGTALRASASKGIHWPFTHDLRHVPHALLRGPSLSLDASLSVQRPSFDGLETLLVLCAPEMAGSSLDEVVTAVRPAACGASPCACLGVQYFSMKARVIGGQITLLGVDGNPE

SEQ ID NO: 135438 - protein, 119 aa, Glycine max
  Coding DNA Sequence Number=SeqID_43753
  Homolog annotation: Hit_ID=A0ST23; Match level="QueryCoverage=26%, HitCoverage=65%, E-value=1e-11, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVTTLSTLEDPMMWNSGNKVGKPVVPAALMNRPTRGERRFAYWALFRFLAH

SEQ ID NO: 135439 - protein, 106 aa, Glycine max
  Coding DNA Sequence Number=SeqID_43754
MKEAVDSRKKNFSKTRNSLKDFSVDRSAGRLSKQTNGLHPHSSGSKDDSTSDSPQISASPHQLDLAPYVSGHYNAQWNAPGLLHDMHMLHSSRILEKKEVEETLAG

SEQ ID NO: 135440 - protein, 111 aa, Glycine max
  Coding DNA Sequence Number=SeqID_43755
MEWIVPTPTPYRLVEPIQVIEVSSSKGDLEEDQRSYLLNLLWMPLTYLRMMKTHSLMLIPQRILCQHLRQTLQRRVALEGQRIVTTLHHSRRLLSLGVHTFWWVSVSSSDC

SEQ ID NO: 135441 - protein, 107 aa, Glycine max
  Coding DNA Sequence Number=SeqID_43756
  Subcellular localization annotation: CTP_CleavageSite=34; ConfidenceScore=5.21e-01
MHTQSFTIPQFFKIGLTHKKSPVESPTVATCPLRASEGEAHGCAFQRRKRCAESPPTFICRKRRKNRRKPVKMKILSSGVVFTFEEGRQKRGFCSYVPSIEEEIRPT

SEQ ID NO: 135442 - protein, 87 aa, Glycine max
  Coding DNA Sequence Number=SeqID_43757
  Gene Ontology: Mol. function=peptidase activity; Biological process =proteolysis
  Homolog annotation: Hit_ID=A6TEH8; Match level="QueryCoverage=100%, HitCoverage=29%, E-value=2e-40, Identity=93%"; Hit description =Putative protease
MLSQENQQVFVLNGIQTMSGYVYNLGNELTSMHGLVDMVRLSPMGSETFAMLDAFRANENGAAPLDLTANSDCNGYWKRLAGLELQA

SEQ ID NO: 135443 - protein, 249 aa, Glycine max
  Coding DNA Sequence Number=SeqID_43758
MERGGGEVLEEIFPRVQDHWGKVQLNIFIDGMQPHSKQLLDASAGGKIKLKTPEEAIELIENMAANDYVILRDQEPSPQEESTRLEELLVQFMQETRSHQKSTDAAIRNLEVQLAKLVPERPTETFAVNTKMKPKKECKVILTKEDVEEEKKEEIERNEEKTQQWEKHSQVKIQQESILQVNTTPHQLIVKEERHGKHDKPLSVLPFLTTSTFLATIWKVFPVYMSFMASLAKRRKCKEDVFYVTFMPP

SEQ ID NO: 135444 - protein, 180 aa, Glycine max
  Coding DNA Sequence Number=SeqID_43759
  Homolog annotation: Hit_ID=A5AY05; Match level="QueryCoverage=46%, HitCoverage=21%, E-value=3e-08, Identity=37%"; Hit description =Putative uncharacterized protein
  Pfam annotation: Domain name=zf-CCHC; Domain location=84-101; Score =21.5; E_value=0.00084; Accession=PF00098.14; Description=Zinc knuckle
MKEGIGHILDLTPIGEKMKESLKRIEQQLKRKSTSKSYGSHSYPNKDQGQGILGVRPSKPKDDKGKTIEKQPLKASMQEKTSSMKCFKCLGRGHITSQCPTKKIMIMRGQDIYSTQDEATTSPSSSKSEEAKGEESSEEIYPQEEGQPLMVKEECKETLVSIATSLRLEFIPQVKELLDE

SEQ ID NO: 135445 - protein, 136 aa, Glycine max
  Coding DNA Sequence Number=SeqID_43760
  Pfam annotation: Domain name=zf-CCHC; Domain location=63-80; Score =31.2; E_value=3.8e-06; Accession=PF00098.14; Description=Zinc knuckle
MAAQALKASSSIQEEEEKDEESKDEEDFSLFVKKFHKFFKKRRIERRQNFNHGKRFQVDSPTLRCYKCNQLGHIKANCPSNEQWLEKNDKKSHEERRTKKAYIAWDDNDSSEGSEKEEINLLTKDYESEEDITQRD

SEQ ID NO: 135446 - protein, 164 aa, Glycine max
  Coding DNA Sequence Number=SeqID_43761
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTDAPYP

SEQ ID NO: 135447 - protein, 96 aa, Glycine max
  Coding DNA Sequence Number=SeqID_43762
MSGVRRDSPQISASPHQLDLAPYASGPYNAQWNAPGLLHDKHTLRSSRILGEMEVDEPWLGLWLPLNYQVVFVIGSAVGRLCGCFRDGLCGKLGGG

SEQ ID NO: 135448 - protein, 72 aa, Glycine max
  Coding DNA Sequence Number=SeqID_43763
MSALKEQMASMIDTMFGMRQLMENNMATAATVSSAAEADPTLPATAHHPLPNVVGREGSTLGHISNPYLGYN

SEQ ID NO: 135449 - protein, 63 aa, Glycine max
  Coding DNA Sequence Number=SeqID_43764
MGDPVSLALLTSIGGRDGDGEILAEEHRRGVVGGSPAVAGRRRFSCGLVVQWWLHLVTFVRKQ

SEQ ID NO: 135450 - protein, 16 aa, Glycine max
  Coding DNA Sequence Number=SeqID_43765
MEPIDAATISSADAYA

SEQ ID NO: 135451 - protein, 300 aa, Glycine max
  Coding DNA Sequence Number=SeqID_43766
  Homolog annotation: Hit_ID=A5BSR3; Match level="QueryCoverage=24%, HitCoverage=23%, E-value=2e-10, Identity=50%"; Hit description =Putative uncharacterized protein
MGPVLPDSLRPFLGGDVRKKAQASQKQNTAPHVLSRGGYDYLEQKLLAEKTKKKLEEVAQSGSVDDVIDPPSPVRRHVKWKMARTKKTREMMTEAAKEIAVKIDSFKEQVTQGSFIPHGRQDVLTTAIGRPEHPGRVCAVGTGVTIKQYFGSAPRTSRSSSSLPPEELQQLTQQIRDQLEESITERVTRQLMASFSQMQSQMQSQGLALPPEPLVGPSAPRVSTKGSCVDPSGNDLEMGDSDRCGLYIEGDHARLVSLGRVYEGSTVVHNTPLLPGQVKVGVEEVTDADAPVPVPTDEFP

SEQ ID NO: 135452 - protein, 217 aa, Glycine max
  Coding DNA Sequence Number=SeqID_43767
  Homolog annotation: Hit_ID=Q84VH5; Match level="QueryCoverage=81%, HitCoverage=30%, E-value=1e-79, Identity=77%"; Hit description =Envelope-like protein
PTDGVVDITVSEHQIAKEITAKQVQHWPKKGKLSAGKLSVKYAILHRIGAANWVPTNHTSTVATESFAVKLPIAFPTVLCGIMLSQHPNILNYTDSVMKRESPLSLHYKLFEGTHVPDIVSTSGKAAASGAVSKDALIAELKDTCKVLEATIKATTEKKMELERLINRLSESGINDGEAAEQEDEVAEEEVEAAEEEEEAAEEEEDAASDDDSEATP

SEQ ID NO: 135453 - protein, 82 aa, Glycine max
  Coding DNA Sequence Number=SeqID_43768
MKLKAENGTETKLQLEAENGKCIHVNILTVMRITLQQEEFKENQDFRPHAISSDSVDIQYPVVEISNKSKLSCVNKSKLNHE

SEQ ID NO: 135454 - protein, 160 aa, Glycine max
  Coding DNA Sequence Number=SeqID_43769
MTGRLLARSLTFDCRIMHYIIVRILLSRSSNLAQAFEEDLILMWAFLTGRQIDWAHLVRYQMHKALWANAPLPYPQLVTVFLRHFQIPLNDEPFVQVKRSFAIDAGAKDALPPQDECTPSDAILPRKGPVTRTMSKRLQEDWARAAEEGPRVLMNLRVHF

SEQ ID NO: 135455 - protein, 98 aa, Glycine max
  Coding DNA Sequence Number=SeqID_43770
MHDMNAFYGHESPENYLFLLAHLGAQCPMCTIKKIWEPIQSLCSDSQPLMIAADDPITASPKLSVLSSRRIPCLANSLEYPRVVVTKTPCDERRDAFV

SEQ ID NO: 135456 - protein, 280 aa, Glycine max
  Coding DNA Sequence Number=SeqID_43771
  Gene Ontology: Mol. function=transporter activity; Cellular component= integral to membrane; Biological process=transport
  Homolog annotation: Hit_ID=A8GDV4; Match level="QueryCoverage=100%, HitCoverage=69%, E-value=1e-105, Identity=69%"; Hit description=Drug resistance transporter, Bcr/CflA subfamily precursor
  Pfam annotation: Domain name=MFS_1; Domain location=1-279; Score =84.0; E_value=4.7e-22; Accession=PF07690.7; Description=Major Facilitator Superfamily
MREELQISAGAVSASLSIFLAGFAFAQLLWGPLSDRLGRKPVLLIGLTLFALGCLGMLWVENAVQLWILRFIQAVGVCAAAAIWQALVVDRYREGQANRVFATIMPLVALSPALAPLLGAWLLNHASWRAIFAALLAITALLLLPTLLLKERAKTQPSADAPKNGVSFWQLLRSPVFSGNVAMYAACSAGFFAWLTGSPFILGDMGYSPNDIGLSYVPQTLAFLLGGYGCRAALKRINGKTLLPWLLVAYGVSMVALYLVATLTDPTLTTLLIPFCVMAL

SEQ ID NO: 135457 - protein, 77 aa, Glycine max
  Coding DNA Sequence Number=SeqID_43772
MMVPRASHVNLRIAFVVHSIILAIKIAIPLDYRVESSTFFKGKIHQVKVKYGSNQLAKLGQKVDRVTSPFCLLPTHD

SEQ ID NO: 135458 - protein, 123 aa, Glycine max
  Coding DNA Sequence Number=SeqID_43773
  Homolog annotation: Hit_ID=Q2HVN2; Match level="QueryCoverage=73%, HitCoverage=26%, E-value=1e-08, Identity=32%"; Hit description =Putative uncharacterized protein
MRWKIVGGDKVRLWEDKWNQQQQPLAERYPRLYQISTQQNQTIRQMGQHLQSGWEWQLRWRRPLFENEIESAINFLKDIEGIHIQQQGSDEWEWLGDQTRNYSTRNAYNLVLEASTGGQQEEW

SEQ ID NO: 135459 - protein, 225 aa, Glycine max
  Coding DNA Sequence Number=SeqID_43774
  Gene Ontology: Mol. function=binding; Cellular component=ubiquitin ligase complex; Biological process=protein ubiquitination
  Homolog annotation: Hit_ID=A5C9T4; Match level="QueryCoverage=67%, HitCoverage=33%, E-value=2e-56, Identity=74%"; Hit description =Putative uncharacterized protein
  Pfam annotation: Domain name=Arm; Domain location=102-142; Score =18.7; E_value=0.021; Accession=PF00514.14; Description=Armadillobeta- catenin-like repeat
  Pfam annotation: Domain name=Arm; Domain location=143-183; Score =11.0; E_value=0.45; Accession=PF00514.14; Description=Armadillobeta -catenin-like repeat
  Pfam annotation: Domain name=Arm; Domain location=184-224; Score=3.0; E_value=4.6; Accession=PF00514.14; Description=Armadillobeta-catenin -like repeat
  Pfam annotation: Domain name=Arm; Domain location=63-101; Score=6.8; E_value=1.5; Accession=PF00514.14; Description=Armadillobeta-catenin- like repeat
  Pfam module annotation: Pfam domain module=Arm::Arm::Arm::Arm; Domain location=102-142::143-183::184-224::63-101
  Subcellular localization annotation: CTP_CleavageSite=55; ConfidenceScore=5.34e-01
NHQSKAKVLRNEIGTSPRRLLRAFCRRISRRRRKCALTASNRISGGEALRSSETLATSQKSCRQSRSDCEVWHVPFLIPLLRCSDSWTQEHAVTALLNLSLHEDNKMSITNVGAVKSLIYVLKTGIGTLKQNAACALLSLALVEENKGSIGAFDAIPPLVSFLLNGLSRGEKDALTTLYKLCFVRHNKEKAVSVDAVKPLVELVAEQGNDMAEKAMVVLNSLVGI

SEQ ID NO: 135460 - protein, 86 aa, Glycine max
  Coding DNA Sequence Number=SeqID_43775
  Subcellular localization annotation: CTP_CleavageSite=34; ConfidenceScore=5.40e-01
MQKIPKIRGKRVFYLVFLDPSSPRLASSSSRPPNSFMVKKPAHLGELTASGHPRGVLKGSKVQEVRELREERKKRKQGRGTTESRP

SEQ ID NO: 135461 - protein, 134 aa, Glycine max
  Coding DNA Sequence Number=SeqID_43776
  Homolog annotation: Hit_ID=A5B2M3; Match level="QueryCoverage=98%, HitCoverage=16%, E-value=1e-24, Identity=40%"; Hit description =Putative uncharacterized protein
VDSRGSPIHSGLSKAFWAEAINTTAYLINRGPSVPLNYQLPEEVWSRKESTGVEVESEPEPSTPPRKSSRISVPPDKYSPSLHYLLLIDAGEPECFSEATQGNDSIEWELAMKDEMTSLQKNKTWSLRKESVTK

SEQ ID NO: 135462 - protein, 109 aa, Glycine max
  Coding DNA Sequence Number=SeqID_43777
MAMGDFISRLSFPENTETFSSLASYPELRRSEFLIGGYVGAKALLLSTTLLSVTMTQELVARGDTLRVIRTLLSSRGGGPDDTQRQIWSFCTLVSSRGGEPDDTRRYLM

SEQ ID NO: 135463 - protein, 212 aa, Glycine max
  Coding DNA Sequence Number=SeqID_43778
MPISPCRCISWDRAHKTPSGPEEVQQGPGVSSSGYGPLSVLQGAHPPNEGSHPQRHPVDPEKSNRALGFPALVTGLCRPTGCPFPPARSRHHDIGIAPTDTQWTRRSPAGSWSCQALITGLCQFYGVPVTSSKGIRPPTNRAFIKKYCVPRQAQGKIPKQPGDGRQRGNRRTANTSRVHLSSSTKRLERCYDPWAANRRPSPKSKASKVLGS

SEQ ID NO: 135464 - protein, 86 aa, Glycine max
  Coding DNA Sequence Number=SeqID_43779
MLNGTPRGFSMTSTRCVSSRILGEMEVDEPWLGLWLPLNYQVDMGASQHRTTEFGVNPTGFLLQNSFLFVYKGMAFVDNWVVGKEE

SEQ ID NO: 135465 - protein, 270 aa, Glycine max
  Coding DNA Sequence Number=SeqID_43780
EFYTNLYDPEEKLPKQVRVRGHLIKLDEDTLNTFLKTPVVVEEGESLCAYSRFALLRPDPQELAAKLCISGRGFELNADGQPLKILRKNMTTLAQTWSVLSFSNLIPTSHSSDVTLDRARLIYGIIMKMDMNVGGVQSDSRSWESLSPAINLAYIKKNCWNLDDPIVTFKGPRKARGKRSEAPSIAPLEAPTPSSSTLPSSSSTDIPMIPPTPTQIPLPAPLSTGPANFVFTPQMLHSMLQSIHRGQSIIMKSLQGMGLPSIMSMEEFDT

SEQ ID NO: 135466 - protein, 147 aa, Glycine max
  Coding DNA Sequence Number=SeqID_43781
LFVLQIAKKNVYTDNYSGIFARQRDSKVSMTDLVSAEDDVNLRVSTGLSAAIDEGLFVLQIAKNNVYTDNHSGISARQRDSKVSMTDLVSAEDDIAKNNVYTDNHSGISAHQRDSKVSMTDLVKVANKSEALSPTYPPMRNSDLRSS

SEQ ID NO: 135467 - protein, 30 aa, Glycine max
  Coding DNA Sequence Number=SeqID_43782
MEHASRESRVALPPKGNGPKEAFLKEIQEG

SEQ ID NO: 135468 - protein, 26 aa, Glycine max
  Coding DNA Sequence Number=SeqID_43783
MALGVIAAHLGELLLQPEVTLLTQAS

SEQ ID NO: 135469 - protein, 399 aa, Glycine max
  Coding DNA Sequence Number=SeqID_43784
  Homolog annotation: Hit_ID=Q6WAY6; Match level="QueryCoverage=63%, HitCoverage=51%, E-value=2e-25, Identity=27%"; Hit description =Putative uncharacterized protein
MGTNQTGKRFYQVKVKGLDTTSIKELGRLMEPLQMQAFRKIYGKILELTIAEISIEAIASLTQYYDQPLRCFTYEDFQLVPTIEEFEEILGCPLGGRKPYLSSGCLPSLSRIATVVKDSARGLDRIKQTRNGIAGLPRRYLEDKVRGMANQGDWVPFMDVLALLIFGVVLFPNVDGLVDLAAIDAFLAYHHSKESAKRVAHGSSVACPLSVFGWFHTCSSKTRGIHVRSRAIARYPNIPLIGTRGCINYNPALAIRQLGYPMRGAPTEESMKDQELRGIRNGIIGGYHEWLKVHIRGLDWLAKLKVVSEESFEAPEEDEEVQALKSELGKAKLAKEKFKLAATHIRKECAGLWEENATTARALEQEAKRARKEEYGRNKFRGALWGSNNELKLRREERD

SEQ ID NO: 135470 - protein, 82 aa, Glycine max
  Coding DNA Sequence Number=SeqID_43785
MEEARGGALASQQHWFRRLPVLDVIELHWMVYGQEGFQNQKVVASSIRFVHNNYRQKYIPLLQWIKQHYFVSYCAKKLEQIQ

SEQ ID NO: 135471 - protein, 122 aa, Glycine max
  Coding DNA Sequence Number=SeqID_43786
MPISPAKVSVGLCHPDIGMDHTHKTPSGPRGAQQGPGVSSSGYGPLSVIQGARPPQQGIAPARHPVDPKKSNRVLGFPALITGLCQFYGVPVDPSKFIRPPINQTFIKKYCAPRQAQGETPQ

SEQ ID NO: 135472 - protein, 72 aa, Glycine max
  Coding DNA Sequence Number=SeqID_43787
MRDEKRSSYVIGSGVNSGIGFGGKFLIALELPSGRAVVGAGAWGASLWIGAGALGCTGAELEEFPARAKKLE

SEQ ID NO: 135473 - protein, 114 aa, Glycine max
  Coding DNA Sequence Number=SeqID_43788
  Homolog annotation: Hit_ID=A6FJQ2; Match level="QueryCoverage=33%, HitCoverage=84%, E-value=3e-11, Identity=92%"; Hit description=50S ribosomal protein L5
MMITTLTYKNRRITRPFRLARFGDDGETSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 135474 - protein, 74 aa, Glycine max
  Coding DNA Sequence Number=SeqID_43789
MRRYLMVILTFCQLEASEPVDTLVEAPLELVGLGSSSSMDSFASWKINGSGMEKEEREEKPLQGEDESRRSSPP

SEQ ID NO: 135475 - protein, 82 aa, Glycine max
  Coding DNA Sequence Number=SeqID_43790
MEALENLKGSSLFTQRSILGASHIDTLEIAQGKLSRYSKGQHFKLGAPFQAHSISRRPKLHNGSSSKIKWPLLLTRGSDSGA

SEQ ID NO: 135476 - protein, 119 aa, Glycine max
  Coding DNA Sequence Number=SeqID_43791
MAAQFIHDRVEMECLEGVWETLEGNEPARTLQRTVELILPTPTPYLLVEPVQVIEVTSSEEDLEELPPKPAVDALDFLEGDEDPLPEVDSPENIMSASKADSTEESGPGGIATSGGSSS

SEQ ID NO: 135477 - protein, 88 aa, Glycine max
  Coding DNA Sequence Number=SeqID_43792
MDRGLQVDGPEMQEKTLKASEARLTGAFSKGGKCAESPPTKVDKSGALAPTYPPSKRKSDLRSSFLRNSPLRPIYRKKGEEVAAQLAQ

SEQ ID NO: 135478 - protein, 89 aa, Glycine max
  Coding DNA Sequence Number=SeqID_43793
MSLPSAVHVSSTFESGAPRMSLPSALRQFSILHLYLETHECHCLALFMCPPLSSAEPLQKRRSRDENRHHGKGRTDEISVLSLLSSYLR

SEQ ID NO: 135479 - protein, 154 aa, Glycine max
  Coding DNA Sequence Number=SeqID_43794
VVPSMVRLMKQANVFLLKKTLKNFTIWEINKDKDILKEDSQASSKVLITNKDSGDHTLANNSTRTRVDLPTGQFNKALKNLEVQVGQLAKHIADKSSNSFVANTEKNPKEECKAMMTRSKRFVEAEDEDSVVMPKKKAAEKKSTDDKKNDVRGE

SEQ ID NO: 135480 - protein, 30 aa, Glycine max
  Coding DNA Sequence Number=SeqID_43795
MESFDAHARCPSLPQCKALRYQSLPFVMTL

SEQ ID NO: 135481 - protein, 120 aa, Glycine max
  Coding DNA Sequence Number=SeqID_43796
VDSRGSPSSKAKWKEKEEKDSSKKIVKKENHFATKGDIKRAILLKQSFYLLLSRETSFSTVILLELEFIPQVKELLDEGLVRVAGRSPEFQESLDLRSNPFQGGGNDAILPPRALDKFET

SEQ ID NO: 135482 - protein, 136 aa, Glycine max
  Coding DNA Sequence Number=SeqID_43797
VTRCYLDEQRFTSIPRPKDMNSMSKVSVNIEDMPSTSTETRKISRVRKDCCYTCCYPQSDDSPNGCENCHSGLNGELDEEIYMKQPEGAVVRLTEPKRKTIGERGIDCIFIGYAEHSKAYRFYVLESNDSVAVTRL

SEQ ID NO: 135483 - protein, 296 aa, Glycine max
  Coding DNA Sequence Number=SeqID_43798
MTEREMITIMVDTLPTFYYEKLIGYMPANFVDLVFAGERIESGLRKGKFEYAANMAPNNNRRASVVGARKKEGDAHAVTTAPTWMKAPQNIQSSYQPNPPNFLIRAGNSLPTQVKGPPAAERAPAQRTAPAALRPVNNDSPRRDLWICTAPERQLPSYSHGIFRVMAFIIGESLGGGHTREGSPATLPQVEEGPNVKINPLASHGGASVNAIEEDGPSRTKRIGDVATSRRFIYQSLQAACMVSRGGDERDECLFHLGESHDMETCLVVEELLQRLMDCGQLEVFIGGKEEPQICM

SEQ ID NO: 135484 - protein, 89 aa, Glycine max
  Coding DNA Sequence Number=SeqID_43799
MYPPLFSLNLVDVPSTRTDPQEMYPLLFSVNNPSVSPLTLLYKGWKNQKILRLCRFEFLTREKGDTRFRRLVLRSFEKGEERQKNNSGG

SEQ ID NO: 135485 - protein, 16 aa, Glycine max
  Coding DNA Sequence Number=SeqID_43800
VPIVVFRHDLVDGNLS

SEQ ID NO: 135486 - protein, 141 aa, Glycine max
  Coding DNA Sequence Number=SeqID_43801
MTRGNPSDLQPFDPEIDRTFHRLVRHHFVPFEHPEHSIIGESEHFVVGNFEHPDFEHYSFEHSENMAQPPPRERTLREMAAPDFTYESLCIQYPDEDVPYVLKTGLIHLLPKFHGLAEGVAKDWLYYLAPKSITSWDDLKR

SEQ ID NO: 135487 - protein, 49 aa, Glycine max
  Coding DNA Sequence Number=SeqID_43802
IRPHSEWISRASKAVSQSLGHGRCIPSSRGSSWAFRLLPTYGRVDVPHN

SEQ ID NO: 135488 - protein, 65 aa, Glycine max
  Coding DNA Sequence Number=SeqID_43803
  Subcellular localization annotation: CTP_CleavageSite=15; ConfidenceScore=5.07e-01
MESPSVATYPTTGVRAKSQMSVFQKEKCVGVATNVYLRENVRKTKKRVFPLLLRILRCNEEFRPT

SEQ ID NO: 135489 - protein, 142 aa, Glycine max
  Coding DNA Sequence Number=SeqID_43804
MGESLTEQCRVKVEGLRVMNFFSRRRSNDAAAVRQRMQALSGMIGRKASVGGFLSSPSNPRAQPWTGGGNYQAGVRYPSSPSRKRWILGAVRIDPCNAVANALSIPPGEYVRKNELKELTGARTSGGACGLIRCKAKNLTRA

SEQ ID NO: 135490 - protein, 94 aa, Glycine max
  Coding DNA Sequence Number=SeqID_43805
MITKDDDKGDDKKLKGQSKNEFKMFKIESRTLQDSRGKLNSRVKNQDSRDQGSRLKIQESRKGYSRIKKKLNQDKYEKVFLKVITLQNDPLDQT

SEQ ID NO: 135491 - protein, 122 aa, Glycine max
  Coding DNA Sequence Number=SeqID_43806
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=65%, E-value=2e-33, Identity=100%"; Hit description=LacZ protein
MEFGSERSGHEVKDEKRSESSVGDEEGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 135492 - protein, 178 aa, Glycine max
  Coding DNA Sequence Number=SeqID_43807
MEKGGLHTFKALRIWSLPVERIDVGLKKGKFDHPTRTTEKTGANKEGEDEGETHAVTAIPVRPSFPPTQQYLYSANNKLSPYPPPSYPQRPSLNLPQSLSTALPMTNTTFSTNQKHQPRTITLAKVHQPPFIREYDSNATCACHGEAPGRSIEHGRALKRKVQGLIDTGWLKFEENCV

SEQ ID NO: 135493 - protein, 123 aa, Glycine max
  Coding DNA Sequence Number=SeqID_43808
MGVFAKEDKNSRGTHVQGLDWLPSLRTAKREEVEAPEEDEEVQALRAELEQAQTVKERFKSAALKIQKENTELRDVNVATTKALERETKRACREEHGRNKFRGALWVATVSLNSEERKRTNHE

SEQ ID NO: 135494 - protein, 99 aa, Glycine max
  Coding DNA Sequence Number=SeqID_43809
MTQGENVNPYPRKQKEEKKNFQSKRKQKKKRRKISNQRESKKKGKEIPNQRVGESKKKRKKIPNQKMGESKKRKERKLLIKDRKKPEEICRKVFGPDNI

SEQ ID NO: 135495 - protein, 236 aa, Glycine max
  Coding DNA Sequence Number=SeqID_43810
  Subcellular localization annotation: CTP_CleavageSite=80; ConfidenceScore=5.42e-01
MAPRKLASRGPGRTRRPKELVPLRSTTVTALGALYTSSASKPSRDGRFSGSDASSSGTTSILISGGNRAPAVGTTEEGVRDMRSWVRGQWIPFDADAISQLLGYPMVLEEGQECEYGQRRNRSDGFDEEAIAQLLCIPGQDFARTAAGRRVRIMRTNMTTVTQIWMTLLLSNILPTDHNSDLPMPKCQLVYAILTGLRLAFTELGHLTWSSIYGIWFASRRATTEHMYGPMTVCTR

SEQ ID NO: 135496 - protein, 149 aa, Glycine max
  Coding DNA Sequence Number=SeqID_43811
MARTYSPLKVIGTSTQGSTVMRSKRSTHREGRSSNKIGHEILTVLLKKVIIHATLSYLLQISPGTPSKCDASSIGACRPRIFFINGFLCFLEDEWQQNGERERERRRHFKEKISLEEAHHHRRPWIRACRKKEMNEGRGREEHEILCSK

SEQ ID NO: 135497 - protein, 117 aa, Glycine max
  Coding DNA Sequence Number=SeqID_43812
MEADMEAMKEQMAAMMEAMMSVKKIMEADAVAIAATSVVAKVNPTSPSGINQMNHPTSDMATEGQAVGDIPLQNTLEGPQYHPRPHPLHSTAIKNPHAMAEMGKVDHLKERPRAIEG

SEQ ID NO: 135498 - protein, 115 aa, Glycine max
  Coding DNA Sequence Number=SeqID_43813
  Homolog annotation: Hit_ID=A5C982; Match level="QueryCoverage=46%, HitCoverage=13%, E-value=2e-16, Identity=77%"; Hit description =Putative uncharacterized protein
MRTTLSLLKWIYIVNNNDLISFPLNIKGILKPSRQLGEDFKINNPRAKIKKPTQSDDIPQALAALTLDNTIAETKWTSDTEASNHMISKASMLSNIQQYSGTRNRETDYHREVQG

SEQ ID NO: 135499 - protein, 165 aa, Glycine max
  Coding DNA Sequence Number=SeqID_43814
AGGPDDTRRYLTVIRTLLSSRGGGPDGKQRPKTKFGHSAPLYHPEAAGPMTSRDQVWSFCTLVSSRGGGPDDTRRYLTVIRTLLSSRGGGPDDKQRPKTKFGHSAPLYHPEAAGPMIRGDTLRLSAPFCHPEAAGPDDKQRPKAALDSMQRLIQSSAPFVPPGTT

SEQ ID NO: 135500 - protein, 162 aa, Glycine max
  Coding DNA Sequence Number=SeqID_43815
MAPTRHPLDPDKSNRALGFPALITGLCQSFGVPVAPSKVIRPPITRAFIEKYCTQRQVQGDAPQAADAPPPHQAGLAGSFDTEQYLRHLMSLSLQSQGFTSFPCPTPDQFRAEVAWPGDWPEAQAGEAPAGAPAEAPDEADEAREDKEMNDLLDFLGGSGAT

SEQ ID NO: 135501 - protein, 159 aa, Glycine max
  Coding DNA Sequence Number=SeqID_43816
MASRKRKSATSRPQAQYDTKRFQSLEAWNRYTDNILDWRILPEKNVKIYHTEFDEFKAEMERRNLHKRLANLQDGSIDVAVVKEFYANLYSPEDQTPKQVRVRRHLIKIDADSLNTFLETPVVLEEGPSLEASEERSHHSCTDMECFLLQQPDSHFPHL

SEQ ID NO: 135502 - protein, 70 aa, Glycine max
  Coding DNA Sequence Number=SeqID_43817
MVTIIPAKIPQPPFSQGYNSNATCAYHGGVPGHFIEHCVTLKHKLTCTLELISKFVQSEIARSTRLVGVP

SEQ ID NO: 135503 - protein, 232 aa, Glycine max
  Coding DNA Sequence Number=SeqID_43818
  Homolog annotation: Hit_ID=UPI00016621D1; Match level="QueryCoverage =90%, HitCoverage=41%, E-value=3e-12, Identity=31%"; Hit description =UPI00016621D1 related cluster
SEGYTPSPSEGLHVLTFRGLHALAIRGLHVLTFVGLHALTFRGLHVLANRGLHAFTLRGLHVLTNVGLHALTFRGLHVLANRGLHALTFRGLHILAFRGLHVLTLRGLHVLTLRGLNILALRGLHVLTIRGLHALTSRGLHVLALRGPHVLTIRGLHALTSRGLHVFTLRGLRPLALGLHALTFRGPHVLTFRGLHALAIRGLHVLAFVGLHALTFRGLHVLVQQRATRPHL

SEQ ID NO: 135504 - protein, 140 aa, Glycine max
  Coding DNA Sequence Number=SeqID_43819
  Homolog annotation: Hit_ID=Q8S8M1; Match level="QueryCoverage=89%, HitCoverage=11%, E-value=2e-08, Identity=32%"; Hit description =Putative retroelement integrase
  Pfam annotation: Domain name=zf-CCHC; Domain location=74-91; Score =21.5; E_value=0.00084; Accession=PF00098.14; Description=Zinc knuckle
MKEGIGHILDWKIRVEQQLKRKSTSKSYGYHSYPKKYQRQGILGVTPSKPNDDKEKTIEKQLIKASMQEKTSSMKCFKCLGRGHITSQCPTKKTMIIWGQDIYSSQDEATTSPSSSKSEEQKGKNLVKRSSPNEEGQALM

SEQ ID NO: 135505 - protein, 41 aa, Glycine max
  Coding DNA Sequence Number=SeqID_43820
MDLPASRDKGRDQHTMHARDKMCLPLPWPWLTSGEVLDSRS

SEQ ID NO: 135506 - protein, 71 aa, Glycine max
  Coding DNA Sequence Number=SeqID_43821
MGSSQKPSLKKRFYQVKIKSLEVTSLRELGQLMGQLQRQAFRKAYGKIWDLARVEVSHGTNCLPRPVLGIL

SEQ ID NO: 135507 - protein, 416 aa, Glycine max
  Coding DNA Sequence Number=SeqID_43822
MAPRKLASKSPRKDKAVEGTSSAPEYDSHRFRSAVHQQRFEAIKGWSFLRERRVQLRDDEYTDFQEEIGRQRWASLVTPMAKFDPEVVLEFYANAWPTEEGVRDMRSWVRGQWIPFDADAIGQLLGYPLVLEEGQECEYDQRRNQSDGFDEEAIAQLLCIPGQDFARTAAGRRVRIMRTNMTTLTQIWMTLLLSNILPTDHNSNLPLPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGPARSFAWSSIYKHLVRQQAANHRAHVQTHDCLYQMSLSMQSQGFASFSCPTPDQFRAEVAWPGDWPEVQAGEAPPEVPGDGEEAHEDEEMADLLDFLGRSGAT

SEQ ID NO: 135508 - protein, 207 aa, Glycine max
  Coding DNA Sequence Number=SeqID_43823
  Homolog annotation: Hit_ID=Q2HSV3; Match level="QueryCoverage=66%, HitCoverage=21%, E-value=4e-12, Identity=32%"; Hit description=IMP dehydrogenase/GMP reductase, putative
MTGIKGAPYQRRLDALTVTDVCWMPYGEHRGVRAFDLISSYTGQLIWGQIVVYVRPERVLRQFGYLQTIPPPPICDSLTDHLVPLGELCVVPGQVALDYMEWFFQISHPFVTRTEEIAASRHPPPPHHGEFVEPPIPEVSVATDLPTHSVGMAQDLGAIAEDLERVINLRMVTEGTDLHDIMTRCLRRVRGDAADGSLRPRQRHRID

SEQ ID NO: 135509 - protein, 26 aa, Glycine max
  Coding DNA Sequence Number=SeqID_43824
MTGDASKFTHTSPKKSGHVTYGDNNK

SEQ ID NO: 135510 - protein, 286 aa, Glycine max
  Coding DNA Sequence Number=SeqID_43825
GAPTEESMSPFLVRDLGAQNSETIQRIHKAWETSLRKDQELRGIRNGIIGGDHEWLKVRILGLNWLAKLKVVSEENFEAPEEDEELQTLKSELGKAKLAKEKFKLAATHVRKECAGLREENAITARALEQETKRARKEEYGRNKFRGALWGSNSELKLRREERDQSRAHSMVLKEELIACSRSKRSLSQHLCETETNMLAIIAKYQEELGLAMAHEHRIADEYAQVYAEKRLEEGDRLFTPRGNHVDGPICSYFEQESRTSPIASQGQSNGGHLLCPQEDPRTSQL

SEQ ID NO: 135511 - protein, 208 aa, Glycine max
  Coding DNA Sequence Number=SeqID_43826
  Gene Ontology: Mol. function=transporter activity; Cellular component= outer membrane-bounded periplasmic space; Biological process=transport
  Homolog annotation: Hit_ID=A6T592; Match level="QueryCoverage=100%, HitCoverage=64%, E-value=4e-98, Identity=87%"; Hit description =Taurine transport protein
  Pfam annotation: Domain name=NMT1; Domain location=31-207; Score= -49.6; E_value=0.00016; Accession=PF09084.2; Description=NMT1THI5 like
  Pfam annotation: Domain name=OpuAC; Domain location=24-207; Score =0.0; E_value=2.4e-05; Accession=PF04069.3; Description=Substrate binding domain of ABC-type glycine betaine transport system
  Pfam module annotation: Pfam domain module=NMT1::OpuAC; Domain location=31-207::24-207
  Subcellular localization annotation: CTP_CleavageSite=33; ConfidenceScore=5.14e-01
MAVTNTISAVSAALALMTFQAQAVNVTVAYQTSAEPAKVAQADNTFAKESGATVDWRKFDSGASVLRALASGDVQIGNIGSSPLAVAATQQLPIEAFLLASQLGNSEALVVKKGISSPKDLIGKRIAVPFISTTHYSLLAALKHWGIKPTQVQLVNLQPPAIIAAWQRGDIDGAYVWAPAVNELEKDGKVLTDSSQVGQWGSPTLDVW

SEQ ID NO: 135512 - protein, 37 aa, Glycine max
  Coding DNA Sequence Number=SeqID_43827
MEKNEETTTEEKALDLLHQWSPLLLEDHGSGMEKEER

SEQ ID NO: 135513 - protein, 73 aa, Glycine max
  Coding DNA Sequence Number=SeqID_43828
KAVASGGSNPARLVELDGNHLPYFAINRGGREEGRAEALPRRFHNVFREEFRKDFNRSSTFFIRSSSFFDLQR

SEQ ID NO: 135514 - protein, 82 aa, Glycine max
  Coding DNA Sequence Number=SeqID_43829
HPVGLIEARNQSWKPQGPVGLFRVHWGEIGIAVAGQNARVKSCPGMHSSCVIASLSGCPRTVGPPPISGGGPGTVKRKLLAP

SEQ ID NO: 135515 - protein, 150 aa, Glycine max
  Coding DNA Sequence Number=SeqID_43830
MTLLLSNILPSDRIANLPLQKYQLVCVVPTWGSHPQRHPVDLKKSNRALGFPALVTGLCRPYRAPVPPASSCRRGIGIAPAGHPVDPKKSNRVLGFPALITGLCQFYGVPVAPTRSLGPALTGLSSRSTAPPGRRRAKHHISIGMAGSGQ

SEQ ID NO: 135516 - protein, 98 aa, Glycine max
  Coding DNA Sequence Number=SeqID_43831
MTYLSSLEVASLSVNNHVSNVPPLCADLVHGAKDKQLRVKEPVRTHLICNPSRPLVTHLICNPSIMHCILSYPNFVRGPLLDDMRPFFGPCEVLGIHH

SEQ ID NO: 135517 - protein, 128 aa, Glycine max
  Coding DNA Sequence Number=SeqID_43832
  Gene Ontology: Mol. function=nucleic acid binding
  Homolog annotation: Hit_ID=Q2QQ59; Match level="QueryCoverage=57%, HitCoverage=10%, E-value=1e-10, Identity=40%"; Hit description =Transposon protein, putative, unclassified
MYVAFANHYGGYDKVGFIRKDIYNQEVHMRKQHTSYASGALKYLHDLRTKDPMMYVSCTADEGSRLQRLFWCDAERQLLYESSSNPLEIFHSLCKNPFTKSESHRDNPSLVFKNPYNLRDPRSLNQSL

SEQ ID NO: 135518 - protein, 126 aa, Glycine max
  Coding DNA Sequence Number=SeqID_43833
  Gene Ontology: Mol. function=nucleic acid binding
  Homolog annotation: Hit_ID=Q2QQ59; Match level="QueryCoverage=58%, HitCoverage=10%, E-value=1e-10, Identity=40%"; Hit description =Transposon protein, putative, unclassified
MHLPNHYGGYDKVGFIRKDIYNQEVHMRKQHTSYASGALKYLHDLRTKDPMMYVSCTADEGSRLQRLFWCDAERQLLYESSSNPLEIFHSLCKNPFTKSESHRDNPSLVFKNPYNLRDPRSLNQSL

SEQ ID NO: 135519 - protein, 72 aa, Glycine max
  Coding DNA Sequence Number=SeqID_43834
  Homolog annotation: Hit_ID=A5BKH5; Match level="QueryCoverage=44%, HitCoverage=6%, E-value=3e-08, Identity=81%"; Hit description =Putative uncharacterized protein
MKILQKKSNPMMNIPKEWKASKDHPLDNLIGDISKGNMVIEHNFSAPRTPQQNGVVERKNRSLEEIARTLIK

SEQ ID NO: 135520 - protein, 126 aa, Glycine max
  Coding DNA Sequence Number=SeqID_43835
MSLHSSSSVNGEGSTPKDPFSHNSCKSLSEELRDYYEGRNKSHLRPHSHRRENERKPQEANINLPYFHGKDNVEAYLDWEIRIEQKLKRKPTLKSYGSHYYPKKDQGLGILGATPSKPKDDKGKTI

SEQ ID NO: 135521 - protein, 320 aa, Glycine max
  Coding DNA Sequence Number=SeqID_43836
  Homolog annotation: Hit_ID=Q2HW90; Match level="QueryCoverage=70%, HitCoverage=43%, E-value=1e-22, Identity=34%"; Hit description =Putative uncharacterized protein
MDILALLIFGVVLFPNVDGLVDLAAIDAFLAYHHSKESLVVAVLADLFDTFDRRCEKSSARIICCLPALCVWLVSHLFQQDIRHPCPLQSHRSCVEKRRVDWDQHLEGIGGRTVNWFPRWKEGKEGVLFSCGGYPNIPLIGTRGCINYNPSLAIRQLGYPMRGAPTEESLSLFLVRDFGAQNFKVIQRVHKAWDSPLRKDKELRGICNGIIGGYHEWLKVRTRGLGWLTKLKIISEENFEAPEEDEEVRALKTELGKARLAKEKFKLVAIDVRKECVGLREENAATAKALEQETKRARKEEHGCDKFRGALWGSNSELKL

SEQ ID NO: 135522 - protein, 133 aa, Glycine max
  Coding DNA Sequence Number=SeqID_43837
MPLPQEPLNERPRGLARKSMAGTNFAELYGLSSPKYQEELGLATAHEHRIADEYAQVYAEKEARGRVIDSLHQEATMWMDRFALTLNGSQELPRLLANANAMADTYSAPEEIHGLLGYCQHMIDLMTHIIRNR

SEQ ID NO: 135523 - protein, 32 aa, Glycine max
  Coding DNA Sequence Number=SeqID_43838
MASIGIIPFEEHTAAVGTTSNNMFSKRKTLDE

SEQ ID NO: 135524 - protein, 88 aa, Glycine max
  Coding DNA Sequence Number=SeqID_43839
MSILASFIYLFFYSALLALSLYSHPQVLPPQPAGTIAGHNQFSSHRHCSVCAVSNSEHVLHQRDSEFGSNTALKVIVVTHNAQCGINL

SEQ ID NO: 135525 - protein, 124 aa, Glycine max
  Coding DNA Sequence Number=SeqID_43840
MFNAGTLSMEFGDIVVHFNILDAMKHPSEDHSIFRPEIIDQIVDDYMFDFVLHGSTYTSDFLYEVQAEEPSSSPTIVPPTVQPPPTPELKPLPANLKYAYLEDKEKFPVVISASLDVEQEEKLF

SEQ ID NO: 135526 - protein, 95 aa, Glycine max
  Coding DNA Sequence Number=SeqID_43841
MTLQLVDRSITRPYSVVEDVLVKKVTFNLFDAIKHPNDHRACFKMEVVEHEVAMVVQGMTSQSPLEKALTNAVECLTKEEEKDLKRCLEELEGLK

SEQ ID NO: 135527 - protein, 106 aa, Glycine max
  Coding DNA Sequence Number=SeqID_43842
MGSVLIPCVNKRTEGPYHLLNCTHGALRPQMRKIAIPWIIGLNQAHAFIKRFIKSKYGSNRLAKLGQKMNRVTSLLRLLPNIFRIVDVLVTSIFTLTKMSWTMLKI

SEQ ID NO: 135528 - protein, 86 aa, Glycine max
  Coding DNA Sequence Number=SeqID_43843
MPLRSLDRLWLEESIHIDIPGSHTCLSHMPIVVNTKYAETLTTVCNFRQIFMLYVQGEVFIKQVKQGSIPHNLQWLQKKPWDGQCH

SEQ ID NO: 135529 - protein, 110 aa, Glycine max
  Coding DNA Sequence Number=SeqID_43844
MAPRKLASKRSRKDKAAEGTNSAPEYDSHHFRSAEHQQRFEAIKGWSFLRERRVQLRDDEYTDFQEEIVCRRWASLVTPMATFDPDIVLEFYANAWPIEEGVRDMRSWVR
